United States Patent 11,098,302 (IDENTIFICATION OF POLYNUCLEOTIDES ASSOCIATED WITH A SAMPLE) - sequence listing, part 94

SEQ ID NO: 324654 - DNA, 528 bp, Homo sapiens
  misc_feature: GZ8MTXP01DR66H.38.55.E11.1.454.CMB.2.raw
  modified_base (264)..(264): a, c, t, g, unknown or other
  misc_feature (264)..(264): n is a, c, g, or t
  modified_base (268)..(268): a, c, t, g, unknown or other
  misc_feature (268)..(268): n is a, c, g, or t
  modified_base (274)..(274): a, c, t, g, unknown or other
  misc_feature (274)..(274): n is a, c, g, or t
  modified_base (293)..(293): a, c, t, g, unknown or other
  misc_feature (293)..(293): n is a, c, g, or t
  modified_base (302)..(302): a, c, t, g, unknown or other
  misc_feature (302)..(302): n is a, c, g, or t
  modified_base (370)..(370): a, c, t, g, unknown or other
  misc_feature (370)..(370): n is a, c, g, or t
  modified_base (382)..(382): a, c, t, g, unknown or other
  misc_feature (382)..(382): n is a, c, g, or t
  modified_base (489)..(489): a, c, t, g, unknown or other
  misc_feature (489)..(489): n is a, c, g, or t
  modified_base (511)..(511): a, c, t, g, unknown or other
  misc_feature (511)..(511): n is a, c, g, or t
tcagtcgatcacgtcacgaccggtgctcgatttagcactcgcacgttgggtttggggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggagcagctccaacattggagtattaattttgtctcctggtaccagcagctccaggaacagccccaaancctnatttangaccataataggcaccctnaggattccngaccgattctctggctccaagtctggcacgtcagcccacctggcatccaccgcctcagactggggacngcctattatacngacgaacagtgggataccagactagaatggcgtttggggtgtcgtcgggtggacggccaggctgaccgtcaggtcaacgcccgaagggcttcgcccccgtggttccncttcctcgtccccaacccttcncacggtcttaacgtccg

SEQ ID NO: 324655 - DNA, 517 bp, Homo sapiens
  misc_feature: GZ8MTXP01AGTBU.38.55.E11.1.454.CMB.2.raw
  modified_base (208)..(208): a, c, t, g, unknown or other
  misc_feature (208)..(208): n is a, c, g, or t
  modified_base (215)..(215): a, c, t, g, unknown or other
  misc_feature (215)..(215): n is a, c, g, or t
  modified_base (501)..(501): a, c, t, g, unknown or other
  misc_feature (501)..(501): n is a, c, g, or t
  modified_base (503)..(504): a, c, t, g, unknown or other
  misc_feature (503)..(504): n is a, c, g, or t
  modified_base (506)..(517): a, c, t, g, unknown or other
  misc_feature (506)..(517): n is a, c, g, or t
tcagtcgatcacgtcacgaccggtgctcgatttagcactcgcacgttgggttggccgtattaaaagtgaaactgatggtgggacaacagactacgctgcacccgtgaaaggcagattcaccatctcaagagatgattcaacgaacacgctctttctacaaatgatcagcctagaaaaccgaggacacagccgtgtattactgtaccanagggaanagcagttatatgatagtagtgttatctgtactactacggtatggacgtcgtggggaccaagggaccacggtcattcgtcctccccagccctccaccgaacgggccccagtccggtccttccccctggccacccctcctccaagacgccaccgtcggtcgggggccacgacggcccggcccgtggggcctcggcccgtaggggtaccaaacgggtaccttacgttacccgacggtcgaacttccggaacgtgggacggccggggctggggaccgaagggcgacaagngnngnnnnnnnnnnnn

SEQ ID NO: 324656 - DNA, 581 bp, Homo sapiens
  misc_feature: GZ8MTXP01CHE6G.38.55.E11.1.454.CMB.2.raw
  modified_base (501)..(501): a, c, t, g, unknown or other
  misc_feature (501)..(501): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgcttatttttaaaggtgtccagtgtgaggtgcagctggtggagtcgtgggggaggcgttgggaaagccgtgggggtcccttagactctcctgtacagcctctggattctacttttagtatgcctggatgacctgggtccgccaggctccgaggaaggggctggaagtggggtggaccgtaagttaaaagtgaaactgagtgggtaggacaacgagactaacgctgcacccgtagaaacggcagactcacatctacaagagatgaacttacaacgaacacgtctactttactaactaaatgactacgagaccctaacgaaaaccgaggacanacgccgtagtaactacttagtaaccacgaagggaagagcttagttaattataagtaataggttagtaaggtttaataacg

SEQ ID NO: 324657 - DNA, 491 bp, Homo sapiens
  misc_feature: GZ8MTXP01ECZRW.38.55.E11.1.454.CMB.2.raw
  modified_base (210)..(210): a, c, t, g, unknown or other
  misc_feature (210)..(210): n is a, c, g, or t
  modified_base (217)..(217): a, c, t, g, unknown or other
  misc_feature (217)..(217): n is a, c, g, or t
  modified_base (480)..(481): a, c, t, g, unknown or other
  misc_feature (480)..(481): n is a, c, g, or t
  modified_base (483)..(491): a, c, t, g, unknown or other
  misc_feature (483)..(491): n is a, c, g, or t
tcagtcgatcacgtcacgaccggtgctcgatttagcactcgcacgttgggttggccgtattaaaaagtgaaactgatggtgggacaacagactacgctgcacccgtgaaaggcagattcaccatctcaagagatgattcaaacgaacacgctctttctacaaatgatcagcctagaaaaccgaggacacagccgtgtattactgtaccanagggaanagcagttattatgatagtagtgttatctgtactactacggtatggacgtcgtgggccgaaggaccgacggtcattcgtcctccccacgccctcccacccgaacgggccccacgtccggtcccttcccccgtcggccacccctcctccaagacgcacctcgtcgggggcacgacgccgcccgtgggctcgccgtggtacgaacggtacctacttccgacgtcgactcgacgtgacggcgggcgtggacgaagggcgacagtagnngnnnnnnnnn

SEQ ID NO: 324658 - DNA, 445 bp, Homo sapiens
  misc_feature: GZ8MTXP01B5EII.38.55.E11.1.454.CMB.2.raw
  modified_base (208)..(208): a, c, t, g, unknown or other
  misc_feature (208)..(208): n is a, c, g, or t
  modified_base (215)..(215): a, c, t, g, unknown or other
  misc_feature (215)..(215): n is a, c, g, or t
  modified_base (436)..(437): a, c, t, g, unknown or other
  misc_feature (436)..(437): n is a, c, g, or t
  modified_base (439)..(445): a, c, t, g, unknown or other
  misc_feature (439)..(445): n is a, c, g, or t
tcagtcgatcacgtcacgaccggtgctcgatttagcactcgcacgttgggttggccgtattaaaagtgaaactgatggtgggacaacagactacgctgcacccgtgaaaggcagattcaccatctcaagagatgattcaaacgaacacgctctttctacaaatgatcagcctgaaaaccgaggacacagccgtgtattactgtaccanagggaanagcagttatatgatagtagtgttatctgtactactacggtatggacgtctggggccaagggaccacggtcattgtctccccagcctccaccagggcccatcggtcttcccctggccaccctcctccaagacgcacctcgtcgggggcacgagcggccctgggctgcctggtcaaggctactcacgtgatcgactggagcgggctggcaagggcgacatagnngnnnnnnn

SEQ ID NO: 324659 - DNA, 425 bp, Homo sapiens
  misc_feature: GZ8MTXP01BS251.38.55.E11.1.454.CMB.2.raw
  modified_base (180)..(180): a, c, t, g, unknown or other
  misc_feature (180)..(180): n is a, c, g, or t
  modified_base (214)..(214): a, c, t, g, unknown or other
  misc_feature (214)..(214): n is a, c, g, or t
  modified_base (336)..(336): a, c, t, g, unknown or other
  misc_feature (336)..(336): n is a, c, g, or t
  modified_base (353)..(353): a, c, t, g, unknown or other
  misc_feature (353)..(353): n is a, c, g, or t
  modified_base (419)..(425): a, c, t, g, unknown or other
  misc_feature (419)..(425): n is a, c, g, or t
tcagtcgatcacgtcacgaccggtgctcgatttagcactcgcacgttgggttggccgtattaaaagtgaaactgatggtgggacaacagactacgctgcacccgtgaaaggcagattcaccatctcaagagatgattcaacgaacacgctctttctacaaatgatcagcctgaaaaccgnggacacagccgtgtattactgtaccacagggaanagcagttattatgatagtagtgttatctgtactactacggtatggacgtctggggccaagggaccacggtcattgtctccccagcctccaccaggcccatcgtctcccctgcaccctctcancgcactctcggggcacngcgccctgggctgcctggcaggactacttcacgtgatcgactgagcgggctggcaaggcgcatagnnnnnnn

SEQ ID NO: 324660 - DNA, 538 bp, Homo sapiens
  misc_feature: GZ8MTXP01DE8X5.38.55.E11.1.454.CMB.2.raw
  modified_base (237)..(237): a, c, t, g, unknown or other
  misc_feature (237)..(237): n is a, c, g, or t
  modified_base (262)..(262): a, c, t, g, unknown or other
  misc_feature (262)..(262): n is a, c, g, or t
  modified_base (295)..(295): a, c, t, g, unknown or other
  misc_feature (295)..(295): n is a, c, g, or t
  modified_base (437)..(437): a, c, t, g, unknown or other
  misc_feature (437)..(437): n is a, c, g, or t
  modified_base (501)..(501): a, c, t, g, unknown or other
  misc_feature (501)..(501): n is a, c, g, or t
  modified_base (522)..(522): a, c, t, g, unknown or other
  misc_feature (522)..(522): n is a, c, g, or t
tcagtcgatcacgtcacgaccggtgctcgatttagcactcgcacgttgggtttggggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggagcagctccaacattggagtataattttgctctggtaccngcagctccaggaacagcccccaaancctcatttatgaccaataataggccgaaccctnagggattcctgaccgattctctggcctcaagtctggcaccgtcacgccacccgtggcatccgaccggcctccgagacgtggggacagggccagttatacgtgcggaaacagtgggataccagactgaactgacgttggggtncgtcgggtggacggaccaggctgacccgtctagggtcaacgcccaagggccttgccccctggcnccttctcgttccccgccttcncgacgtcgaacttccg

SEQ ID NO: 324661 - DNA, 454 bp, Homo sapiens
  misc_feature: GZ8MTXP01DVH9F.38.55.E11.1.454.CMB.2.raw
  modified_base (181)..(181): a, c, t, g, unknown or other
  misc_feature (181)..(181): n is a, c, g, or t
  modified_base (208)..(208): a, c, t, g, unknown or other
  misc_feature (208)..(208): n is a, c, g, or t
  modified_base (215)..(215): a, c, t, g, unknown or other
  misc_feature (215)..(215): n is a, c, g, or t
  modified_base (355)..(355): a, c, t, g, unknown or other
  misc_feature (355)..(355): n is a, c, g, or t
  modified_base (450)..(454): a, c, t, g, unknown or other
  misc_feature (450)..(454): n is a, c, g, or t
tcagtcgatcacgtcacgaccggtgctcgatttagcactcgcacgttgggttggccgtattaaaagtgaaactgatggtgggacaacagactacgctgcacccgtgaaaggcagattcaccatctcaagagatgattcaacgaacacgctctttctacaaatgatcagcctagaaaaccgnggacacagccgtgtattactgtaccanagggaanagcagttattatgatagtagtggttatctgtactactacggtatggacgtcgtggggccaagggaccacggtcattgtcctccccacgcctccaccaagggcccatccggtccttcccctggcacccctcctccaagacncacctcgtcggggccacagcggccctgggctgcctgggtaccaaggtactacttccacgtgatcgactggagcgggcgtggcaagggcacatagnnnnn

SEQ ID NO: 324662 - DNA, 684 bp, Homo sapiens
  misc_feature: GZ8MTXP01CBCAQ.38.55.E11.1.454.CMB.2.raw
  modified_base (209)..(209): a, c, t, g, unknown or other
  misc_feature (209)..(209): n is a, c, g, or t
  modified_base (276)..(276): a, c, t, g, unknown or other
  misc_feature (276)..(276): n is a, c, g, or t
tcagtcgatcacgtcacgaccggtgctcgatttagcactcgcacgttgggtttgggacaatcttcatcatgacctgctcccctctcctcctcacccttctcattcactgcacagggtcctgggcccagtctgtgttgacgcagccgccctcagtgtctgccggcccaggacagaagtcaccatctcctgctcgtggagcagctaccaanattggatattaattttgctcctggtaccagcagctccaggaacacgcccccaaactcctacatttancgaaccaataatacggcgacccctgacggtacttccgtagaccgtattcctacgtcggactcctaagtctggctaccgtcacgcccacccgtggacacgtccacccgggcctacccgagaccgtcgggggacacgggtaccctaagttactacgtcggaaccggaaacgagttacggggaattacccgaagaccgtaagaacgttcggtcgggtttaggggtcgtcggttacggggtagggaacgggaccgaaggtccgttaccggacccggttaccgtacggtcccgaaacggtccccgaaacggggtcccttaccccggtcccccgtccgggttacccttaccggttcccttcccgttacccccgtaaccccttcccgtacccgacgttaacgccgtttaacccgg

SEQ ID NO: 324663 - DNA, 608 bp, Homo sapiens
  misc_feature: GZ8MTXP01BBIEO.38.55.E11.1.454.CMB.2.raw
  modified_base (565)..(565): a, c, t, g, unknown or other
  misc_feature (565)..(565): n is a, c, g, or t
  modified_base (585)..(585): a, c, t, g, unknown or other
  misc_feature (585)..(585): n is a, c, g, or t
tcagtcgatcacgtcacgaccggtgctcgatttagcactcgcacgttgggtttggggacaatcttcatcatgacctgctcccctctcctcctcacccttctcattcactgcacagggtcctgggcccagtctgtgttgacgcagccgcctcagtgtctgcggccccaggacagaaggtcaccatctcctgctctggaggcagctccaacattggagtattaattttgtctcctggtaccagcagctcccaggaaccacgcccccaaactcctacatttatcgaaccataaagtacggccgaacccctcgagggtacttcctgaccgtattctctggctccaagtctggcaccgtcacgccctaccccgtggaccactcccgacccgggccctccgaacggaccgtgggggaaccgacgggcccgtaatttacttacgaggaccggtaaacagtcgggaatacccgagactagaactggtcggttggggtgcgtacgggtggacgggccaggtccgtcgacccgttcagggtccaacggccgaggccttccgccccctcgggttcnccgttcgtccggttcccccncccgtctcgttacgtcgcgtccg

SEQ ID NO: 324664 - DNA, 511 bp, Homo sapiens
  misc_feature: GZ8MTXP01AEI6R.38.55.E11.1.454.CMB.2.raw
  modified_base (263)..(263): a, c, t, g, unknown or other
  misc_feature (263)..(263): n is a, c, g, or t
  modified_base (292)..(292): a, c, t, g, unknown or other
  misc_feature (292)..(292): n is a, c, g, or t
  modified_base (301)..(301): a, c, t, g, unknown or other
  misc_feature (301)..(301): n is a, c, g, or t
  modified_base (476)..(476): a, c, t, g, unknown or other
  misc_feature (476)..(476): n is a, c, g, or t
tcagtcgatcacgtcacgaccggtgctcgatttagcactcgcacgttgggtttggggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaggcagctccaacattggagataattttgctcctggtaccagcagctcccaggaacagccccaaancctcatttatgaccataataggcaccctnaggattccngaccgattctctggctccaagtctggcaccgtcagccaccctggcatcaccggcctcagactggggacagccgattatactgcggaacatgggataccagactgaatgcgttggggtgctcgggtggagggaccaggctgaccgtcgtaggcaagcccaggcttcgcccctggcncttctcgttccccgcctcctcaccgtgaacgtccg

SEQ ID NO: 324665 - DNA, 768 bp, Homo sapiens
  misc_feature: GZ8MTXP01C9F14.38.55.E11.1.454.CMB.2.raw
  modified_base (152)..(152): a, c, t, g, unknown or other
  misc_feature (152)..(152): n is a, c, g, or t
  modified_base (285)..(285): a, c, t, g, unknown or other
  misc_feature (285)..(285): n is a, c, g, or t
  modified_base (513)..(513): a, c, t, g, unknown or other
  misc_feature (513)..(513): n is a, c, g, or t
tcagtcgatcacgtcacgaccggtgctcgatttagcactcgcacgttgggtttggggacaatcttcatcatgacctgctcccctctcctcctcacccttctcattcactgcacagggtcctgggcccagtctgtgttgacgcagccgccctnagtgtctgcggccccaggacagaaggtcaccatctcctgctctggaggcagctccaacattggatattaattttgtctcctggtaccagcagcctcccaggaacacgacccccaaactccctactattttacncgaaccaataacgtacggaccgacccctacgaacggggtactttccccgtacgaaccccgtatttccgttaccgttcgggaccttacccgtaaaggttccttggggaccctaacccggttccaaacggtcccctaaccccggttggggaaccctaacgttcccgaacccgggtccctacccgaacggaccggtcgggggaacgacgggtaccctaatttacgttacgnggtaccggaaagacgttagggaacttaccgaggtaactgaaacttcggtacgggtttggggcgtccggttcggggaggggaacgggtaccgagggtaccgttcggaacccggttaccgtaggggttcccaacgggaccccgttaaaggggtcccttcccgggtcccccgttcgggttacccgttaccgtttccccgttcccggttacccccaacccctttccccgtcgaacccggtttcgaaccgtttaacccgg

SEQ ID NO: 324666 - DNA, 591 bp, Homo sapiens
  misc_feature: GZ8MTXP01DB4RC.38.55.E11.1.454.CMB.2.raw
  modified_base (410)..(410): a, c, t, g, unknown or other
  misc_feature (410)..(410): n is a, c, g, or t
  modified_base (419)..(419): a, c, t, g, unknown or other
  misc_feature (419)..(419): n is a, c, g, or t
  modified_base (461)..(461): a, c, t, g, unknown or other
  misc_feature (461)..(461): n is a, c, g, or t
tcagtcgatcacgtcacgaccggtgctcgatttagcactcgcacgttgggtttggggagatctgggagaggagccccagccatgggattcccaagtgttttcattcagtgatcaggactgaacacagaggactcaccatggagtttgggctgagctggattttccttgctgctatttaaaggtgtcagtgtgaggtgcagctggtggagtcgtgggggaggcgttgggaaagcgtggggggtcccttagactctcctgtacagcctctggattctactttagtatgcctggatgaccgtggtccgccaggctccgagggaagggctggaagtggggttgaccgtattaaagtgaaactgactgggtaggacaacagaactacgctgcacccgtgaaagcagacttcacanctacaaganatagattacgaacgacaacgtcttactttactactaaattanactacgacgaccgtaacgaaaaccgacgaacacgacgacgtaagttagttacttaaccgttacgtaaaccgaacggaagggaagacgtaacgttaagttaattagtagttaagttaacgttaaggttaag

SEQ ID NO: 324667 - DNA, 609 bp, Homo sapiens
  misc_feature: GZ8MTXP01DEK2T.38.55.E11.1.454.CMB.2.raw
  modified_base (542)..(542): a, c, t, g, unknown or other
  misc_feature (542)..(542): n is a, c, g, or t
  modified_base (563)..(563): a, c, t, g, unknown or other
  misc_feature (563)..(563): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggtattttccttgctgctatttaaaaggtgtcagtgtgaggtgcagctggtggagtcgtgggggaggcgttgggaagccgtggggggtccctagactctcctgtacagcctctggattctacttttagtatgcctggatgaccgtggtccgccaggctccgagggaaaggggctagggaagtgggttagaccgtaagttaaaagtgaaactgagtggtagggacaacgagactaaacgctgacacccgagaacgcagactacacatctacaagagtatagaattaccaaacggaaccacgacttactttaccaaataaatacgtataccgacgaacccgtaagaaaaccggacgaacaacgacgtaccgttagtaactttaaccgngtaaacccagaaaggggaaanagttacttagttaataagtgtaatagttagtaacggttaattaacg

SEQ ID NO: 324668 - DNA, 812 bp, Homo sapiens
  misc_feature: GZ8MTXP01C2CD1.38.55.E11.1.454.CMB.2.raw
  modified_base (291)..(291): a, c, t, g, unknown or other
  misc_feature (291)..(291): n is a, c, g, or t
tcagtcgatcacgtcacgaccggtgctcgatttagcactcgcacgttgggtttggggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaggcagctaccaactattggagtattaatttttgtcctccgtaggtaccagcagcctacccgaggaacacgacccccaaactcctactatttancgaacctaataagtacggccgaacccctgacgggtactttcccgtagacccgtatttcctacgttcggccttaccgaacgttcgtgggacctacccggtccaacgtccccgaaccccgtcgggaaccctactccccgaaacccgggtccccttacccggaaggacccggtacggggggaaaccgacggggtaccccggttaaatttaccgtttaaccgtacgggaccgggtaaaccagggttacggggtaacctaacccgaaggtaacctaggtaaacgttcggttaccggggtttgggggtcgggtcccggtttagggggtacggggaaaccgggggacccgtacggggtaccgttacgggtaaccccgggttcccgtaaggggttcccgaaccgggtaccccgaaagggtccccttccgggtaacccccccgttccggggttacccttccgttcccggttcccgtttccccccgccctttaccccgccgttaaccggttcgttaaccgttaaccccggg

SEQ ID NO: 324669 - DNA, 591 bp, Homo sapiens
  misc_feature: GZ8MTXP01DNKJB.38.55.E11.1.454.CMB.2.raw
  modified_base (309)..(309): a, c, t, g, unknown or other
  misc_feature (309)..(309): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtcgtgggggaggcgttgggaaagccgtggggggtcccttagactctcctgtacagcctctggattcacttttagtatgcctggatgacctgggtccncaggctccgaggaaaggggctaggagtgggtggaccgtaattaaaagtgaaactggagtgggtagggacaacgagactaacgctgcacccgtagaaagcagacttcaccatctacaagagatagattacaaacgaacacgtcttactttactaacaaattgaactcgaacgcctaagaaaaccgaggaccaacgacgtccgttagtaacttacgttagtacccaaggagggaagacgcttaggtttaattagtgtaataggttaggttggtttaacttaacg

SEQ ID NO: 324670 - DNA, 548 bp, Homo sapiens
  misc_feature: GZ8MTXP01AUGAA.38.55.E11.1.454.CMB.2.raw
  modified_base (264)..(264): a, c, t, g, unknown or other
  misc_feature (264)..(264): n is a, c, g, or t
  modified_base (274)..(274): a, c, t, g, unknown or other
  misc_feature (274)..(274): n is a, c, g, or t
  modified_base (456)..(456): a, c, t, g, unknown or other
  misc_feature (456)..(456): n is a, c, g, or t
  modified_base (468)..(468): a, c, t, g, unknown or other
  misc_feature (468)..(468): n is a, c, g, or t
  modified_base (518)..(518): a, c, t, g, unknown or other
  misc_feature (518)..(518): n is a, c, g, or t
  modified_base (532)..(532): a, c, t, g, unknown or other
  misc_feature (532)..(532): n is a, c, g, or t
  modified_base (538)..(538): a, c, t, g, unknown or other
  misc_feature (538)..(538): n is a, c, g, or t
tcagtcgatcacgtcacgaccggtgctcgatttagcactcgcacgttgggtttgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaggcagctccaacattggagtataattttgctcctggtaccagcagctccaggaacacgccccaaacncctcatttangaccataatacggcgaccctcaggacttcctgaccgtattctctggcctcaagtctggcaccggtcacgcccacccgtgggaccactcgacccggcctacccgagaccgtgggggaacacggcccgtatttaacgtacgtggacggaaacagtagggactaccgagactgaatgcgttgggngcgtcgggaggnggaccaggcctgccgtctaggcaacgcccgaggcttcgcccctggttccncgttcctcgtcccncctccncacgtgctcg

SEQ ID NO: 324671 - DNA, 552 bp, Homo sapiens
  misc_feature: GZ8MTXP01CHMKK.38.55.E11.1.454.CMB.2.raw
  modified_base (207)..(207): a, c, t, g, unknown or other
  misc_feature (207)..(207): n is a, c, g, or t
  modified_base (237)..(237): a, c, t, g, unknown or other
  misc_feature (237)..(237): n is a, c, g, or t
  modified_base (266)..(266): a, c, t, g, unknown or other
  misc_feature (266)..(266): n is a, c, g, or t
  modified_base (520)..(520): a, c, t, g, unknown or other
  misc_feature (520)..(520): n is a, c, g, or t
  modified_base (539)..(539): a, c, t, g, unknown or other
  misc_feature (539)..(539): n is a, c, g, or t
tcagtcgatcacgtcacgaccggtgctcgatttagcactcgcacgttgggtttgggacaatcttcatcatgacctgctcccctctcctcctcacccttctcattcactgcacagggtcctgggcccagtctgtgttgacgcagccgccctcagtgtctgcggccccaggacagaagtcaccatctcctgctctggagcagctccaanattggagtattaattttgctcctggtaccngcagctccaggaacacgccccaaatcctnatttatgacctataatacggcaccctgaggacttcctgaccgtattctctggctaccaagtctggccaccgtcacgcccacccgtggacactccacccggcctccgagacgtgggggacaggccgtattatacgtgacggaacagtagggactaccgagtactagaagtggcggtttggggtcgtccgtcgggtagggacgggaccgaggctcggtacccgtcgtaggcaacgccgaggcttccgccccgtgcncttctcgtcccaaccctcncagtcgaacgtcg

SEQ ID NO: 324672 - DNA, 619 bp, Homo sapiens
  misc_feature: GZ8MTXP01CW8UF.38.55.E11.1.454.CMB.2.raw
  modified_base (437)..(437): a, c, t, g, unknown or other
  misc_feature (437)..(437): n is a, c, g, or t
  modified_base (444)..(444): a, c, t, g, unknown or other
  misc_feature (444)..(444): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctattttaaaggtgtccagtgtgaggtgcagctggtggagtcgtgggggaggcgttgggaaagccgtggggggtcccttagactctcctgtacagcctctggattcacttttagtatgcctggatgacctgggtccgccaggctccgaagggaacggggctagggaatgggggttggaccgtaattaaaagtgaaacgtggagtcggtaggggacaacgagactaaacgctgacacccgtagaaaggcaagactacactatcctanaaggaanatagtaactacaaacgaactacgtacttactttacaaacgtaaactgtaactacaacgtacctaaacgaaaaccgacgaacacgtacgtccgtagttaacttacgacgtaaccgaacgtaaagggaacagttcttaagtttaatagtaagtaagttagttagttcgtttaagtcg

SEQ ID NO: 324673 - DNA, 596 bp, Homo sapiens
  misc_feature: GZ8MTXP01A19GB.38.55.E11.1.454.CMB.2.raw
  modified_base (266)..(266): a, c, t, g, unknown or other
  misc_feature (266)..(266): n is a, c, g, or t
  modified_base (305)..(305): a, c, t, g, unknown or other
  misc_feature (305)..(305): n is a, c, g, or t
  modified_base (320)..(320): a, c, t, g, unknown or other
  misc_feature (320)..(320): n is a, c, g, or t
  modified_base (338)..(338): a, c, t, g, unknown or other
  misc_feature (338)..(338): n is a, c, g, or t
  modified_base (370)..(370): a, c, t, g, unknown or other
  misc_feature (370)..(370): n is a, c, g, or t
  modified_base (411)..(411): a, c, t, g, unknown or other
  misc_feature (411)..(411): n is a, c, g, or t
  modified_base (461)..(461): a, c, t, g, unknown or other
  misc_feature (461)..(461): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagcgtgatttccttgctgctatttaaagtgtccagtgtgaggtgcagctggtggagtcgtgggggaggcttgggaaagccgtggggggtcccttagactctcctgtacagtccnctggattctacttttagtatgcctggatgactgggtccncagctcaggaaggcnggatggtgcgtataaagngaaactgatcggtgggacaacgagactaacgntgcacccgtagaaaggcaagattacacctatcctagaaagngattacgacttacgaaaccacgaaccttacttacttaacaacgtaaagtntacacacgacgtaacgaaaccgaacgaacgacgacgtacgtacgtaacttaacttacgtaacgaacgaaacggaaggaacgttacgttacgttaattaagtaagtaagtaggttaggttaaggtttaagttaacg

SEQ ID NO: 324674 - DNA, 609 bp, Homo sapiens
  misc_feature: GZ8MTXP01BNE3J.38.55.E11.1.454.CMB.2.raw
  modified_base (414)..(414): a, c, t, g, unknown or other
  misc_feature (414)..(414): n is a, c, g, or t
  modified_base (561)..(561): a, c, t, g, unknown or other
  misc_feature (561)..(561): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctatttaaagtgtccagtgtgaggtgcagctggtggagtcgtgggggaggcgttgggaaagccgtggggggtcccttagactctcctgtacagcctctggattctacttttagtatgcctggatgaccgtgggtccgccaggctccgaggaaggggctggaagtgggtgcgtattaaagtgaaactgatggtggacaacagactaacgctgcacccgtagaaacgcagattcaccatacctanaaagagatagtaacttacgaaaccgaacgaacgtcttactttactaacgaaaattcgaacttcaacgtccctaaggaaaaacccgagggaaccaacggacgtacccggttgtaaacgtttacacggtaaacccaggtaaaggggaanagttcttaaggtttaatatggtaatacggttagtggtttaactaaccg

SEQ ID NO: 324675 - DNA, 566 bp, Homo sapiens
  misc_feature: GZ8MTXP01BHK4B.38.55.E11.1.454.CMB.2.raw
  modified_base (302)..(302): a, c, t, g, unknown or other
  misc_feature (302)..(302): n is a, c, g, or t
  modified_base (444)..(444): a, c, t, g, unknown or other
  misc_feature (444)..(444): n is a, c, g, or t
  modified_base (507)..(507): a, c, t, g, unknown or other
  misc_feature (507)..(507): n is a, c, g, or t
  modified_base (524)..(524): a, c, t, g, unknown or other
  misc_feature (524)..(524): n is a, c, g, or t
  modified_base (529)..(529): a, c, t, g, unknown or other
  misc_feature (529)..(529): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctatttaaaaggtgtcagtgtgaggtgcagctggtggagtcgtgggggagcgttgggaagccgtgggggtcccttagactctctgtacagcctctggattctacttttagtatgcctggatgactggtccncaggctccgaggaagggctaggagtgggtgacgttaagttaaaagtgaaagtgagtgggtagggaacaagtagactaacgctcgccacccggtagaaaggcagattacaccatcacgaagagatagacttacaaacgacacnctactttacaagtaaatgatacgacacctagaaaacgacgacacgagtccgtagtaacttacngtaaccagaaagggaanagttnttaagttaatagtgtacgtaggttagtcgttaataag

SEQ ID NO: 324676 - DNA, 584 bp, Homo sapiens
  misc_feature: GZ8MTXP01EIBER.38.55.E11.1.454.CMB.2.raw
  modified_base (308)..(308): a, c, t, g, unknown or other
  misc_feature (308)..(308): n is a, c, g, or t
  modified_base (412)..(412): a, c, t, g, unknown or other
  misc_feature (412)..(412): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtcgtgggggaggcgttgggaaagccgtggggggtcccttagactctcctgtacagcctctggattctactttagtatgcctggatgacctggtccncaggctcgaggaagggctggatgggtgcgtataaagtgaaactgatggtgggacaacgagactaacgctgcacccgtagaacgcagattcaccatctacaaganatagattacaacgaacacgcttactttacaacgaaatgaatccaagaccctaagaaaaccgaggaccaacgtacgcccgtgtaaattaccgttagtaaacccaacggtaaggggaaagacgttcgttaaagtttaattagtgtaagttaggttaagttggtttaactttcgg

SEQ ID NO: 324677 - DNA, 565 bp, Homo sapiens
  misc_feature: GZ8MTXP01DS4KY.38.55.E11.1.454.CMB.2.raw
  modified_base (309)..(309): a, c, t, g, unknown or other
  misc_feature (309)..(309): n is a, c, g, or t
  modified_base (426)..(426): a, c, t, g, unknown or other
  misc_feature (426)..(426): n is a, c, g, or t
  modified_base (526)..(526): a, c, t, g, unknown or other
  misc_feature (526)..(526): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctattttaaaggtgtccagtgtgaggtgcagctggtggagtcgtgggggaggcgttggggaaagccgtggggggtcccttagactctcctgtacagcctctggattcacttttagtatgcctggatgacctgggtccnccaggctccaggaaggggctggaagtggggttggccgtaagttaaaagtgaaactgagtggtgggacaacagactaacgctgcacccgtagaaaggcagattcaccatctacaaganatagattacaaacgaacacgcttactttactaacaaattgaatcagccctagaaaccgagacacagccgttgtaattacttagtaacccaagaggggaanaggcttaagttaattatgtaagtagttagtgttaagttc

SEQ ID NO: 324678 - DNA, 588 bp, Homo sapiens
  misc_feature: GZ8MTXP01EO0LD.38.55.E11.1.454.CMB.2.raw
  modified_base (269)..(269): a, c, t, g, unknown or other
  misc_feature (269)..(269): n is a, c, g, or t
  modified_base (307)..(307): a, c, t, g, unknown or other
  misc_feature (307)..(307): n is a, c, g, or t
  modified_base (544)..(544): a, c, t, g, unknown or other
  misc_feature (544)..(544): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctatttaaaaggtgtccagtgtgaggtgcagctggtggagtcgtgggggaggcgttgggaaagccgtgggggtcccttagactctcctgtacagcctntggattctacttttagtatgcctggatgacctggtccnccaggctccgaggaagggctaggagtgggtgccgtaattaaaagtgaaactgatggtggacaagagactaacgctgcacccgtagaaacggcagattcacatcacaagagatagattacaaacgaacacgtactactttactaaccgtaaatgaataccaacgacctaacgaaaaccgaaggaaccaacacggtacccgtagtaacttaacgttcgtaaccaacgaagggaaagagnttaggttaattataagtattaggttagttaaggtttaattaacg

SEQ ID NO: 324679 - DNA, 598 bp, Homo sapiens
  misc_feature: GZ8MTXP01AOW1N.38.55.E11.1.454.CMB.2.raw
  modified_base (272)..(272): a, c, t, g, unknown or other
  misc_feature (272)..(272): n is a, c, g, or t
  modified_base (312)..(312): a, c, t, g, unknown or other
  misc_feature (312)..(312): n is a, c, g, or t
  modified_base (434)..(434): a, c, t, g, unknown or other
  misc_feature (434)..(434): n is a, c, g, or t
  modified_base (442)..(442): a, c, t, g, unknown or other
  misc_feature (442)..(442): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtcgtgggggaggcgttggggaaagccgtggggggtcccttagactctcctgtacagcctntggattctacttttagtatgcctggatgaccgtgggtccnccgaggctccgaagggaaacggggctagggaagtgggttaggccggttaaagttaaaaggtgaaacgtgagtgggtagggacaacgagactaacgctgccacccgtagaaacgcagatcacntcacaagngatgacttacaaacgacacgtcttacttacaacgaaatgaatcgaacgtaccaaggaaaaccgacggacacgacgtccgtagttaactacgttcgtaacccgagaagggaacagttcttagtttaatagtgtaattaggttacgttggtttaatcg

SEQ ID NO: 324680 - DNA, 567 bp, Homo sapiens
  misc_feature: GZ8MTXP01CL7DF.38.55.E11.1.454.CMB.2.raw
  modified_base (346)..(346): a, c, t, g, unknown or other
  misc_feature (346)..(346): n is a, c, g, or t
  modified_base (411)..(411): a, c, t, g, unknown or other
  misc_feature (411)..(411): n is a, c, g, or t
  modified_base (479)..(479): a, c, t, g, unknown or other
  misc_feature (479)..(479): n is a, c, g, or t
  modified_base (507)..(507): a, c, t, g, unknown or other
  misc_feature (507)..(507): n is a, c, g, or t
  modified_base (517)..(517): a, c, t, g, unknown or other
  misc_feature (517)..(517): n is a, c, g, or t
  modified_base (528)..(528): a, c, t, g, unknown or other
  misc_feature (528)..(528): n is a, c, g, or t
  modified_base (532)..(532): a, c, t, g, unknown or other
  misc_feature (532)..(532): n is a, c, g, or t
tcagtcgatcacgtcacgaccggtgctcgatttagcactcgcacgttgggtttggggagatctgggagaggagccccagccttgggattcccaagtgtttcattcagtgatcaggactgaacacagaggactcaccatggagtttgggctgagctggattttccttgctgctatttaaaaggtgtccagtgtgaggtgcagctggtggagtcgtgggggaggcgttgggaaagccgtggggggtcccttagactctcctgtacagcctctggtattctacttttagtatgcctggatgacctggtccgcaggctccgaggaagggctggatgggtgcgtataaagngaaactgatcggtggacagagactaacgctgcaccggtagaaggcagactcaccatctcaaaganatagaattacgaaacgaacaccgtcttactttacaacgaaattgactacgaacgccctagaaaaccgnggaccaccaggtcccgtagtaacttacnggtaaacccngaaaggggaanacgnttagtttaatatgtatagttaggtgttaattaacg

SEQ ID NO: 324681 - DNA, 557 bp, Homo sapiens
  misc_feature: GZ8MTXP01CB56M.38.55.E11.1.454.CMB.2.raw
  modified_base (308)..(308): a, c, t, g, unknown or other
  misc_feature (308)..(308): n is a, c, g, or t
  modified_base (468)..(468): a, c, t, g, unknown or other
  misc_feature (468)..(468): n is a, c, g, or t
  modified_base (481)..(481): a, c, t, g, unknown or other
  misc_feature (481)..(481): n is a, c, g, or t
  modified_base (507)..(507): a, c, t, g, unknown or other
  misc_feature (507)..(507): n is a, c, g, or t
  modified_base (553)..(553): a, c, t, g, unknown or other
  misc_feature (553)..(553): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctatttaaaggtgtccagtgtgaggtgcagctggtggagtcgtgggggaggcgttgggaaagccgtggggggtcccttagactctcctgtacagcctctggattctacttttagtatgcctggatgacctgggtccncaggctccgaggaaggggctggaagtgggttggccgtaattaaaagtgaaactgatggtgggacaacgagactaacgctgcacccgtagaaagcagacttcaccatctacaagagatagattcaaacgaacacgtctacttactaacgaaatgatacgancctagaaaaccgnggaaccagacgtccgtgtaacttacngtaaccacgaagggaacagcagttaatagtgataggttagttgttnttcg

SEQ ID NO: 324682 - DNA, 596 bp, Homo sapiens
  misc_feature: GZ8MTXP01C7E5W.38.55.E11.1.454.CMB.2.raw
  modified_base (361)..(361): a, c, t, g, unknown or other
  misc_feature (361)..(361): n is a, c, g, or t
  modified_base (571)..(571): a, c, t, g, unknown or other
  misc_feature (571)..(571): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctatttaaaaggtgtccagtgtgaggtgcagctggtggagtcgtgggggaggcgttgggaaagccgtggggggtcccttagactctcctgtacagcctctggattctacttttagtatgcctggatgacctgggtccgccaggctccgagggaaaggggctaggaagtggggttggccgtaattaaaagngaaactgatggtagggacaacgagactaacgctgcacccggtagaaaggcagatcaccatctacaagagatagaacttacaaacgaacacgtcttactttactaactaaatgaactcaagccctaagaaaacccgaggaccaaccgtagccgtagttaacttacgaggtaacccaagtaaaggggaattaacgcttaaggttaattaagngtaataggttacgttggttaacttg

SEQ ID NO: 324683 - DNA, 583 bp, Homo sapiens
  misc_feature: GZ8MTXP01DQ3JJ.38.55.E11.1.454.CMB.2.raw
  modified_base (308)..(308): a, c, t, g, unknown or other
  misc_feature (308)..(308): n is a, c, g, or t
  modified_base (538)..(538): a, c, t, g, unknown or other
  misc_feature (538)..(538): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctatttaaaaggtgtccagtgtgaggtgcagctggtggagtcgtgggggaggcgttgggaaagccgtgggggtcccttagactctcctgtacagcctctggattctacttttagtatgcctggatgacctgggtccnccgaggctccgagggaaaggggctaggaagtggggttggaccgtaagttaaaagtgaaactgagtggtagggacaacgagactaacgctcgcacccgtagaaagcagatacaccatctacaagagatagaattacaaacgaacacgtcttacttactaacaaatgaatcagacctagaaacgaggaccacgagtccgtagtaacttacgttacgtacccaagaagggaanaacgcttaagttaatatgtaagtaggttagttggttaacttaacg

SEQ ID NO: 324684 - DNA, 645 bp, Homo sapiens
  misc_feature: GZ8MTXP01ECR7F.38.55.E11.1.454.CMB.2.raw
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctatttaaaaggtgtccagtgtgaggtgcagctggtggagtcgtgggggagcgttgggaaagccgtgggggtcccttagactctcctgtacacgcctctggattctacttttagtatgcctggatgaccgtgggtccgccaggctccgagggaaaggggctaggaagttgggggttgaccgttaagttaaaagtgaaacgtgagtggtagggacaagagactaacgctcgacacccgtagaaacgcagacttcacatctacgaagagtatagtaacttacgaaacgaacacgtcttactttactaaacgtaaattggaacttaccgacgtacccgtaaacggaaaaccgaacgggtaccaaccgacggtcccgtaagttaacgttaaccttacggttaacccaacggaaacggggaaagttaccggttattaagttaattagtaagtataggttagttaaggttaacgttaacg

SEQ ID NO: 324685 - DNA, 700 bp, Homo sapiens
  misc_feature: GZ8MTXP01AX636.38.55.E11.1.454.CMB.2.raw
  modified_base (648)..(648): a, c, t, g, unknown or other
  misc_feature (648)..(648): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggtattttccttgctgctatttaaaggtgtccagtgtgaggtgcagctggtggagtcgtgggggaggcgttgggaaagccgtggggggtcccttagactctcctgtacagcctctggtattctacttttagtatgcctggatgacctgggtccgccgaggctccgaggggaaaggggctgggaagtgggggttcgaccggttaagttaaaaggtagaaactggtagtacggggtaggggacaaacgagaaccgttaacgccgttcggacccgtaaccccgggtaggaaaacgggtcgaacgtacttacccaaccctatacctacgaaagacgaattaggacttacgaaaaccgaactaccgtaccttacttttaacccaagtaaaattcggaactaccgaacggaccctaaaggaaaaaccccggtagggaaccctacggaacgtcccgtaaggttaacttaacgttcggtaaacccaggtaaaggggaagngttcgttaaggtttaatagtaagtagtttaggttagttgggtttaacttaag

SEQ ID NO: 324686 - DNA, 587 bp, Homo sapiens
  misc_feature: GZ8MTXP01C2VU0.38.55.E11.1.454.CMB.2.raw
  modified_base (310)..(310): a, c, t, g, unknown or other
  misc_feature (310)..(310): n is a, c, g, or t
  modified_base (359)..(359): a, c, t, g, unknown or other
  misc_feature (359)..(359): n is a, c, g, or t
  modified_base (421)..(421): a, c, t, g, unknown or other
  misc_feature (421)..(421): n is a, c, g, or t
  modified_base (490)..(490): a, c, t, g, unknown or other
  misc_feature (490)..(490): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtcgtgggggaggcgttgggaaagccgtgggggtcccttagactctcctgtacagcctctggattctacttttagtatgcctggatgaccgtgggtccnccaggctccgagggaaaggggctaggaagtgggttgacgtaattaaagngaaactgatcggtaggacagagactaacgctgcaccgtagaaagcagatcacatctacaganactagattaccgaaacgaactacgcttactttacaacgtaaatcgaatacgagaccctaagaaaaccgngaacacgacgtccgttagtaacttacgcgtaaccgaacgaaaggggtaacagttcttaaagtttaatagtgtaagtggttagttcggttaattaacg

SEQ ID NO: 324687 - DNA, 560 bp, Homo sapiens
  misc_feature: GZ8MTXP01BR8Z5.38.55.E11.1.454.CMB.2.raw
  modified_base (265)..(265): a, c, t, g, unknown or other
  misc_feature (265)..(265): n is a, c, g, or t
  modified_base (271)..(271): a, c, t, g, unknown or other
  misc_feature (271)..(271): n is a, c, g, or t
  modified_base (290)..(290): a, c, t, g, unknown or other
  misc_feature (290)..(290): n is a, c, g, or t
  modified_base (301)..(301): a, c, t, g, unknown or other
  misc_feature (301)..(301): n is a, c, g, or t
  modified_base (411)..(411): a, c, t, g, unknown or other
  misc_feature (411)..(411): n is a, c, g, or t
tcagtcgatcacgtcacgaccggtgctcgatttagcactcgcacgttgggtttggggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggagcagctccaacattgagataatttgtctcctggtaccagcagctccaggaacacgccccaaatcctnatttangaccataataggcaccctnaggtacttccngaccgtattctctgcctcaagtctgcacgtcagccacctggacatcaccgcctcagacgtggggacacggccgattatacgtgacggaactagtgggactaccgagtacngaagtgcggtttggggtgccgttcgggtagggacgggaccgaggcctcggtacccgtccgtagggtccaacggcccaagggtccttccggcccccgttgggttccaccttccgtccgttcccccgccctccgtcgaccgtgaacgtccg

SEQ ID NO: 324688 - DNA, 658 bp, Homo sapiens
  misc_feature: GZ8MTXP01AQM3C.38.55.E11.1.454.CMB.2.raw
  modified_base (279)..(279): a, c, t, g, unknown or other
  misc_feature (279)..(279): n is a, c, g, or t
  modified_base (415)..(415): a, c, t, g, unknown or other
  misc_feature (415)..(415): n is a, c, g, or t
tcagtcgatcacgtcacgaccggtgctcgatttagcactcgcacgttgggtttggggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaggcagctccaacattggagtattaattttgtctcctggtaccagcagcctcccaggaacacgcccccaaatcctcatttancgaccataatggccgaccctgagggacttcctagaccgtattctcgtggctcaagtctcggcaccgtcacgcccaccgtggcactccgaccggtccctacgacgacgtgggggacacgggcctaattacgttacgnggacggaaacagtacgggaactacccgaagtacctaggaagttcggtcgggtttaggggtcgtcggttaccggggtgggaacgggacccgtaggccggtacgtaccccggttaccgttaagggccgaaccgacccgaacgggtcccttccgggtcccccccgttcgggacccttcccgttccgttcccggtttaccccccaacccgtttcccgtaccgttacccggttcgaaccgttcccggg

SEQ ID NO: 324689 - DNA, 661 bp, Homo sapiens
  misc_feature: GZ8MTXP01DW7QK.38.55.E11.1.454.CMB.2.raw
  modified_base (416)..(416): a, c, t, g, unknown or other
  misc_feature (416)..(416): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctatttaaaggtgtccagtgtgaggtgcagcgtggtggagtcgtgggggagcgttgggaaagccgtgggggtcccttagactctcctgtacagcctctggattcacttttagtatgcctgatgaccgtggtccgccgaggctaccgagggaaaggggctagggaagtggggttgacgttaagttaaaagtgaaactgagtggacgggaacaagagactaaacgctggctaacccggtagaaacgnacgacttacaccattacacgaaagacgatagaacttacaaaccgaacaccgtcttactttacaaacaaagttcgaaatccgaagtacccgtaaaggaaaacccgaggaaccaacgaacgtacccgttaggttaaaccttacgttacggtaaccccgaaaggaaaggggtaaacgttacgttacttaaagggttttaaattaagtaaggtaaattagggttagtaacccgggtttttaagtaaccg

SEQ ID NO: 324690 - DNA, 675 bp, Homo sapiens
  misc_feature: GZ8MTXP01C7FS7.38.55.E11.1.454.CMB.2.raw
  modified_base (309)..(309): a, c, t, g, unknown or other
  misc_feature (309)..(309): n is a, c, g, or t
  modified_base (353)..(353): a, c, t, g, unknown or other
  misc_feature (353)..(353): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgcttatttaaaaggtgtcagtgtgaggtgcagcgtggtggagtcgtgggggaggtcgttaggggaaagccgtggggggtcccttagactctcctgtacagcctctggattctactttagtatgcctgatgacctggtcncaggctcgaggaagggctggagtgggtgaccgtaagttaaaagngaaactgagtaggtagggaacaacgaagacctaaaccgctggacccgaacccggtaggaaaacgggccaaggtacttaccaaccctattacacgaaagagtaatagtacttacaaacgaaccacgtcttacttactaacgtaaatgaaactcgaaacgcccgtaaacgaaaaccggaacggaccaacggtacgtacccggttaattaaacttaacgttacgttaaacccgaggtaaaggggaacgaacgttcgttaaaagtttaagttaaagtaaggttaaaccgtaagggtttacggtttaagtttaacgttttaacccgg

SEQ ID NO: 324691 - DNA, 587 bp, Homo sapiens
  misc_feature: GZ8MTXP01AE14Y.38.55.E11.1.454.CMB.2.raw
  modified_base (291)..(291): a, c, t, g, unknown or other
  misc_feature (291)..(291): n is a, c, g, or t
  modified_base (307)..(307): a, c, t, g, unknown or other
  misc_feature (307)..(307): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctatttaaaaggtgtccagtgtgaggtgcagctggtggagtcgtgggggagcgttgggaagccgtgggggtcccttagactctctgtacagcctctggtattctactttagtatgcctgntgacctggtccgccgnggctccgaggaagggcgtggagtggttggccgtagttaaagtgaaactgagtggtaggacgaacgagactaacgcgtcgagacccccccgtagaacggcgagacttacaccactactacaacgagatagattacaacgaacacgtactactttactaaccgtaaatagtactacgtacgaccgtacgaaaaccggacgaaccaacacgccgtgtaactacgttacgtaccacgtaaggaacgagacttagtaattatgtatagttagtaagttgttaacg

SEQ ID NO: 324692 - DNA, 456 bp, Homo sapiens
  misc_feature: GZ8MTXP01ELAVJ.38.55.E11.1.454.CMB.2.raw
  modified_base (181)..(181): a, c, t, g, unknown or other
  misc_feature (181)..(181): n is a, c, g, or t
  modified_base (215)..(215): a, c, t, g, unknown or other
  misc_feature (215)..(215): n is a, c, g, or t
  modified_base (446)..(446): a, c, t, g, unknown or other
  misc_feature (446)..(446): n is a, c, g, or t
  modified_base (448)..(456): a, c, t, g, unknown or other
  misc_feature (448)..(456): n is a, c, g, or t
tcagtcgatcacgtcacgaccggtgctcgatttagcactcgcacgttgggttggccgtattaaaagtgaaactgatggtgggacaacagactacgctgcacccgtgaaaggcagattcaccatctcaagagatgattcaacgaacacgctctttctacaaatgatcagcctagaaaaccgnggacacagccgtgtattactgtaccagagggaanagcagttattatgatagtagtgttatctgtactactacggtatggacgtcgtgggccaagggaccacggtcattgtcctccccagcctccaccgaacgggcccatccggtccttcccccgtggccaccccttcctaccaagacgcacctcgtcgggggcacgacgccggcccgtgggctcgcctggtacaaggacctactcacgtgatcgactgagcggctggcaggcganannnnnnnnn

SEQ ID NO: 324693 - DNA, 700 bp, Homo sapiens
  misc_feature: GZ8MTXP01AYOZ4.38.55.E11.1.454.CMB.2.raw
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggtattttccttgctgtcttaattttaaaaggtgtccagtgtgaggtgcagcgtgggtggaggtcggtggggggaggtcgttaggggaaaggtccggtggggggttcccttagacttcgtcctgtacacgtcctcgtggtacttctacttttagtatcgctggatcgaccgtcgggtcccgccgaggtcctaccggaaggggaaagggcgtagggtaaggttgggggttacggtaaccgttaaagttaaaaggtagtaaacgtggagttagggacggaacaaagacgactaacgctcggaccgtaaacccggtaagaaacggacaacgtactacccactatactaacgaaagtacattagaactacaaacgacacgtcttaactttacaaacgaaattgaactaccgaacgacctaaaggaaaccgtacggaactacgacgtccgttaagttaaccgttaacttacggtaaccgaaacgggaaagggtaagttaccgagttaagtttaatagtaaggtaatacgggttggttaattcgtaacgg

SEQ ID NO: 324694 - DNA, 713 bp, Homo sapiens
  misc_feature: GZ8MTXP01AZOVC.38.55.E11.1.454.CMB.2.raw
  modified_base (271)..(271): a, c, t, g, unknown or other
  misc_feature (271)..(271): n is a, c, g, or t
tcagtcgatcacgtcacgaccggtgctcgatttagcactcgcacgttgggtttgggggagatctgggagaggagccccagccttgggattcccaagtgttttcattcagtgatcaggactgaacacagaggactcaccatggagtttgggctgagctggtattttccttgctgtcttatttaaaaggtgtcagtgtgaggtgcagctggtggagtcgtgggggaggcgttagggaagtccgtggggggtcctagactctctgtacagcctntgtacttctacttttagtatcgtcctggatcgaccgtcgggtccgccgtacggccgtaccggaagggggaaacggggtcgtagggtaaggttgggggtttacggaaccggttaaagttaaaagtacgaaacgttggagtacggggtaggtaacaaacgacggtaacctaacggcctcggacccgtaacccgggtaaggaaacggtacgaacgtacttacccaccgtataccgtaacgaaagagtacttagaacttacgaaaaccgtaacaccgtacttactttaccgaaacttaaatcgtaactacgaaacgtccgtaaacggaaaccgacgaacacgtaccgtaccgtgtaacttaacgttacgaaaccgaggtaaacgggaacttacgttacttaaggtttaatataaggttataggttacgttaagttaagtttaaccg

SEQ ID NO: 324695 - DNA, 594 bp, Homo sapiens
  misc_feature: GZ8MTXP01CYM7O.38.55.E11.1.454.CMB.2.raw
  modified_base (553)..(553): a, c, t, g, unknown or other
  misc_feature (553)..(553): n is a, c, g, or t
  modified_base (570)..(570): a, c, t, g, unknown or other
  misc_feature (570)..(570): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggtattttccttgctgcttatttaaaaggtgtccagtgtgaggtgcagctggtggagtcgtgggggaggcgttaggggaaagccgtggggggtcccttagactctcctgtacagcctctggtattctacttttagtatgcctggatgacctcggtccgcgaggcctccgaaggaacggggcgtaggagtggggttgaccgtaagttaaagtgaaacgtgagtcggtaggaacacgagactaacgctgccaccgtagaaaggcagactcacctatactacgaaagagatagtactacaaacgacacgtcttactttacaacgtaaatcgaatcgaacgacctaaggaaaaccgagaccacgagccgtagtaattaccgaggtaaccagtaacgggaanagcttaaggttaatagngtaaatggttagttggttaattcg

SEQ ID NO: 324696 - DNA, 742 bp, Homo sapiens
  misc_feature: GZ8MTXP01CD0F0.38.55.E11.1.454.CMB.2.raw
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagcgtggtagtttcctaggctgacttaagtttaaaggtgtccagtgtgaggtgcagctggtggagtcgtgggggagcgttagggaagccgtgggggtccctagactctcctgtacagcctgtggtattctacttttagtatgccttggatcggaccgtcgggtccgcaggcctaccgaaggggaaaggggctagggtaagtggggttacggtacgttaagttaaaagtgaaacgtgtagttagggacggaacaagacgactaaacgctgaccaacccggtagaaacggctaagtacttacaccctaatccctaagaaaggtagtagtaagtaaaccttaacgaaaccggaaacctaccgttcttacttttaaaccaacggggtaaaattggaaccttaacgaagttaccccgaaacgaaaaaccggcggaaaccaccgtaacggtcccggtttaaagttaaaccgtttaacccttacgggtaaaaccccgacgggttaaaagggggtaaacttaaccggttacgttaaaggttttaattaaggtaaggtttaaaggttaggttttaagggttaaccgtttaagttaaccg

SEQ ID NO: 324697 - DNA, 598 bp, Homo sapiens
  misc_feature: GZ8MTXP01CUYJL.38.55.E11.1.454.CMB.2.raw
  modified_base (303)..(303): a, c, t, g, unknown or other
  misc_feature (303)..(303): n is a, c, g, or t
  modified_base (422)..(422): a, c, t, g, unknown or other
  misc_feature (422)..(422): n is a, c, g, or t
  modified_base (427)..(427): a, c, t, g, unknown or other
  misc_feature (427)..(427): n is a, c, g, or t
  modified_base (523)..(523): a, c, t, g, unknown or other
  misc_feature (523)..(523): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctatttaaaggtgtccagtgtgaggtgcagctggtggagtcgtgggggagcgttgggaagccgtgggggtcctagactctcctgtacagcctctggattctacttttagtatgcctggatgacctgggtccncaggctccgaggaacggggctaggaagtgggttggaccgtaagttaaaagtgaaactgagtggtagggacaacgagactaaacgctgcgacccgtagaacgcagtactcaccatcctanaaganatagacttacaaacgacacgtctacttacaacgtaaatcgaatccgaaacgcctaacgaaaaccgaggaacctaacacgtccgtagtaattaaccnggtaaacccaggaaagggaacaacggcttaaggttaattaagtgtaacgtaggttagtaagggttttaataaccg

SEQ ID NO: 324698 - DNA, 595 bp, Homo sapiens
  misc_feature: GZ8MTXP01DO8WR.38.55.E11.1.454.CMB.2.raw
  modified_base (440)..(440): a, c, t, g, unknown or other
  misc_feature (440)..(440): n is a, c, g, or t
  modified_base (465)..(465): a, c, t, g, unknown or other
  misc_feature (465)..(465): n is a, c, g, or t
  modified_base (563)..(563): a, c, t, g, unknown or other
  misc_feature (563)..(563): n is a, c, g, or t
  modified_base (589)..(589): a, c, t, g, unknown or other
  misc_feature (589)..(589): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgcttattttaaaaggtgtccagtgtgaggtgcagctggtggagtcgtgggggaggcgttgggaagccgtgggggtcccttagactctctgtacacgcctctggattcacttttagtatgcctggatgaccgtcgggtccgccaggctaccgaggggaaacgggggctgggaagtggggttaggaccggttaattaaaagtgaaactggagtgggtagggacaacgagaacaacgctgccacccgtagaaaggcagacttcaccatcctanaagagatagaattacaaacgacacncttactttaccaaacaaatgaatacgaacacccgtaagaaaccggagacacgagtcccgtataattacagtaaccacgaaagggacagcttaagtttntaagtgtatacggttagtttcggttnttaacg

SEQ ID NO: 324699 - DNA, 561 bp, Homo sapiens
  misc_feature: GZ8MTXP01A8IPO.38.55.E11.1.454.CMB.2.raw
  modified_base (309)..(309): a, c, t, g, unknown or other
  misc_feature (309)..(309): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttgggaaagccgtggggggtcccttagactctcctgtacagcctctggattcacttttagtatgcctggatgacctggtccgccnggctccgaggaaggggctaggatgggtggccgtaagttaaagtgaaactgatcggtagggacaacagactaacgctgcacccgtgaagcagattcaccagtctacaagagatagacttacaacgacacgctctttacacgaatgactcacgcctagaaaccgagactacagccgtgtaacttacgcgtacccagaaggggaacaggttcttaaggtttaatagtgtaataggttacgttggttaattaaccg

SEQ ID NO: 324700 - DNA, 602 bp, Homo sapiens
  misc_feature: GZ8MTXP01AJG5X.38.55.E11.1.454.CMB.2.raw
  modified_base (431)..(431): a, c, t, g, unknown or other
  misc_feature (431)..(431): n is a, c, g, or t
  modified_base (560)..(560): a, c, t, g, unknown or other
  misc_feature (560)..(560): n is a, c, g, or t
  modified_base (564)..(564): a, c, t, g, unknown or other
  misc_feature (564)..(564): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctatttaaagtgtccagtgtgaggtgcagctggtggagtcgtgggggagcgttgggaagccgtgggggtcccttagactctctgtacagcctctggattctacttttagtatgcctggatgaccgtggtccgccaggcctccgaagggaaggggctaggagtggggttgaccgttaagttaaagtgaaactgagtggtagggacaacgagactacgctcgcacccggtagaaacggcagacttaccaccatctacgaagngtatagaacttacgaaacgaacacgtaccttactttacaaacgtaaattcgactaccaagtacccgtaaggaaaaccgaggaaccacgaacgtcccggtattaacgtacttcgaacgacgaaagggtancggnttaggtttaatgtaagtagttcgttagttggttaatcg

SEQ ID NO: 324701 - DNA, 618 bp, Homo sapiens
  misc_feature: GZ8MTXP01AXRGA.38.55.E11.1.454.CMB.2.raw
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctattttaaaggtgtccagtgtgaggtgcagctggtggagtcgtgggggaggcgttgggaagccgtgggggtcccttagactctcctgtacagcctctggattctacttttagtatgcctggatgaccgtgggtccgccgaggctccgagggaacggggcgtaggaacgttgggggttggaccgttaagttaaaagtgtaaactggagtcggtagggacaagagacgtaacgctcgacaacccggtagaaacggcaagacttaccgacctagtactacgaagagatagaattacgaaacgaacacgtacttactttacaactaaatgaactacaacgtcccgtaaagaaacccgacggaccacgacgtcccgtagtaacttaacttcgtaaccacggaaggaacgagcttagttaatagtaagtagtaggttagttgttaattaacg

SEQ ID NO: 324702 - DNA, 656 bp, Homo sapiens
  misc_feature: GZ8MTXP01D0N1I.38.55.E11.1.454.CMB.2.raw
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctatttaaagtgtcagtgtgaggtgcagctggtggagtcgtgggggaggtcgttgggaaagccgtgggggtcccttagactctcctgtacagcctctggattctactttagtatgcctggatgaccgtcgggtccgccgaggctccgaggggaaacggggtctagggaagttggggttacggtaccgttaagttaaaagtgtaaaacgtggtaagtcgggtacgggaaacaacgagaccgtaaaccgctggacctacccggtagaaaacggcaacgacttaccactatactacaagatagtagaattacaaacgtaacaccgtcttactttactaaacgtaaatgtaactacgacgtacctaacggaaaaccgtaaggaaccaacgacgtacgttggtaaactttacgttacgtaaacccgagtaaacgggaagttaacgttcttaaaggttaataagtgtaagtagttagttgttaagttaacg

SEQ ID NO: 324703 - DNA, 645 bp, Homo sapiens
  misc_feature: GZ8MTXP01E3FF3.38.55.E11.1.454.CMB.2.raw
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttggctgagctggattttccttgctgctattttaaaaggtgtccagtgtgaggtgcagcgtggtggagtcgtgggggaggcgttaggggaaagccgtgggggtcccttagactctcctgtacagcctctggtattctactttagtatgcctggatgaccgtgggtcccgccgaggcctaccgagggaaaggggcgtagggagtgggggttaggaccgttaaagttaaaaggtagaaacgtggagtagggtagggaacaaacgagaaccgtaacgctcggaccaacccggtaggaaacggcgaagacttacaccatctacaagagatagaattacaaacgaacacgtcttacttactaacgaaatagaactacgaaccgaccgtaaacggaaaaccgaggaaccacgtaacgcccgtagttaacttaacgttacgtaaaccgacggtaaaggaacgagacgttaagttaatagtaagtataggttacgttggttaattaacg

SEQ ID NO: 324704 - DNA, 718 bp, Homo sapiens
  misc_feature: GZ8MTXP01DSZV9.38.55.E11.1.454.CMB.2.raw
  modified_base (185)..(185): a, c, t, g, unknown or other
  misc_feature (185)..(185): n is a, c, g, or t
  modified_base (321)..(321): a, c, t, g, unknown or other
  misc_feature (321)..(321): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggatttccttgctgcttatttaaaaggtntcagtgtgaggtgcagctgggtggagtcgtgggggagtcgttaggggaaagtccggtgggggtccccttaggaccttctcctgtacagtcctcgtggtattctacttttagtatgcctggatcgaccgtcggtccncgaggcctaccgaagggaagggcgtggaagttgggggttacggaccgttaaagttaaaaggttagtaaaacgtggtaagttggggtacggaactaaacgaagaccgttaaaccgctaacggaccgtaaacccggtaggaaaacggccgaaagtacttacccacctaacgtactacgaaaggaactagtaggtaacttaccgaaacgtaaccgtactaccttaccttttaccaaacgtaaagttacggtaactaccaacgacccgtaaacggaaaacccgaacggaccgaacgaaccgtccgtaagttaacttaacgacggtaaacccgaaggtaaaggaacgagttcggttaatttaagtataacggtaagttaggttacggttgttaactttaacg

SEQ ID NO: 324705 - DNA, 713 bp, Homo sapiens
  misc_feature: GZ8MTXP01DF9EQ.38.55.E11.1.454.CMB.2.raw
tcagtcgatcacgtcacgaccggtgctcgatttagcactcgcacgttgggtttggggagatctgggagaggagccccagccttgggattcccaggtgttttcattcagtgatcaggactgaacacagaggactcaccatggagtttgggctgagctggtattttccttgctgcttaattttaaaaggtgtccagtgtgaggtgcagctgggtggagtcggtgggggaggtcgttaggggaaagtccggtggggggtcccttagactctcctgtacagcctcgtggtattctacttttagtatcgcctggatcgaccgtgggtccgccgacggcctaccgaaggggaaacgggggtcgtagggtaaggttcgggggttacggtaaccgtaaagtttaaaaaggtcgaaaacgtggtaagtacgggtagggaacaaacgacgtaacgtaacgcgtcgacccgaacccggtaaggaaacgggcaacgtacttaccaacctactacctaacgaaagacgtaataggtaacttaaccgaaacgactactacttacctttaacaaacgtaatacgaactactaacgaacccgtaaagaaaaccggaacgtacaaccgacgtacccgtattaacgttaacacggtaaacccaaggtaaagggaacttacgttacttaaggtttaataagtgaagtttagttacggttgtttaattaaccg

SEQ ID NO: 324706 - DNA, 695 bp, Homo sapiens
  misc_feature: GZ8MTXP01EUUNT.38.55.E11.1.454.CMB.2.raw
  modified_base (452)..(452): a, c, t, g, unknown or other
  misc_feature (452)..(452): n is a, c, g, or t
tcagtcgatcacgtcacgaccggtgctcgatttagcactcgcacgttgggtttggggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaggcagctaccaaactagttggagtatttaatttttgtcctcctgggtaccagcacgcctcccgaaggaaccacgaccccccaaactcctacatttacacgaaccataagtacggccacctcgaaggacttccgtgaccgtatttcctcgtggtctaccgaagtcgtacggctacccgtcacggcccaccgtggcccaatccgacccggtcctaccgacggtacgtcggggacgacgggacctagttacttacgnggacgaacgtagtcgggactaccgaagtactaggtaatggtcggtttaggggtcgtcggtcgggtaggggaacgggacccgtaagggcgttaccggacccggttacccggttaagggcccgaacccggccccgttaaagggccccgttacccgggtccccccgttcgggttacccgttaccctttaccccgttcccggtccccctccccgttccccgtcgaaccggttcgttcgtaacccggg

SEQ ID NO: 324707 - DNA, 556 bp, Homo sapiens
  misc_feature: GZ8MTXP01C4ZFL.38.55.E11.1.454.CMB.2.raw
  modified_base (305)..(305): a, c, t, g, unknown or other
  misc_feature (305)..(305): n is a, c, g, or t
  modified_base (405)..(405): a, c, t, g, unknown or other
  misc_feature (405)..(405): n is a, c, g, or t
  modified_base (408)..(408): a, c, t, g, unknown or other
  misc_feature (408)..(408): n is a, c, g, or t
  modified_base (410)..(410): a, c, t, g, unknown or other
  misc_feature (410)..(410): n is a, c, g, or t
  modified_base (414)..(414): a, c, t, g, unknown or other
  misc_feature (414)..(414): n is a, c, g, or t
  modified_base (442)..(442): a, c, t, g, unknown or other
  misc_feature (442)..(442): n is a, c, g, or t
  modified_base (494)..(494): a, c, t, g, unknown or other
  misc_feature (494)..(494): n is a, c, g, or t
  modified_base (509)..(509): a, c, t, g, unknown or other
  misc_feature (509)..(509): n is a, c, g, or t
  modified_base (514)..(514): a, c, t, g, unknown or other
  misc_feature (514)..(514): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctatttaaaggtgtccagtgtgaggtgcagcgtggtggagtcgtgggggagcgttgggaagccgtgggggtccttagactctcctgtacagcctctggattctacttttagtatgcctggatgaccgtggtccncaggctccgaggaagggctggagtgggtagtacgtaagttaaagtgaaactgagtggtagggacacgagactaacgctgcacccgtgaagcagatcacancananaganagatacaaacgacacgcttacttacaanaatgatacgagaccctaagaaaccgagaacctagacgtccgtgtaacttacngtaaccagaaggganaacgnttaagtttaatagtgtagttagttacgttggttaatttaacg

SEQ ID NO: 324708 - DNA, 569 bp, Homo sapiens
  misc_feature: GZ8MTXP01AYRMW.38.55.E11.1.454.CMB.2.raw
  modified_base (363)..(363): a, c, t, g, unknown or other
  misc_feature (363)..(363): n is a, c, g, or t
  modified_base (379)..(379): a, c, t, g, unknown or other
  misc_feature (379)..(379): n is a, c, g, or t
  modified_base (449)..(449): a, c, t, g, unknown or other
  misc_feature (449)..(449): n is a, c, g, or t
  modified_base (511)..(511): a, c, t, g, unknown or other
  misc_feature (511)..(511): n is a, c, g, or t
  modified_base (528)..(528): a, c, t, g, unknown or other
  misc_feature (528)..(528): n is a, c, g, or t
  modified_base (545)..(545): a, c, t, g, unknown or other
  misc_feature (545)..(545): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcgttggggaaagccgtgggggtcccttagactctcctgtacagcctctggattctacttttagtatgcctggatgaccgtggtccgcaggctaccgagggaaaggggctgggaagtggggttggccgttaagttaaaagngaaactgatggtgganaagagactaacgctgcacccgtagaaagcagattcaccatctacaagagatagattacaaacgtacacgntactttacaactaatgatcaagcctagaaaaccgacggaacacgacgccggtgtaacttacngtaacccagaggggaancggcttagttaattagnggtataggttagtggttaataacg

SEQ ID NO: 324709 - DNA, 687 bp, Homo sapiens
  misc_feature: GZ8MTXP01A4AMS.38.55.E11.1.454.CMB.2.raw
  modified_base (427)..(427): a, c, t, g, unknown or other
  misc_feature (427)..(427): n is a, c, g, or t
  modified_base (449)..(449): a, c, t, g, unknown or other
  misc_feature (449)..(449): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctattttaaaggtgtccagtgtgaggtgcagctggtggagtcgtgggggaggcgttgggaagccgtgggggtcccttagactctcctgtacagcctctggtattctacttttagtatgcctggatgacctgggtccgccaggctaccgagggaacggggctagggaagttgggggttaggacccgttaagttaaaacggtgtaaacgtgagtgggtaggaacaacgacgactaacgctcgcacccgtagaaacggnagattcactatcctacaagganatagtattacaaccgtaacacgtccttactttactaaacgtaaatcgtaacttaccgaaccggtacccgtaaaccggaaaaccggaacggggaaccaaccgtacggtacccggtttacgtaaacgtttaacccgttaggtaaaccccgaaagtaaagggggaacgaccggttacgttaaagggtttaacttaagttaaggtaagttaaggttaacggtttggtttaacgtttaaccgg

SEQ ID NO: 324710 - DNA, 769 bp, Homo sapiens
  misc_feature: GZ8MTXP01BPMRB.38.55.E11.1.454.CMB.2.raw
  modified_base (293)..(293): a, c, t, g, unknown or other
  misc_feature (293)..(293): n is a, c, g, or t
tcagtcgatcacgtcacgaccggtgctcgatttagcactcgcacgttgggtttggggacaatcttcatcatgacctgctcccctctcctcctcacccttctcattcactgcacagggtcctgggcccagtctgtgttgacgcagccgccctcagtgtctgccggccccaggacagaaggtcaccatcctcctgctcgtggaggcagcctaccaacattggagtattaattttgtctcctggtaccagcacgcctacccgaggaaccacgacccccctaaactcctacatttanacgaacctaataacgtacggccgaccctcgaaggtcttccgtcgaccgtatttccgtcgttcggtcctaccgtaagttcgcggacctacccggttccacgccctacccgtgggaaccacgtcccgacccgggtccctaccgaggacgtcgggggacgtacggaccgtagtttactacgtcggacggtaaactaggtcgggaacttaccgaagactaggaacttggtcggggtttacggggtcggtaccgggttcggggtaacgggacgggtaccgagggtcccgtacgggttaaccccggtcggttacggacccggaaccggtacccccgggttaaaggtcccccgttcccgggccccccggtttcggttacccccttaccccggttttaccccggttcccccggtttacccccccctaacccggtttcccccggttacgttaaccccggggttttcgaaccgggttaaccccggg

SEQ ID NO: 324711 - DNA, 649 bp, Homo sapiens
  misc_feature: GZ8MTXP01EJJFF.38.55.E11.1.454.CMB.2.raw
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgcttattttaaaaggtgtccagtgtgaggtgcagcgtggtggagtcgtgggggagcgttagggaagccgtgggggtcccttagctctcctgtacagcctctggattctacttttagtatcgcctggatcggaccgtgggtccgccaggctaccgagggaaacgggggctagggacgttgggggttacggtaacgttaaagttaaaaggtagaaacgtggagttgggtacgggaacaaacgagaccgtaacgctcggaccgaaccggtaggaaacgcaagtacttaccactatactagaaagagatagtaactacaaacgaacacgtcttacttacaaacaattgaactcgaaacgtacccaaacggaaaaccgaggaaccacgacgtacccgttagtaaacttcgttacggaaacccgaaggaagggaaagagttcttaagtttaattagaagtactaggttagttccgtttaataacg

SEQ ID NO: 324712 - DNA, 814 bp, Homo sapiens
  misc_feature: GZ8MTXP01CW13Y.38.55.E11.1.454.CMB.2.raw
tcagtcgatcacgtcacgaccggtgctcgatttagcactcgcacgttgggtttggggacaatcttcatcatgacctgctcccctctcctcctcacccttctcattcactgcacagggtcctgggcccagtctgtgttgacgcagccgccctcagtgtctgcggcccaggacagagtcaccatctcctgctcgtggagcagctaccaatattggatattaatttgctcgtggtaccagcagctaccgagaaccacgaccccctaaatcctactatttacacgaacctaataaacgtacggcccgtaaccccgtgtaacgggtacttccccgtacgaacccgtatttcctaccgtaggcccttaccgtaaagttccgacgggtacctacccggtccaacggcccctaaccccggtgggtaacccaacgtccccgaacccgggtcccttaccgaacgggtaccgggtcgggggaaacccgacgggtaacccgttaagtttaacgttaaccggtacgggtaacccggaaagtacgggtaaccggggtaacttaaaccccgaagtaaacccgttaggtaaacgttccgggttaacgggggtttacgggggtcggttaaccgggtcgggggtacgggggaaaccgggtaaccggcgggtaccgttacggtaccccgggttagtaccgggtaccgaacccgggcccgaaacgggtccccgttaaccgggttccccccgttcgttacccgttacccgttccggtttaaccccttacccccgtccccttaccgtaccgttacccgttcgttaacgtccccggg

SEQ ID NO: 324713 - DNA, 783 bp, Homo sapiens
  misc_feature: GZ8MTXP01ALMZ3.38.55.E11.1.454.CMB.2.raw
tcagtcgatcacgtcacgaccggtgctcgatttagcactcgcacgttgggtttggggacaatcttcatcatgacctgctcccctctcctcctcacccttctcattcactgcacagggtcctgggcccagtctgtgttgacgcagccgccctcagtgtctgccggccccaggacagaaggtcaccatctcctgctctggaggcagctccaacattggagtattaattttgtctcctggtaccagcacgcctacccgaaggaaccacgaccccccaaaactccctactaattttaacacgaaccctaaataaagtacgggacccgtaaccccgtcgaaggggtactttccccgtaggtaaccccgtattttccgtccgttcggccttacccgtaaaggttccgtaggggccctaacccggttccaacgcccccgtaacccgtggggaaccctacgtcccggaccccgggtcccctaccgaacggaccggtcggggggaaaccgaccggggtacccgttaagtttaaacgttaccgtacgggaaccggaaactacgggttagggaactaacccgaagtaaccgttaggaaagttcggtaccggggttttggggtcgggtaccggttaccgggggtaggggaaccgggacccgtagggtcccgtacggtacccggtaccgttacgggccgaaccgtcccggaacgggtcccgttccgtcccccgtcggttcccgttccttccgttcccgtcccccgccttcccgtacgttaccgtgaaccgttccgg

SEQ ID NO: 324714 - DNA, 585 bp, Homo sapiens
  misc_feature: GZ8MTXP01DZMME.38.55.E11.1.454.CMB.2.raw
  modified_base (487)..(487): a, c, t, g, unknown or other
  misc_feature (487)..(487): n is a, c, g, or t
  modified_base (516)..(516): a, c, t, g, unknown or other
  misc_feature (516)..(516): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctatttaaaaggtgtccagtgtgaggtgcagctgggtggagtcgtgggggaggcgttggggaaagccgtggggggtcccttagactctcctgtacagcctctggattcacttttagtatgcctggatggacctgggtccgccaggctccgagggaaaggggctagggaagtgggggttacggaccgttaaagtttaaaaggtagtaaaactgaagtgggtagggaacaacgagactaaacgctgaccacccgtagaaacgcagacttacacctatctacaagagatagacttacaaacgacacgctactttacaanaaatcgaatcagcctagaaaccgagacanagccgttgtaaacttcgacgtaccacgaagggaagagcttagttaatatgtatagttagttgttaatcg

SEQ ID NO: 324715 - DNA, 575 bp, Homo sapiens
  misc_feature: GZ8MTXP01AXQWW.38.55.E11.1.454.CMB.2.raw
  modified_base (359)..(359): a, c, t, g, unknown or other
  misc_feature (359)..(359): n is a, c, g, or t
  modified_base (482)..(482): a, c, t, g, unknown or other
  misc_feature (482)..(482): n is a, c, g, or t
  modified_base (507)..(507): a, c, t, g, unknown or other
  misc_feature (507)..(507): n is a, c, g, or t
  modified_base (525)..(525): a, c, t, g, unknown or other
  misc_feature (525)..(525): n is a, c, g, or t
  modified_base (529)..(529): a, c, t, g, unknown or other
  misc_feature (529)..(529): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcacatggagtttgggctgagctggatttcctgctgctatttaaaggtgtccagtgtgaggtgcagctgggtggagtcgtgggggaggcgttaggggaaagccggtgggggtcccttaggactctcctgtacagcctctggtattcgtacttttagtatgacctggatgaccgtggtccgcgaggctccgagggaagggctaggaagtgggtagacgtaagtaaagngaaactgatggtaggacaacgagactaaacgctgcaccgtagaaacgcagtactcaccatcacaagagatagattacaaacgacacgtcttatttacaagaatgatcacgtccagaaacccgngaacacgagtccgtagtaactacgngtaacccgagaagggaancggnttaagttaatagtaaggtaccttagggttagttaaggttaacttcg

SEQ ID NO: 324716 - DNA, 673 bp, Homo sapiens
  misc_feature: GZ8MTXP01B9UTA.38.55.E11.1.454.CMB.2.raw
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggtattttccttgctgcttattttaaaaggtgtccagtgtgaggtgcagctggtggagtcgtgggggaggcgttgggaagccgtgggggtcccttagactctcctgtacacgcctcgtggtattctacttttagtatgccgtggatcgaccgtgggtccgccgaggcctaccgaagggaaacgggggctagggtaagttgggggttacggtaccggttaaagttaaaaggtgaaaacgtggtaagtgggtacgggaacaaacgacgaacgtaacgctcgaccgaacccggtaggaaacggtcaaggacttacgaaccctatacctaacgaaagtagaataggtaacttaccgaaacgaactacgctttactttacaaacaaattgaacttccgaaagtcccgtaaagaaaaccggacgtaacacgacgtccgtagttaacttacgttcgtaaaccacggaaagggaacttacgcgttaagttaattagtaagtagttaaggttagttggtttaatcg

SEQ ID NO: 324717 - DNA, 602 bp, Homo sapiens
  misc_feature: GZ8MTXP01CSEZQ.38.55.E11.1.454.CMB.2.raw
  modified_base (429)..(429): a, c, t, g, unknown or other
  misc_feature (429)..(429): n is a, c, g, or t
  modified_base (448)..(448): a, c, t, g, unknown or other
  misc_feature (448)..(448): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctatttaaaaggtgtccagtgtgaggtgcagctggtggagtcgtgggggaggcgttggggaaagccgtggggggtcccttagactctcctgtacagcctctggattctacttttagtatgcctggatgacctggtcgccaggctccgaggaaggggctggaagtgggttgaccgtaagttaaaagtgaaactgagtcggtagggacaacagacctaacgctgcacccgtagaaaggcagactcaccatctacaagtanatagaacttacaacgaacncgacttactttactaacgaaatgaactcaacgcctaacggaaaaccgaggaacctaacgagcccgttagtaactttaacgcgttaaaccgagaagggaacgagttacgttagtttaagtattgaacgttaggttagttcggtttaatttaacgg

SEQ ID NO: 324718 - DNA, 464 bp, Homo sapiens
  misc_feature: GZ8MTXP01DOSA0.38.55.E11.1.454.CMB.2.raw
  modified_base (214)..(214): a, c, t, g, unknown or other
  misc_feature (214)..(214): n is a, c, g, or t
  modified_base (334)..(334): a, c, t, g, unknown or other
  misc_feature (334)..(334): n is a, c, g, or t
  modified_base (450)..(450): a, c, t, g, unknown or other
  misc_feature (450)..(450): n is a, c, g, or t
  modified_base (453)..(454): a, c, t, g, unknown or other
  misc_feature (453)..(454): n is a, c, g, or t
  modified_base (456)..(464): a, c, t, g, unknown or other
  misc_feature (456)..(464): n is a, c, g, or t
tcagtcgatcacgtcacgaccggtgctcgatttagcactcgcacgttgggttggccgtattaaaagtgaaactgatggtgggacaacagactacgctgcacccgtgaaaggcagattcaccatctcaagagatgattcaacgaacacgctctttctacaaatgatcagcctgaaaaccgaggacacagccgtgtattactgtaccacagggaanagcagttattatgatagtagtgttatctgtactacgtacggtatggacgtctggggccaagggaccacggtcattcgtcctccccagcctccaccagggccccatccggtccttcccccnggccaccctcctccagacgcacctcgtcgggggccacgacgccggcccctggggcctggccctgggcaacggacctacttccagtgactccgactgagcgggctggcaaggcgcanagnngnnnnnnnnn

SEQ ID NO: 324719 - DNA, 618 bp, Homo sapiens
  misc_feature: GZ8MTXP01EGT7Z.38.55.E11.1.454.CMB.2.raw
  modified_base (271)..(271): a, c, t, g, unknown or other
  misc_feature (271)..(271): n is a, c, g, or t
  modified_base (310)..(310): a, c, t, g, unknown or other
  misc_feature (310)..(310): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgcttattttaaaaggtgtccagttgtgaggtgcagctggtggagtcgtgggggagcgttgggaagccgtgggggtcccttagactctcctgtacacgcctntggattctacttttagtatgcctggatgacctgggtccncaggctccgagggaagggctagggaacgtgggttgtaccgtaagttaaaagtgaaactgagttgggaggacaacaggtactaaacgctgccaacccgtagaaacggcaggtacttcaccatctacaagagatagacttacaacgaacacgtcttacgttactaacgtaaatcgatacacgaccaaacggaaaaccgaacggaacaacgtaaccgtccgtaaggtaactttacgttacgtaacccgaaaggagggaaacgagttcttaaggttaatagtaagtagttaggttagttcggtttaataagg

SEQ ID NO: 324720 - DNA, 670 bp, Homo sapiens
  misc_feature: GZ8MTXP01C3957.38.55.E11.1.454.CMB.2.raw
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggtattttccttgctgcttaattttaaaaggtgtccagtgtgaggtgcagcgtggtggagtcgtgggggagtgttagggaagccgtgggggtcccttagactctcctgtacacgcctctggtattctacttttagtatcgctggatgaccgtggtccgcaggcctaccgaaggggaaggggctagggaagttgggggttaggtaccgtaaagttaaaaggtgtaaacgtggtaagtggggtacggaacaacgacgacctaaacgctcggaccaacccgggtaggaaacggcaagtacttaccaccatacctacgaaagagtaagtagtaacttacaaacgactacgtccttactttacctaataaatgtaactaccgaacgtacccgtaaaggaaaacccggaggaacctaacggtacgtccgttagtaacttaacgacgtaaaccgagaaacgggaagttaacgttcttaagtttaagtagtgtaagttaggttaggttaacgttaattaacg

SEQ ID NO: 324721 - DNA, 587 bp, Homo sapiens
  misc_feature: GZ8MTXP01BJJO2.38.55.E11.1.454.CMB.2.raw
  modified_base (304)..(304): a, c, t, g, unknown or other
  misc_feature (304)..(304): n is a, c, g, or t
  modified_base (346)..(346): a, c, t, g, unknown or other
  misc_feature (346)..(346): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtcgtgggggagcgttgggaaagccgtgggggtcccttagactctctgtacagcctctggattcacttttagtatgcctggatgacctggccncaggctccgaggaagggctggaatgggtgacgttaataaagngaaactgagtggtaggacaagagactaacgctgacacccgtagaaaggcagattacacctatctacaagagatagacttacaaaccgtaacacgtcttactttaccaataaatgactacgacgaccgtaacgaaaccgaggaccaacgacggtacccttagtaacttacacgttaaacccgacggaagggaacagttaccttaagttaattagtgtaagttagttagttcggtttaattcg

SEQ ID NO: 324722 - DNA, 658 bp, Homo sapiens
  misc_feature: GZ8MTXP01CSFFU.38.55.E11.1.454.CMB.2.raw
  modified_base (485)..(485): a, c, t, g, unknown or other
  misc_feature (485)..(485): n is a, c, g, or t
  modified_base (607)..(607): a, c, t, g, unknown or other
  misc_feature (607)..(607): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgcttattttaaaaggtgtccagtgtgaggtgcagctgggtggagtcgtgggggaggcgttggggaaagccgtgggggtcccttagactctcctgtacagcctgtggtattctacttttagtatgcctggatcgaccgtcggggtccgccgaggcctacccgaaggggaaacgggggtcgtagggaaggttgggggtttacggtaccggtaaagtttaaaagtagtaaaacgtggtagtagggtagggaacaacgaagtacctaacgactcgaccacccggtaggaaacggcagtactccaacatcctacgaaganagtagacttacgaaacgtacacgtcttacttacaacgtaaatgactacacgacctaagaaaccgaggaaccagacgtccgtataacgttaccttaggtaacccaggtaaagggagttaacgngttaagtttaatagtaagtaagttaggttaggttaaggtttaactttaacg

SEQ ID NO: 324723 - DNA, 570 bp, Homo sapiens
  misc_feature: GZ8MTXP01EJ9XZ.38.55.E11.1.454.CMB.2.raw
  modified_base (302)..(302): a, c, t, g, unknown or other
  misc_feature (302)..(302): n is a, c, g, or t
  modified_base (344)..(344): a, c, t, g, unknown or other
  misc_feature (344)..(344): n is a, c, g, or t
  modified_base (411)..(411): a, c, t, g, unknown or other
  misc_feature (411)..(411): n is a, c, g, or t
  modified_base (416)..(416): a, c, t, g, unknown or other
  misc_feature (416)..(416): n is a, c, g, or t
  modified_base (476)..(476): a, c, t, g, unknown or other
  misc_feature (476)..(476): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggatttccttgctgctatttaaaggtgtccagtgtgaggtgcagctggtggagtcgtgggggagcgttgggaaagccgtgggggtcccttagactctcctgtacagcctctggattcacttttagtatgcctggatgactggtccncagcctacgaggaaggctaggagtggtgacgttaataaagtnaaactgagtggaggacaagagactaacgctgacgacccgtagaaacggcagacttacaccaatccanaagantagattcaaacgacactctactttacgaacaaagttgaattcaagcccaagaaaacccgnggacacgagcccgttagtaacttaccaggtaacccaagaaggggaacgaagacgttagttaatagtaagtaagtagttagttcccgttaagtcg

SEQ ID NO: 324724 - DNA, 625 bp, Homo sapiens
  misc_feature: GZ8MTXP01B4UUQ.38.55.E11.1.454.CMB.2.raw
  modified_base (432)..(432): a, c, t, g, unknown or other
  misc_feature (432)..(432): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctatttaaaggtgtcagtgtgaggtgcagctggtggagtcgtgggggagcgttgggaagccgtggggggtcccttagactctcctgtacagcctctggacttctacttttagtatgcctggatgaccgtggtccgcaggctaccgagggaaggggctaggagtgggtaggcgttaagttaaaagtgtaaactggagtcgggtaggacaacgagactaacgctgacacccgtagaaacggcagactacaccatctacaaganatagaacttacaaacgaacacgtacttactttactaaacgtaaattgtaactacgaagaccctaacggaaaacccgaaggaccaaccgtacgtacccgttaggtaacttaaccttacggtaaacccacggaaagggaacttacgggacttaagttaattagtaagtaagtaggttagtaaggtttaattaacg

SEQ ID NO: 324725 - DNA, 664 bp, Homo sapiens
  misc_feature: GZ8MTXP01EO2S2.38.55.E11.1.454.CMB.2.raw
  modified_base (189)..(189): a, c, t, g, unknown or other
  misc_feature (189)..(189): n is a, c, g, or t
  modified_base (278)..(278): a, c, t, g, unknown or other
  misc_feature (278)..(278): n is a, c, g, or t
  modified_base (314)..(314): a, c, t, g, unknown or other
  misc_feature (314)..(314): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttggctgagctggtattttccttgctgtcttaattttaaaaggtntccagtgtgaggtgcagctggtggagtcggtgggggaggtcgttagggaagtccggtgggggtcccttagactctcctgtacacgcctntgtattctactttagtatgctgatgaccgtggtccncgaggctcgaagggaaggggtctggaagttgggtacggtacgttaaagttaaaagtgtaaactggagtgggtaggaactaacgagtaccgtaacgctcgccgtaacccgtaggaaacgctaacgacttaccaacctataccctaagaaagagtattaacgtattaaaccgaacgaaactaccgtcttaacttaccaaacgtaatacgaactacgacgtaaccctaaacggaaaaccgagtaccaacgtacgtccgttaagtaaccttacgttacggtaaacgacggaaagggaacgagttacgttatttaattagtaagtaagttacggttaggttcggtttaactaacg

SEQ ID NO: 324726 - DNA, 640 bp, Homo sapiens
  misc_feature: GZ8MTXP01DI7B9.38.55.E11.1.454.CMB.2.raw
  modified_base (306)..(306): a, c, t, g, unknown or other
  misc_feature (306)..(306): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgcttatttaaaggtgtccagtgtgaggtgcagctggtggagtcgtgggggaggcttgggaagccgtgggggtcccttagactctcctgtacagcctctggtattctacttttagtatgcctggatgacctggtccncaggctcgaggaagggctggaagtgggtgacgtaattaaagtgaaactgagtcggtgggaacagagacgtaacgctcgcacccgtagaaacggcagtactcaaccatactacaaaagtatagaattacaaacgaactacgcttacttaactaacgaaattcgataacacggaccctaaacggaaaacccgaggaaaccacgtaacggtacccgttaggttaaccttaacgttaaccgaaaccgaaacgaaaggggggtaaactagggttaaccttaggttttaaacttaagttaagtaagttaggttaaggttggtttaaacttcggtttaacg

SEQ ID NO: 324727 - DNA, 678 bp, Homo sapiens
  misc_feature: GZ8MTXP01D6MNR.38.55.E11.1.454.CMB.2.raw
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctatttaaaggtgtccagtgtgaggtgcagcgtggtggagtcggtgggggaggcgttagggaaagccgtgggggtcccttagactctcctgtacagcctgtggtattctactttagtatgcctggatgaccgtcggtccgccaggcctaccgagggaaacggggtctagggtagttggggtaggtaccggtaagttaaaagtgtaaactgaagtgggtacggacaacgagacctaacgctcggacctacccgtagaaacgcgagtacttaccacactactacgaaagtacagtagtaactaacaaacgtaaccaccgtacttactttaaccaactaaaattcgaacttaaccgaacgtaccccgtaaagggaaaacccgaggaacctaaccggaacgtcccgtagttaaacttacgttacggtaaacccttaaagggaaacgggtaaagttacggacttaaaggttaataagtgtaagttaggttagttaacggtttaattaacggg

SEQ ID NO: 324728 - DNA, 736 bp, Homo sapiens
  misc_feature: GZ8MTXP01EF7PN.38.55.E11.1.454.CMB.2.raw
  modified_base (273)..(273): a, c, t, g, unknown or other
  misc_feature (273)..(273): n is a, c, g, or t
  modified_base (325)..(325): a, c, t, g, unknown or other
  misc_feature (325)..(325): n is a, c, g, or t
  modified_base (632)..(632): a, c, t, g, unknown or other
  misc_feature (632)..(632): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggtattttcctgctgtcttaattttaaaaggtgtccagtgtgaggtgcagcgtgggtggagtcgtgggggagtcgttagggaagtccggtcgggggtcccttagactctcctgtacncgcctcgtggtacttctacttttagtatcgtctggatcgaccgtgggtcccncgacggctaccgaaggggaaacggggtcgtagggtaaggttggggtttacggtaaccggtttaaagttaaaaggtcgtaaaacgtggtaaggttcggggtacgggaacgaaacgacggtacccttaaccgacgttcgacccgtaaaccccgggtaaaggaaacggtcaacggtaactttacccaacgtacttacaacgaagtagattagtaattacgaaacgactacgtactttacttacctaaaggaaacttgaactcgaaacggacctaacggaaaaccgaaggacccaacgtacggtaccgttnttaaacgttccgttaaggtaacccgaaaggtaagggaaacggttagttacgtttaaattaagttaagtgttaagttagggttaagtttccggtttaattaacgg

SEQ ID NO: 324729 - DNA, 629 bp, Homo sapiens
  misc_feature: GZ8MTXP01BXVA6.38.55.E11.1.454.CMB.2.raw
  modified_base (272)..(272): a, c, t, g, unknown or other
  misc_feature (272)..(272): n is a, c, g, or t
  modified_base (458)..(458): a, c, t, g, unknown or other
  misc_feature (458)..(458): n is a, c, g, or t
  modified_base (482)..(482): a, c, t, g, unknown or other
  misc_feature (482)..(482): n is a, c, g, or t
  modified_base (591)..(591): a, c, t, g, unknown or other
  misc_feature (591)..(591): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagagactcaccatggagtttggctgagctggtattttccttgctgcttaattttaaaaggtgtccagtgtgaggtgcagcgtggtggagtcgtgggggaggcgttagggaagccgtgggggtcccttagactctcctgtacagcctntggtattctacttttagtatcgccgtggactcggacccgtcggggtcccgccgacggccgtacccggaagggggaaacggggtcgtagggaaggttgggggtttacgtaccgttaaagttaaaacggtagaaacgtgagtagggtaggaacaacgagacctaacgctcgaccacccggtagaacgnaagtactaccactatcacgaaganatagacttaacaacgacactcttacttactaacaatgactacgaacgaccgtaaggaaacgagacacgacgtcttagtaacttacacgtaccaaggaggtaagacgttnttaagttaatagtgtataggttacgttgttaacgttcg

SEQ ID NO: 324730 - DNA, 661 bp, Homo sapiens
  misc_feature: GZ8MTXP01AK8WJ.38.55.E11.1.454.CMB.2.raw
  modified_base (623)..(623): a, c, t, g, unknown or other
  misc_feature (623)..(623): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctatttaaaaggtgtccagtgtgaggtgcagctgggtggaggtcgtgggggaggcgttgggaaagccgtggggggtccctagactctcctgtacagcctgtggtattctacttttagtatcgcctggactcggaccgtcgggtcccgccaggcctccgaagggaacggggctagggaagtgggggttggaccggttaagttaaacgtagaaacgtggagtgggtagggacaaagacgactaaacgctgcccacccggtagaaacgcagtacttcacctatactacgaagagtatacgaacttacgaaaccgaaccacgtacttacctttaacaactaaagtgaactacaacgtacccgaaagaaaaccggaggaacctaacgacggtcccgtagttaacgttacgttacggtaacccaaggtaaggggaacgagttacgttaggtttaattntaagggtaaattcggttaaggttggtttaacgttaacg

SEQ ID NO: 324731 - DNA, 599 bp, Homo sapiens
  misc_feature: GZ8MTXP01EKYEH.38.55.E11.1.454.CMB.2.raw
  modified_base (558)..(558): a, c, t, g, unknown or other
  misc_feature (558)..(558): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttcctgctgctattttaaaggtgtccagtgtgaggtgcagctggtggagtcgtggggagcgttgggaagccgtgggggtcccttagactctctgtacacgtctcgtgtattctacttttagtatcgtcgtgatcgaccgtcggtccgcgaggtcctaccgaagggaaacggggctaggtagtggggttcgaccgttaaagttaaagtagaaacgtgagtcgggtaggacaagacgacgtaacgcgtcgaccgacccgtagaagacagacttcgactactacctagaagagagtagtaacttacaaacgacacgtcttacttacaactaatgactacacgtactaacgaaacgagactacgacgcgttagtaacttacgttacaccgagaagggaacngacttagttaatagtaagtacgtagttagttgttgttaacg

SEQ ID NO: 324732 - DNA, 736 bp, Homo sapiens
  misc_feature: GZ8MTXP01COVUS.38.55.E11.1.454.CMB.2.raw
  modified_base (312)..(312): a, c, t, g, unknown or other
  misc_feature (312)..(312): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgcttatttaaaaggtgtccagtgtgaggtgcagcgtggtggagtcgtgggggaggtcgttagggaaagccgtgggggtcccttagactctcctgacagtcctcgtggtattctactttagtatgcctggatgaccgtggccnccgaggctccgaaggaacggggcgtaggagtgggttggaccgtaagttaaaacgtagaaacgtggagtcggtaggggacaacgagacgtaaacgcgtcgaccgtacccgtaagggaaacggacgaagtaacttacccaaacccgtaattaccgaactaaaaggaccgtaaagttaggtaaacttaaccgaaaaccggtaaaccacggttaaccctttacgtttaaacctaaacctaaaagttacggtaaacttcccgtaaaagaaccccgttaaacggaaaaaacccgacgggaaacctaaccgaacgtacccgttgttaaacttacgttacgtaaaccaaacggtaaagggaacgaccgttacttaaagggtttaattaaggaaggttaagttaagttacgggtttaagttaagtttaaccgg

SEQ ID NO: 324733 - DNA, 595 bp, Homo sapiens
  misc_feature: GZ8MTXP01BR6CW.38.55.E11.1.454.CMB.2.raw
  modified_base (272)..(272): a, c, t, g, unknown or other
  misc_feature (272)..(272): n is a, c, g, or t
  modified_base (305)..(305): a, c, t, g, unknown or other
  misc_feature (305)..(305): n is a, c, g, or t
  modified_base (311)..(311): a, c, t, g, unknown or other
  misc_feature (311)..(311): n is a, c, g, or t
  modified_base (315)..(315): a, c, t, g, unknown or other
  misc_feature (315)..(315): n is a, c, g, or t
  modified_base (399)..(399): a, c, t, g, unknown or other
  misc_feature (399)..(399): n is a, c, g, or t
  modified_base (427)..(427): a, c, t, g, unknown or other
  misc_feature (427)..(427): n is a, c, g, or t
tcagtcgatcacgtcacgaccggtgctcgatttagcactcgcacgttgggtttgggacaatcttcatcatgacctgctcccctctcctcctcacccttctcattcactgcacagggtcctgggcccagtctgtgttgacgcagccgccctcagtgtctgcggcccaggacagaaggtcaccatctcctgctctggaggcagctccaacattggatattaattttgctcctggtaccagcagctccaggacacgccccaaactcctcatttangaaccataatacggccaccctgaggtacttccngaccgnttcnctgctcagtctggcacgtcacgccaccgtggccactccgacccgccctcgaacgcggtgggggacacggcgtattacgttacgnggacgagacgtgggaactaacgagtacngtaacgtgtcgggttgggtcgtccgttggggacgggacgggaccgaggtccgtcggtacccgtaccgtacggtccaacgtcccgacgggtcccttccggccccgtcgttcgttaccgttccgttcccgtccccgtcccgtaccctccgttacgtaacgttcgtcccgg

SEQ ID NO: 324734 - DNA, 527 bp, Homo sapiens
  misc_feature: GZ8MTXP01AS186.38.55.E11.1.454.CMB.2.raw
  modified_base (182)..(182): a, c, t, g, unknown or other
  misc_feature (182)..(182): n is a, c, g, or t
  modified_base (219)..(219): a, c, t, g, unknown or other
  misc_feature (219)..(219): n is a, c, g, or t
  modified_base (350)..(350): a, c, t, g, unknown or other
  misc_feature (350)..(350): n is a, c, g, or t
  modified_base (501)..(501): a, c, t, g, unknown or other
  misc_feature (501)..(501): n is a, c, g, or t
  modified_base (503)..(504): a, c, t, g, unknown or other
  misc_feature (503)..(504): n is a, c, g, or t
  modified_base (506)..(527): a, c, t, g, unknown or other
  misc_feature (506)..(527): n is a, c, g, or t
tcagtcgatcacgtcacgaccggtgctcgatttagcactcgcacgttgggttggccgtattaaaaagtgaaactgatggtgggacaacagactacgctgcacccgtgaaaggcagattcaccatctcaagagatgattcaacgaacacgctctttctacaaatgatcagcctagaaaaccgnggacacagccgtgtattactgtaccacgagggaagancagtttattatgatagtagtggtatctgtactactacggtatggacgtcgtggggccaaagggccaggtcattcgtcctccccagccctccaacccgaacggggccccattcccgggtcccttccccccgnggcccctacccctcctaccgaaagaccgccacctcggtcgggggccacgcggcccggcccgtggggctcgcccgtcgggtacaacgggtccttactccgaacgtgaacgtcggaacggtgggcggcgggtcgacggacgacggcgactagngnngnnnnnnnnnnnnnnnnnnnnnn

SEQ ID NO: 324735 - DNA, 606 bp, Homo sapiens
  misc_feature: GZ8MTXP01A075X.38.55.E11.1.454.CMB.2.raw
  modified_base (316)..(316): a, c, t, g, unknown or other
  misc_feature (316)..(316): n is a, c, g, or t
  modified_base (388)..(388): a, c, t, g, unknown or other
  misc_feature (388)..(388): n is a, c, g, or t
  modified_base (554)..(554): a, c, t, g, unknown or other
  misc_feature (554)..(554): n is a, c, g, or t
  modified_base (563)..(563): a, c, t, g, unknown or other
  misc_feature (563)..(563): n is a, c, g, or t
  modified_base (567)..(567): a, c, t, g, unknown or other
  misc_feature (567)..(567): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtcgtgggggaggcgttggggaaagccgtggggggtcccttaggactctcctgtacagccctctggtattctacttttagtatgcctggatgaccgtggtccgcnggctccgaggaaggggctaggaagtgggttggaccgttaagttaaaaggtagaaacgtgagtgggtaggganaacgagactaacgctgccaccgtagaagcagactcaccatacacgaagagtatagtaacttacaaaccgaaactaccgtcttacctttacaaacaaagttgactacgacgaccctaacggaaaaccgaggaactaccgagtccgtagtaactaacttcgaaaccgngaaaggganacgnttagttaatagtaagtaagtgttagttggttaataacgg

SEQ ID NO: 324736 - DNA, 664 bp, Homo sapiens
  misc_feature: GZ8MTXP01BPKKY.38.55.E11.1.454.CMB.2.raw
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctatttaaaggtgtcagtgtgaggtgcagctggtggagtcgtgggggaggcgttgggaaagccgtgggggtcctagactctctgtacagcctctggtattctactttagtatgcctggactcggaccgtcgggtccgcgacggctaccggaagggaacgggggtcgtagggaagttgggggttacggtaccggttaagttaaaagtagtaaacgtgtaagtcgggtagggtaacaaacgagaaccgtaacgacgtcgaccaacccggtaggaaacggacaaggacttaccacctatcacgaagagatacgacttacaaacgtacacgtctactttacaaactaaagtcgaactacgaacgtacccgtaaacgaaaaccgaacgtaccaacgtacgtccgttaagtaacttaacgacgtaaaccgaacgtaaagggaacttaggacttaagtttaatagtaaggtaattaggttagttaaggttaacttaacgg

SEQ ID NO: 324737 - DNA, 679 bp, Homo sapiens
  misc_feature: GZ8MTXP01C0U8B.38.55.E11.1.454.CMB.2.raw
  modified_base (264)..(264): a, c, t, g, unknown or other
  misc_feature (264)..(264): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggatttccttgctgctatttaaaggtgtccagtgtgaggtgcagctggtggagtcgtgggggagcgttgggaagccgtgggggtccttagactctcctgtacagcctntggattctacttttagtatgcctggactgtaccgtgggtccgcgaggctaccgagggaaggggctaggagtgggttaggtaccgtaagttaaagtgaaactgagtcggtaggacaacgacgactaacgctcgaccacccgtagaaacgcagtacttaccaccgtatcgtacgaagagtatagacttacgaaacgaactacgtacttactttaacctaaactaaattcggtaaactaccgaaacgttacccgaacggaaaaacccggtcggaaaccctaacgtaccgtcccgtttaaggttaacttaacggttaccgtaaaccgaacggaaaggggtaaacgaacggttcttaaaggttttaattaaaggtaacggtaagtttaaggttaacgggtttggtttaacctttaaccgg

SEQ ID NO: 324738 - DNA, 734 bp, Homo sapiens
  misc_feature: GZ8MTXP01CP7DE.38.55.E11.1.454.CMB.2.raw
  modified_base (323)..(323): a, c, t, g, unknown or other
  misc_feature (323)..(323): n is a, c, g, or t
  modified_base (393)..(393): a, c, t, g, unknown or other
  misc_feature (393)..(393): n is a, c, g, or t
  modified_base (689)..(689): a, c, t, g, unknown or other
  misc_feature (689)..(689): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggtattttccttgctgcttatttaaaggtgtccagtgtgaggtgcagcgtggtggagtcgtgggggaggtcgttaggggaaacgccggtgggggtcccttagactctcctgtacacgcctcgtggtacttctacttttagtatgcctggatcgaccgtcgggtcccncgacggctacgaagggaaggggctaggaagtgggttagacgtaagttaaagtgaaacgtgaggttacggnggaactaagacgactaaacgctaacgaccgtaacccggtaagggaaacggacaacgtacttaccaccctatacaacgaaagagtaagtagtaacttaacgaaacgtaaaccgacgttaacttacctttaaccgtaaactaaaagttacgaaactacccgaacgtaaacccgtaacgaaaaaacccgggaccggaactaacgtaaccggtaccgttaaggttaaaccttacggttaaaccggaacccaaagggaaacgggggaacttaaagggcctttaaaaggtttaatttaaagngtttaaaggtaagggtttaaccggttttcggttaagttttaaccg

SEQ ID NO: 324739 - DNA, 632 bp, Homo sapiens
  misc_feature: GZ8MTXP01C6O51.38.55.E11.1.454.CMB.2.raw
  modified_base (462)..(462): a, c, t, g, unknown or other
  misc_feature (462)..(462): n is a, c, g, or t
  modified_base (592)..(592): a, c, t, g, unknown or other
  misc_feature (592)..(592): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgcttattttaaaaggtgtccagtgtgaggtgcagctggtggagtcgtgggggagcgttgggaaagccgtggggggtcccttagactctcctgtacagcctctggattctacttttagtatgcctggatcgaccgtgggtccgcaggctccgaagggaaacggggctaggaagtgggggtttaggaccgtaagtttaaaagtagaaaacgtggtagtgggtaggggaacaacgaacgactaaacgctcgaccaacccggtaggaaaacggcaaggtactcaacctatacctanaagagatagacttacaaacgtaacacgtcttactttacaaacggtaaattagactaccgagtaaccgtaacgaaaacccggagaacaaccgtcgaccgttagtaacttacagtaacccaaagtagggaanagttacagtttaataagtcgtatagttagttgttaacctg

SEQ ID NO: 324740 - DNA, 698 bp, Homo sapiens
  misc_feature: GZ8MTXP01CYKWL.38.55.E11.1.454.CMB.2.raw
tcagtcgatcacgtcacgaccggtgctcgatttagcactcgcacgttgggtttggggacaatcttcatcatgacctgctcccctctcctcctcacccttctcattcactgcacagggtcctgggcccagtctgtgttgacgcagccgccctcagtgtctgcggcccaggacagaaggtcaccatctcctgctcgtggaggcagctaccaacattggagtattaattttgctctggtaccagcagcctccaggaacacgaccccaaactcctactatttatcgaacctaataaacgtacggccacccctgagggtactttcccgtagacccgtatttccgtcgtttcggaccttaccgaaagttccgttacgggcctacccggtccacgccccgaacccgtgggaaccctactcccgaacccggtccctacgaaggccggtacgggggacgacgggtaccctaaagtttacgttacgcggacggtaaacgtaggtacgggtataacgtcgaagtacgtagtaacgtggtcggtttggggtcgacggttggggacgggacgggacgtacgggcgtaccggtaccggtacgtacgggtaaccacggacccgtaacggcccgttacccgggccccgttcgggttcccttaccgttcccgtccgtttcccccggcccttccgttacgtaaccgttggtaaccg

SEQ ID NO: 324741 - DNA, 722 bp, Homo sapiens
  misc_feature: GZ8MTXP01E0KVW.38.55.E11.1.454.CMB.2.raw
tcagtcgatcacgtcacgaccggtgctcgatttagcactcgcacgttgggtttgggggagatctgggagaggagccccagccttgggattcccaagtgttttcattcagtgatcaggactgaacacagaggactcaccatggagtttgggctgagctggtattttccttgctgcttaattttaaaaggtgtccagtgtggaggtgcagcgtgggtggaggtcgtgggggaggtcgttagggaagccggttgggggtccctagctctcctgtacacgcctgtggtattctacttttagtatcgtccgtggactcgaccggtcgggtcccgccgaggtccgtaccggaaggggaaacgggggtcgtagggtaggttgggggttcgggtacgttaaagttaaaaggtgaaacgtggtagtcgggtagggaacaaagacgtacctaacgcgtgaccaccgggtagaacgcaagtactaccactataccgtaagaaggactagtacgtacttaaacgaaaccggaaccaccgttcctttaaccgtttactaaacctaaagttacgaacttacccgacgaacccgtaaacgaaaaccggaacgggtaaaccctacgaccggttacgtagttaaccttaacgttaccggtaccgaaacggaaggtaacgttacgttacgttagttaagttataacggttaattacggttagtttaacggttttgtaacg

SEQ ID NO: 324742 - DNA, 716 bp, Homo sapiens
  misc_feature: GZ8MTXP01EQV3I.38.55.E11.1.454.CMB.2.raw
  modified_base (239)..(239): a, c, t, g, unknown or other
  misc_feature (239)..(239): n is a, c, g, or t
  modified_base (283)..(283): a, c, t, g, unknown or other
  misc_feature (283)..(283): n is a, c, g, or t
  modified_base (464)..(464): a, c, t, g, unknown or other
  misc_feature (464)..(464): n is a, c, g, or t
tcagtcgatcacgtcacgaccggtgctcgatttagcactcgcacgttgggtttggggacaatcttcatcatgacctgctcccctctcctcctcacccttctcattcactgcacagggtcctgggcccagtctgtgttgacgcagccgccctcagtgtctgcggcccaggacagaagtcaccatctctgctcgtggagcagctaccaatagttggagtattaattttgctctaggtaccngcacgcctccgaaggaccaccgaccccctaaatcctatatttancgaacctaataacgtacggcctaaccctgaggtacttcccgagtaacccgtattcctcgtcggcctaccgtaagtcgtcggacctacccgtccacgtcccgacccgtggaacctacgtcccgacccgtccctacgacggtaccggagggggacctacggtacccgttaattacgttaccgnggaccgaagtacgtacgggtaactaccgagtacgtaagtaagtcggtaggggttcgggtacgtccggtacggggtacggaccggtacgtacgggtacgtcggtaaccccggttcgtaccgggtaccgaacgtccccggttaaacggtcccgttaacccggtcccccggttcggttaaccccgttccgtttcccgttcccgggtcccccttaacccgtccccgttacgaccggttcgttaaccgttcccgggg

SEQ ID NO: 324743 - DNA, 619 bp, Homo sapiens
  misc_feature: GZ8MTXP01DLCB6.38.55.E11.1.454.CMB.2.raw
  modified_base (307)..(307): a, c, t, g, unknown or other
  misc_feature (307)..(307): n is a, c, g, or t
  modified_base (350)..(350): a, c, t, g, unknown or other
  misc_feature (350)..(350): n is a, c, g, or t
  modified_base (367)..(367): a, c, t, g, unknown or other
  misc_feature (367)..(367): n is a, c, g, or t
  modified_base (422)..(422): a, c, t, g, unknown or other
  misc_feature (422)..(422): n is a, c, g, or t
  modified_base (504)..(504): a, c, t, g, unknown or other
  misc_feature (504)..(504): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctatttaaaaggtgtccagtgtgaggtgcagctggtggagtcgtgggggagcgttgggaagccgtgggggtcccttagactctcctgtacagtcctgtggattctacttttagtatgccgtgatgaccgtggtccnccaggctcgaggaagggctggaagtgggtgacgtaataaagtnaaacgtgatggtagganaacgagactaaacgctcgccaacccgtagaaacggcagacttcgacctataccanaagagtatagacttacgaaaccgacacgtcttacttactaactaaatgaacttaccgaagtacccgaaaggaaaaaccccgnggaaaccacgacggtcccgttagttaaacttcgttagtaaaccccgaggaaagggaacgagttccttaaggtttaatagtaaggtaattaggttaccgtttggttaatttaaccg

SEQ ID NO: 324744 - DNA, 472 bp, Homo sapiens
  misc_feature: GZ8MTXP01DAOUG.38.55.E11.1.454.CMB.2.raw
  modified_base (183)..(183): a, c, t, g, unknown or other
  misc_feature (183)..(183): n is a, c, g, or t
  modified_base (210)..(210): a, c, t, g, unknown or other
  misc_feature (210)..(210): n is a, c, g, or t
  modified_base (217)..(217): a, c, t, g, unknown or other
  misc_feature (217)..(217): n is a, c, g, or t
  modified_base (333)..(333): a, c, t, g, unknown or other
  misc_feature (333)..(333): n is a, c, g, or t
  modified_base (371)..(371): a, c, t, g, unknown or other
  misc_feature (371)..(371): n is a, c, g, or t
  modified_base (461)..(472): a, c, t, g, unknown or other
  misc_feature (461)..(472): n is a, c, g, or t
tcagtcgatcacgtcacgaccggtgctcgatttagcactcgcacgttgggttggccgtattaaaaagtgaaactgatggtgggacaacagactacgctgcacccgtgaaaggcagattcaccatctcaagagatgattcaaacgaacacgctcttttctacaaatgatcagcctgaaaaccgnggacacagccgtgtattactgtaccanagggaanagcagttattatgatagtagtgttatctgtactactacggtatggacgtcgtggggccaagggaccaggtcattgtcctccccagcctccaccaggcccatccggtccttccccgngcacccctcctccaagcgcacctcgtcgggggccacgngccggccctgggctcggcctcgggtaccaaaggcctacgttccacgtcagtcgactggacggcgggactgggaccaagggcacgagtagnnnnnnnnnnnn

SEQ ID NO: 324745 - DNA, 667 bp, Homo sapiens
  misc_feature: GZ8MTXP01A7OBP.38.55.E11.1.454.CMB.2.raw
  modified_base (272)..(272): a, c, t, g, unknown or other
  misc_feature (272)..(272): n is a, c, g, or t
  modified_base (371)..(371): a, c, t, g, unknown or other
  misc_feature (371)..(371): n is a, c, g, or t
  modified_base (512)..(512): a, c, t, g, unknown or other
  misc_feature (512)..(512): n is a, c, g, or t
  modified_base (632)..(632): a, c, t, g, unknown or other
  misc_feature (632)..(632): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggtattttcctgctgcttatttaaaggtgtccagtgtgaggtgcagcgtggtggagtcggtgggggaggcgttagggaagccgtgggggtccctagactctcctgtacacgtcctntggtattctacttttagtatgccgtggatcgtaccgtcgggtccgccgaggctaccgaagggaacgggctaggtagtgggttcggacgtaagttaaagngaaactggagtgggaggacaacgagactaacgctcgaccgtaacccggtagaaacggcagacttacaactattcaagaagacgattacggaattaaccaaacggttaacaccgtaccttactttaacgtaactaaggttanaacgttaccaacggtacccgaaacgaaaccgggaacggaccaaaccgaccgttaccgttaggtaaaccttacgttacggaaacccgacgaaaggggaacttaggcttaaagttgttaaanggttacgttaagttaggttaagtttaagttaaccg

SEQ ID NO: 324746 - DNA, 586 bp, Homo sapiens
  misc_feature: GZ8MTXP01BVLRJ.38.55.E11.1.454.CMB.2.raw
  modified_base (429)..(429): a, c, t, g, unknown or other
  misc_feature (429)..(429): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctatttaaaggtgtccagtgtgaggtgcagctggtggagtcgtgggggaggcgttgggaaagccgtggggggtcccttagactctcctgtacagcctcgtggattcacttttagtatgcctggatgacctgggtccgcaggctccgaggaacggggctaggaagtgggttggaccgttaattaaaacgtgaaactggatcggtgggaacaagagactaacgctgcacccgtgaaagcagattaccacatctacaaganatagacttacaaacgtaacacgtcttacttacgaacgtaaattgaactcacgtaccctaaggaaacccgtaggaacctacgagtccgtataacttacgttcgtacgacgtaagggaacagcttaaggttaatactgtataggttactggttaacttg

SEQ ID NO: 324747 - DNA, 860 bp, Homo sapiens
  misc_feature: GZ8MTXP01AL1FB.38.55.E11.1.454.CMB.2.raw
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctatttaaaaggtgtccagtgtgaggtgcagctggtggagtcgtgggggagcttgggaaagccgtggggggtcccttagactctcctgtacagcctctggacttctacttttagtatgcctggatcgaccgtgggtccgccgacggctccgaagggaaacgggggcctagggtaagttgggggttaggacccggtttaaagtttaaaacggtgtaaaaccgttggaacgttacggggaggggtaacaaacgaggtaacccgttaaaccggccgttaacggacccgtaaaccccgggttaggaaaaacggggcctaaagggtaacctttacccaaacccctaatttaccctaacgaaaaggaccggtaattacgggaaactttacaaaacccgggtaaacctaaccgtacctttaaccgtttttaaccaaaccttaaaagttacggaaattaaccccgaaacggtaccccgttaaaacgaaaaaccccgggacggtaaacccgtaccgaaaccgggtaccccggtttaaagggtttaaactttaaacccggttacggtaaaccccgaaacgggtaaacggggggaaagttaacccggttagttaaacggttttttaacggttaaagttaacgggggttaaactttaaacggggttttacgggtttaaggggttttaaccttttaaccggg

SEQ ID NO: 324748 - DNA, 691 bp, Homo sapiens
  misc_feature: GZ8MTXP01BPEAL.38.55.E11.1.454.CMB.2.raw
  modified_base (371)..(371): a, c, t, g, unknown or other
  misc_feature (371)..(371): n is a, c, g, or t
  modified_base (574)..(574): a, c, t, g, unknown or other
  misc_feature (574)..(574): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctattttaaaaggtgtcagtgtgaggtgcagctggtggagtcgtgggggagcgttgggaagcgtgggggtccttagactctctgtacagcctctggattcgtacttttagtatgacctggatcgaccgtcgggtccgccaggctaccgaaggggaaacggggctaggaagtgggggttacggacgttaagttaaaaggtnaaacgtggtagtgggtacgggaaacaacgacgactaaacggctcggccaaacccggtaggaaaacgggcaaacggacttaccaaccctataccgtaacgaaaggaagtaataaggtaacttaacaaaacggaaacaacgtcttaacttttacgaaacaaaagtttccggaaatccgaaagcccaaaggaaaaaccgacggaanaacccgagacccggttagtaactttaacgacggtaaaccaagggaaaggaacgaacggttacttaagggtttaaatataagtaaagttagttaggggtttaagttaaccctttaagg

SEQ ID NO: 324749 - DNA, 712 bp, Homo sapiens
  misc_feature: GZ8MTXP01ELNRU.38.55.E11.1.454.CMB.2.raw
  modified_base (262)..(262): a, c, t, g, unknown or other
  misc_feature (262)..(262): n is a, c, g, or t
  modified_base (669)..(669): a, c, t, g, unknown or other
  misc_feature (669)..(669): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctatttaaaaggtgtccagtgtgaggtgcagctggtggagtcgtgggggagcgttagggaagccgtgggggtccttagactctcctgtacncgcctgtggtattctacttttagtatgtcctggatcgaccgtcgggtccgccgacggcctaccgaagggggaaacggggtcgtagggaaagttgggggttacggtaccggtttaaagttaaaacggtagaaaacgtggaacgttggggtacgggaaacaacgtaacgaacccgtaaaccggctcggaccctaacccgggtaagggaaaacgggaccgaaggtactttacccaacctaattaccaagaaaggtagtaagtacgaacgttaacaaaaccggaacctaccgtactttactttactaaacggtaaatcgtaactacgaacgtacccgtaaacggaaaaccgacggaaccaacgtacgtacccgttagttaacttacgttacgtaacccgagaaaggggaanagttcttaagttaatataagtagttagttagttggttaattcg

SEQ ID NO: 324750 - DNA, 628 bp, Homo sapiens
  misc_feature: GZ8MTXP01AKVFT.38.55.E11.1.454.CMB.2.raw
  modified_base (590)..(590): a, c, t, g, unknown or other
  misc_feature (590)..(590): n is a, c, g, or t
  modified_base (607)..(607): a, c, t, g, unknown or other
  misc_feature (607)..(607): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctatttaaaaggtgtccagtgtgaggtgcagctggtggagtcgtgggggagcgttagggaagccgtgggggtccctagactctcctgtacagcctctggtattcacttttagtatgctggatcgacctggtccgcgaggctaccgagggaaacggggctaggaagtgggggttacggaccgtaagttaaaggtagaaacgtggagtggtaggggacaacgagtactaacgctgaccgaacccggtagaacggacaggtactaccgaccatccgacaaaggtacgaagtacgtaattaccgaaaccgaactacccgtcttacttttacaactaaaacgtgaaactacgaaacgcccgtaacgaaaaccgacggaccaacgacggtcctgtaactacgttacgtaaccgacgaaagggaancgttattagttaatagngtaagtgttagtgttaactcg

SEQ ID NO: 324751 - DNA, 757 bp, Homo sapiens
  misc_feature: GZ8MTXP01ASUGJ.38.55.E11.1.454.CMB.2.raw
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgcttaattttaaaaggtgtccagtgtgaggtgcagctgggtggagtcggtgggggaggtcgttgggaaagccggtcgggggtcccttagactctcctgtacacgcctcgtggtacttctacttttagtatcgccgtggatcggtaccgtgggtcccgccgaggccgtaccgaaggggaaacggggcgtagggtaaggttcgggggttcgtaacccggtttaaagttaaaaaggttacggaaaacgttaggaggttgggggtaacgggaaacgtaaacgaacggtaaccgtaacccggtacgttcggacccgtaaaccccggggtaaaggtaaaaccgggctaaacgggtactttacccaaacctaacttaccgtaacgaaaggtaagtaagttaacgtaacttacgaaaaccgaaactaccttacttacctttaacaacggtaaattagaacgtaccgaacgtaccgtaaacgaaaacccggaacgaaccaacgacggtacgtacgttaacttacttacggtaaacacgggaaaggtaacaggttcttaggttaatagtaagtagtagttaggtaacgttgttaacg

SEQ ID NO: 324752 - DNA, 670 bp, Homo sapiens
  misc_feature: GZ8MTXP01BARTH.38.55.E11.1.454.CMB.2.raw
  modified_base (610)..(610): a, c, t, g, unknown or other
  misc_feature (610)..(610): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggtattttccttgctgcttaattttaaaaggtgtccagtgtgaggtgcagctggtggagtcgtgggggagtcgtagggaaagccgtgggggtccttagactctctgtacagcctgtggtacttctacttttagtatcgccgtggatcgaccgtgggtcccgcacggctaccggaagggaaaggggcgtaggaagtgggttacggaccgttaagtaaagtgaaacgtgagtcggtagggaacaacgagactaacgctgaccaacccggtagaaacggcaagtacttacaccgtatacacaaagacgtatacggtaattacaaacgtaaccacgtcttacttaacgaactaaagttcgaactacaacgtacccgtaaacgaaaaccggacgaaccgacgtaacggtcccgttaagtaacgttaaccttagggtaaacccaagggtaaagggtaaanacggttacttaagtttaagttagtaaggtaagttaggttaacggttgtttaacgttaacg

SEQ ID NO: 324753 - DNA, 648 bp, Homo sapiens
  misc_feature: GZ8MTXP01B0FNA.38.55.E11.1.454.CMB.2.raw
  modified_base (285)..(285): a, c, t, g, unknown or other
  misc_feature (285)..(285): n is a, c, g, or t
  modified_base (325)..(325): a, c, t, g, unknown or other
  misc_feature (325)..(325): n is a, c, g, or t
  modified_base (422)..(422): a, c, t, g, unknown or other
  misc_feature (422)..(422): n is a, c, g, or t
  modified_base (618)..(618): a, c, t, g, unknown or other
  misc_feature (618)..(618): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgcttaatttaaaaggtgtccagtgtgaggtgcagcgtgggtggagtcggtgggggaggtcgttaggggaaagtccggtcggggggttcccttagacttctcctgtacacgtcctntggattctacttttagtatgcctgatgaccgtcgggtccncgaggctacgagggaagggctggagtgggtgtacgtaattaaagtgaaactgagtcggtaggacaacgagactaacgctcgccacccggtagaacgnagacttcacatactacaaagtacgatacgattaccgaaacgtactacgtactttacctttaactaactaaacgttcgaacttaccaacggtacctaaacggaaaaccgacgactaaccgtagcccgttagtaaaccttacgttacgtaaaccgttacggaaaggggtaacgaggttcttaaagtttaattaaggtntaaggtaggttaggttgttaacgttaacgg

SEQ ID NO: 324754 - DNA, 665 bp, Homo sapiens
  misc_feature: GZ8MTXP01AWBDM.38.55.E11.1.454.CMB.2.raw
  modified_base (476)..(476): a, c, t, g, unknown or other
  misc_feature (476)..(476): n is a, c, g, or t
  modified_base (483)..(483): a, c, t, g, unknown or other
  misc_feature (483)..(483): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctatttaaaggtgtccagtgtgaggtgcagcgtggtggagtcgtgggggagcgttgggaagccgtgggggtcccttagactctctgtacagcctctggtattctacttttagtatgccgtggatgaccgtcgggtccgccgacggcgtaccgaagggggaaacggggtcgtaggaaggttgggggttacggtaccgttaaagtaaaaggtacgtaaaacgtggtaagtgggtacgggaacaacgtacggactaaacgctcgaccgaacccgtaggaaacgcaagtacttaccgacctatacctanaaagganatagtaacttacgaaacgtaaccactacttactttaacaaacctaaattgatacgaacgaccgtaacgaaaccgaacggacaacgacgtaccgtcgtaacgttaacgttacgtacgaacgaacgggtaaggacgttacttaaggttaattagtaagtagtagttagttaagttaagttaacg

SEQ ID NO: 324755 - DNA, 592 bp, Homo sapiens
  misc_feature: GZ8MTXP01D21HR.38.55.E11.1.454.CMB.2.raw
  modified_base (303)..(303): a, c, t, g, unknown or other
  misc_feature (303)..(303): n is a, c, g, or t
  modified_base (413)..(413): a, c, t, g, unknown or other
  misc_feature (413)..(413): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgcttatttaaaggtgtccagtgtgaggtgcagcgtggtggagtcgtgggggagcgttagggaagccgtgggggtcccttagactctcctgtacagcctctggattcacttttagtatgcctgatgactggtcncagctcgaggaagggctggagtgggtcgacgtaagttaaagtgaaactgagtcgggtaggacaacgagactaacgctgcacccgtagaaggcagattcacatcacgaagnatagactacaaacgacactcttacttacaaactaaatgaaacttccgaagtacccgaaggaaaacccgaggaacctacgaacgtcccgttaaggttaaactttcgacgtaaacccgaggaacggggaacttagcggttaaatttaatagtaagattggttaagtttcggttaacttaag

SEQ ID NO: 324756 - DNA, 677 bp, Homo sapiens
  misc_feature: GZ8MTXP01B1N2F.38.55.E11.1.454.CMB.2.raw
  modified_base (321)..(321): a, c, t, g, unknown or other
  misc_feature (321)..(321): n is a, c, g, or t
  modified_base (325)..(325): a, c, t, g, unknown or other
  misc_feature (325)..(325): n is a, c, g, or t
  modified_base (451)..(451): a, c, t, g, unknown or other
  misc_feature (451)..(451): n is a, c, g, or t
  modified_base (553)..(553): a, c, t, g, unknown or other
  misc_feature (553)..(553): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgcttattttaaaaggtgtccagtgtgaggtgcagcgtggtggagtcggtgggggaggtcgttggggaaagccggtggggggtcccttagactctcctgtacacgtcctctggtattctacttttagtatgcctggactgaccgtgggtccnccgnggctccgaaggggaacggggctaggaagtggggtacggaccgttaattaaaaggtagaacgtggaggtcgggtacggaacgaacgacgacctaacgcgtcgacccgtaacccgggtaaggaacggntaacggtactacccactatcgaacaaggtagagtagtaacttaacgaaaccggtaactaacgttcctttaacttaaccaaagtaattacgactacccgtaanacccgtaaaacggaaccgaacggtaccaacggtcgtaccttaggttaaaccttcgacgtaacccgaaggaaacggtagacgttagttagttaatagtgtaacgtagttgtaagtttcgttaacg

SEQ ID NO: 324757 - DNA, 708 bp, Homo sapiens
  misc_feature: GZ8MTXP01C54PB.38.55.E11.1.454.CMB.2.raw
  modified_base (270)..(270): a, c, t, g, unknown or other
  misc_feature (270)..(270): n is a, c, g, or t
  modified_base (311)..(311): a, c, t, g, unknown or other
  misc_feature (311)..(311): n is a, c, g, or t
  modified_base (662)..(662): a, c, t, g, unknown or other
  misc_feature (662)..(662): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggtattttcctgctgcttaatttaaaaggtgtccagtgtgaggtgcagcgtggtggagtcgtgggggagcgttgggaagtccgtgggggtccttagactctcctgtacagcctntggattctacttttagtatgctggatcggacctcgggtccnccgtaggccgtaccgagggaaagggggtctagggagtgggttacggtaccgttaaagttaaaacgtgtaaaacgtggaagttcggggtacgggaacaagtacgaacctaaaccggctccggtaccgtaaaccccgggtaggaaaacgggcctaaagggtacttacccaccgtaactcctaacgaagaggtaataggtaacttaccgaaacggtaacacgtacctttactttaccctaaataaagttccgaattacgaaccgtaaccgaacggaaaaccccgtagggacctaaccgtagtacccgtagttaacttacgttacggtaaccaaacgtacggggaattaccgttnttaaagttaacgtatggtaagtacggttagtaagggtttctaaccg

SEQ ID NO: 324758 - DNA, 428 bp, Homo sapiens
  misc_feature: GZ8MTXP02IL9GM.38.55.E11.1.454.CMB.2.raw
  modified_base (179)..(179): a, c, t, g, unknown or other
  misc_feature (179)..(179): n is a, c, g, or t
  modified_base (213)..(213): a, c, t, g, unknown or other
  misc_feature (213)..(213): n is a, c, g, or t
  modified_base (425)..(428): a, c, t, g, unknown or other
  misc_feature (425)..(428): n is a, c, g, or t
tcagtcgatcacgtcacgaccggtgctcgatttagcactcgcacgttgggttggccgtattaaagtgaaactgatggtgggacaacagactacgctgcacccgtgaaaggcagattcaccatctcaagagatgattcaacgaacacgctctttctacaaatgatcagcctgaaaaccgnggacacagccgtgtattactgtaccacagggaanagcagttattatgatagtagtggttatctgtactactacggtatggacgtctggggccaagggaccacggtcattgtctccccagcctccaccaagggcccatcggtctcccctggcaccctcctccaagagcacctctggggcacagcgccctgggctgcctggtcagctactccacgtgatcgactgagcgggctggcaaggcgcatagnnnn

SEQ ID NO: 324759 - DNA, 436 bp, Homo sapiens
  misc_feature: GZ8MTXP02GMZ9B.38.55.E11.1.454.CMB.2.raw
  modified_base (433)..(436): a, c, t, g, unknown or other
  misc_feature (433)..(436): n is a, c, g, or t
tcagtcgatcacgtcacgaccggtgctcgatttagcactcgcacgttgggttggccgtattaaagtgaaactgatggtgggacaacagactacgctgcacccgtgaaaggcagattcaccatctcaagagatgattcaacgaacacgctctttctacaaatgatcagcctgaaaaccgaggacacagccgtgtattactgtaccacagggaagagcagttattatgatagtagtggttatctgtactactacggtatggacgtctggggccaagggaccacggtcattgtctccccagcctccaccaagggcccatcggtctcccctggcaccctcctccaagagcacctctcgggggcacagcggccctgggctgcctggtcaaggactacttccacgtgatcgactgagcgggctgggcaaggcgcatagnnnn

SEQ ID NO: 324760 - DNA, 548 bp, Homo sapiens
  misc_feature: GZ8MTXP02FXWIX.38.55.E11.1.454.CMB.2.raw
  modified_base (307)..(307): a, c, t, g, unknown or other
  misc_feature (307)..(307): n is a, c, g, or t
  modified_base (322)..(322): a, c, t, g, unknown or other
  misc_feature (322)..(322): n is a, c, g, or t
  modified_base (343)..(343): a, c, t, g, unknown or other
  misc_feature (343)..(343): n is a, c, g, or t
  modified_base (475)..(475): a, c, t, g, unknown or other
  misc_feature (475)..(475): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtcgtgggggaggcttgggaaagccgtggggggtcccttagactctcctgtacagcctctggattcacttttagtatgcctggatgacctggtccncagctcaggaaggcnggatgggtgcgtattaaaagngaaatgatggtgggacaacagactacgctgcacccgtagaaagcagattcaccatcctacaagagatgattacaaacgaacacgcttactttactaaacaaattgaattaccaagtacccctagaaaaccgnggaacacgagcccgtagtactactagtaccagaagggaacagcagttaatatagtatagtacgtaggttatag

SEQ ID NO: 324761 - DNA, 431 bp, Homo sapiens
  misc_feature: GZ8MTXP02IYPQ4.38.55.E11.1.454.CMB.2.raw
  modified_base (213)..(213): a, c, t, g, unknown or other
  misc_feature (213)..(213): n is a, c, g, or t
  modified_base (429)..(431): a, c, t, g, unknown or other
  misc_feature (429)..(431): n is a, c, g, or t
tcagtcgatcacgtcacgaccggtgctcgatttagcactcgcacgttgggttggccgtattaaagtgaaactgatggtgggacaacagactacgctgcacccgtgaaaggcagattcaccatctcaagagatgattcaacgaacacgctctttctacaaatgatcagcctgaaaaccgaggacacagccgtgtattactgtaccacagggaanagcagttattatgatagtagtggttatctgtactactacggtatggacgtctggggccaagggaccacggtcattgtctccccagcctccaccaagggcccatcggtcttcccctggcaccctcctccaagagcacctctggggcacagcggccctgggctgcctggtcaggctacttccacgtgatcgactgagcgggctggcaaggcgcatagnnn

SEQ ID NO: 324762 - DNA, 526 bp, Homo sapiens
  misc_feature: GZ8MTXP02I4Q6L.38.55.E11.1.454.CMB.2.raw
  modified_base (298)..(298): a, c, t, g, unknown or other
  misc_feature (298)..(298): n is a, c, g, or t
  modified_base (309)..(309): a, c, t, g, unknown or other
  misc_feature (309)..(309): n is a, c, g, or t
  modified_base (379)..(379): a, c, t, g, unknown or other
  misc_feature (379)..(379): n is a, c, g, or t
  modified_base (392)..(392): a, c, t, g, unknown or other
  misc_feature (392)..(392): n is a, c, g, or t
  modified_base (431)..(431): a, c, t, g, unknown or other
  misc_feature (431)..(431): n is a, c, g, or t
  modified_base (500)..(500): a, c, t, g, unknown or other
  misc_feature (500)..(500): n is a, c, g, or t
  modified_base (515)..(515): a, c, t, g, unknown or other
  misc_feature (515)..(515): n is a, c, g, or t
tcagtcgatcacgtcacgaccggtgctcgatttagcactcgcacgttgggtttggggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaggcagctccaacattggagattaattttgtctcctggtaccagcagctcccaggaacagcccccaaatcctcatttatgacccataataggcgacccctnagggattcccngaccgattctctggctccaagtctggcacgtcagccaccctggccatccaccggcctcagactggggacnggccgattatacngacggaacatgggataccgagactgaaatgcttggggtnctcgggtggacgggcagggctggacccgtcgtaggtcaagcccgaaaggctacgccccctggcacttcncgttccccacctccncacgtgactcg

SEQ ID NO: 324763 - DNA, 530 bp, Homo sapiens
  misc_feature: GZ8MTXP02JX7GQ.38.55.E11.1.454.CMB.2.raw
  modified_base (369)..(369): a, c, t, g, unknown or other
  misc_feature (369)..(369): n is a, c, g, or t
  modified_base (461)..(461): a, c, t, g, unknown or other
  misc_feature (461)..(461): n is a, c, g, or t
  modified_base (482)..(482): a, c, t, g, unknown or other
  misc_feature (482)..(482): n is a, c, g, or t
  modified_base (511)..(511): a, c, t, g, unknown or other
  misc_feature (511)..(511): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtcgtgggggaggcttgggaaagccgtggggggtcccttagactctcctgtacagcctctggattcactttagttatgcctggatgacctgggtccgccaggctccgaggaagggctggagtgggtgcgtataaagtgaaactgatggtagggacaanagactacgctgcaccgtgaaagcagatcaccatcacaagagatgattacaacgaacacgctctttacacaaatgatcagcctagaaaaccgngacacagccgtagtacttacngtacccagagggaacagctagttaatagngatagtagtacgttatacg

SEQ ID NO: 324764 - DNA, 543 bp, Homo sapiens
  misc_feature: GZ8MTXP02GV75P.38.55.E11.1.454.CMB.2.raw
  modified_base (464)..(464): a, c, t, g, unknown or other
  misc_feature (464)..(464): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctatttaaaaggtgtccagtgtgaggtgcagctggtggagtctgggggaggcttgggaaagccgtgggggtcccttagactctcctgtacagcctctggattcacttttagtatgcctggatgacctggtccgccaggctccgaggaaagggctggaatgggtgcgtataaagtgaaactgatggtagggacaacgagactacgctgcaccgtgaaagcagatcaccatctacaagagatgattacaaacgaacacgcttactttacaacaaatgatcagcctagaaaaccgngaacacagccgtagtactacgtgtaacccagaacgggaacgagacaagttaatataggatagttagtacggtttaatcg

SEQ ID NO: 324765 - DNA, 518 bp, Homo sapiens
  misc_feature: GZ8MTXP02HVWB7.38.55.E11.1.454.CMB.2.raw
  modified_base (273)..(273): a, c, t, g, unknown or other
  misc_feature (273)..(273): n is a, c, g, or t
  modified_base (425)..(425): a, c, t, g, unknown or other
  misc_feature (425)..(425): n is a, c, g, or t
  modified_base (434)..(434): a, c, t, g, unknown or other
  misc_feature (434)..(434): n is a, c, g, or t
tcagtcgatcacgtcacgaccggtgctcgatttagcactcgcacgttgggtttgggacaatcttcatcatgacctgctccctctcctcctcacccttctcattcactgcacagggtcctgggcccagtctgtgttgacgcagccgccctcagtgtctgcggccccaggacagaaggtcaccatctcctgctctggagcagctccaacattggagattaattttgtctcctggtaccagcagctcccaggaacagccccaaactcctcatttangaccataataggcgaccctcaggattcctgaccgattctctggctcaagtctggcacgtcacgccacctggcatccaccggcctccagacgtggggacaggccgagttatactggcggaacagtgggataccgagactgaatgctttgggtncgttcgggnggagggaccaggctgaccgtcgtagtcacgcccaaggcctgcccctcggtcacgtctcgttccccgccttccactcgtgactcg

SEQ ID NO: 324766 - DNA, 617 bp, Homo sapiens
  misc_feature: GZ8MTXP02IPNLP.38.55.E11.1.454.CMB.2.raw
  modified_base (403)..(403): a, c, t, g, unknown or other
  misc_feature (403)..(403): n is a, c, g, or t
  modified_base (407)..(407): a, c, t, g, unknown or other
  misc_feature (407)..(407): n is a, c, g, or t
  modified_base (426)..(426): a, c, t, g, unknown or other
  misc_feature (426)..(426): n is a, c, g, or t
  modified_base (479)..(479): a, c, t, g, unknown or other
  misc_feature (479)..(479): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggatttcctgctgctattttaaaggtgtccagtgtgaggtgcagctggtggagtctgggggaggcgttgggaagccgtgggggtcccttagactctcctgtacagcctctggattcacttttagttatgcctggatgacctgggtccgccaggctccgaggaaagggctggaagtgggttgcgtataaagtgaactgatggtggacaacagactacgctgcacccgtagaaagcagatcacatctanaagngatgacttacaaacgaacncgtacttactttacaaactaaatgaattcaacgacccttaaggaaaaacccgnggaaacccacgtaaacggtcccgttaggttaaacttacccgttagtaaaccccaacggaaacgggggaaagacgtacgttaaaggtttaacttaagtaggtaaagttaacggtttagttacgggtttaaaatttccgg

SEQ ID NO: 324767 - DNA, 561 bp, Homo sapiens
  misc_feature: GZ8MTXP02GUUPL.38.55.E11.1.454.CMB.2.raw
  modified_base (275)..(275): a, c, t, g, unknown or other
  misc_feature (275)..(275): n is a, c, g, or t
  modified_base (296)..(296): a, c, t, g, unknown or other
  misc_feature (296)..(296): n is a, c, g, or t
  modified_base (375)..(375): a, c, t, g, unknown or other
  misc_feature (375)..(375): n is a, c, g, or t
tcagtcgatcacgtcacgaccggtgctcgatttagcactcgcacgttgggtttgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaggcagctccaacattggagataattttgtctcctggtaccagcagctcccaggaacagcccccaaactcctcatttangaccataataggcgacccctnagggattcctgaccgattctctggctccaagtctggcaccgtcagccaccctggcatccaccgctccagactggggacnggccgattatactgacggaacagtgggataccgagactgaaatgcgtttggggtgcgttcggggtggacggggaccagggctaggacccgttccgtaagggtcacgcccgaaaggtcctacgcccccgtcggtaccaccgttccgttccgttcccccgccccttccgtccgaccgttcgactccgg

SEQ ID NO: 324768 - DNA, 530 bp, Homo sapiens
  misc_feature: GZ8MTXP02GO6I1.38.55.E11.1.454.CMB.2.raw
  modified_base (294)..(294): a, c, t, g, unknown or other
  misc_feature (294)..(294): n is a, c, g, or t
  modified_base (382)..(382): a, c, t, g, unknown or other
  misc_feature (382)..(382): n is a, c, g, or t
  modified_base (389)..(389): a, c, t, g, unknown or other
  misc_feature (389)..(389): n is a, c, g, or t
  modified_base (392)..(392): a, c, t, g, unknown or other
  misc_feature (392)..(392): n is a, c, g, or t
  modified_base (396)..(396): a, c, t, g, unknown or other
  misc_feature (396)..(396): n is a, c, g, or t
  modified_base (404)..(404): a, c, t, g, unknown or other
  misc_feature (404)..(404): n is a, c, g, or t
  modified_base (417)..(417): a, c, t, g, unknown or other
  misc_feature (417)..(417): n is a, c, g, or t
tcagtcgatcacgtcacgaccggtgctcgatttagcactcgcacgttgggtttgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaggcagctccaacattggagataattttgtctcctggtaccagcagctcccaggaacagcccccaaatcctcatttatgaccataataggcgaccctnaggattcctgaccgattctctggctccaaagtctggcaccgtcagccacctggcatcaccgctcagctggggacaggccattatacgngacgaanagngganacgagacngaatgcgttgggncgtgggaggacggacgaggtctacggacccgtcgtaggcacgacccgaaggcctccggcccccgtcggtaccacctccgtccgttacccccaccctcctacgacgtcgactcg

SEQ ID NO: 324769 - DNA, 547 bp, Homo sapiens
  misc_feature: GZ8MTXP02JD5ZC.38.55.E11.1.454.CMB.2.raw
  modified_base (351)..(351): a, c, t, g, unknown or other
  misc_feature (351)..(351): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttgggaaagccgtgggggtcccttagactctcctgtacagcctctggattcacttttagtatgcctggatgacctggtccgccaggctccgaggaaggggctggaatgggttggccgtattaaaagngaaactgatggtggacaacagactacgctgcaccgtgaaagcagattcaccatctacaagagatgattacaacgaacacgcttactttactaacaaattgattcagaccctagaaaacccgaggacacagccgtagtacttacgtgtaacccagagggaacgagcaagttaatagtagatagtacgtggttatacg

SEQ ID NO: 324770 - DNA, 437 bp, Homo sapiens
  misc_feature: GZ8MTXP02HVQFK.38.55.E11.1.454.CMB.2.raw
  modified_base (214)..(214): a, c, t, g, unknown or other
  misc_feature (214)..(214): n is a, c, g, or t
  modified_base (433)..(437): a, c, t, g, unknown or other
  misc_feature (433)..(437): n is a, c, g, or t
tcagtcgatcacgtcacgaccggtgctcgatttagcactcgcacgttgggttggccgtattaaaagtgaaactgatggtgggacaacagactacgctgcacccgtgaaaggcagattcaccatctcaagagatgattcaacgaacacgctctttctacaaatgatcagcctgaaaaccgaggacacagccgtgtattactgtaccacagggaanagcagttatatgatagtagtggttatctgtactactacggtatggacgtctggggccaagggaccacggtcattgtctccccagcctccaccaagggcccatcggtcttcccctggccaccctcctccaagagccacctctcggggcacagcggcctgggctgcctggtcaaggactacttccacgtgatcgactgagcgggctggcaaggcgcatagnnnnn

SEQ ID NO: 324771 - DNA, 585 bp, Homo sapiens
  misc_feature: GZ8MTXP02IMJ0Y.38.55.E11.1.454.CMB.2.raw
  modified_base (217)..(217): a, c, t, g, unknown or other
  misc_feature (217)..(217): n is a, c, g, or t
  modified_base (278)..(278): a, c, t, g, unknown or other
  misc_feature (278)..(278): n is a, c, g, or t
tcagtcgatcacgtcacgaccggtgctcgatttagcactcgcacgttgggtttggggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaggcagctccaacattgganattaattttgtctcctggtaccagcagctcccaggaacacgcccccaaactcctcatttangaccaataataggcaccctcgaggacttcctgaccgtattctctggctcaagtctggcacgtcacgccacctggcatccgaccgcctccagaccgtgggggacgacgggccgtaatttacgttaacgtggacggaaacagttaggggaactaacccgaagacttagaaatgtcgttggggtgcgtcggggtagggacgggaccgaggcgtcggaccgtccgtaggtaccgacgaccccgaaaggccctcgcccccgttcggtcccacgttcctccgttccccgccctccctctaccgttcgactccg

SEQ ID NO: 324772 - DNA, 535 bp, Homo sapiens
  misc_feature: GZ8MTXP02FZ1I5.38.55.E11.1.454.CMB.2.raw
  modified_base (346)..(346): a, c, t, g, unknown or other
  misc_feature (346)..(346): n is a, c, g, or t
  modified_base (400)..(400): a, c, t, g, unknown or other
  misc_feature (400)..(400): n is a, c, g, or t
  modified_base (502)..(502): a, c, t, g, unknown or other
  misc_feature (502)..(502): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttgggaaagcctggggggtcccttagactctcctgtacagcctctggattcacttttagttatgcctggatgacctggtccgcagctccaggaaagggctggaatggtggcgtattaaaagngaaactgatggtggacaacagactacgctgcaccgtgaaagcagatcaccatcncaagagatgattcaaacgaacacgcttactttactaacaaatgatcaagccctagaaaaccgaggaacacaagccgtagtacttactgtaccaacgaggaanagcagttaatatagatagtagtaggttactacg

SEQ ID NO: 324773 - DNA, 436 bp, Homo sapiens
  misc_feature: GZ8MTXP02GSI9U.38.55.E11.1.454.CMB.2.raw
  modified_base (214)..(214): a, c, t, g, unknown or other
  misc_feature (214)..(214): n is a, c, g, or t
  modified_base (344)..(344): a, c, t, g, unknown or other
  misc_feature (344)..(344): n is a, c, g, or t
  modified_base (429)..(436): a, c, t, g, unknown or other
  misc_feature (429)..(436): n is a, c, g, or t
tcagtcgatcacgtcacgaccggtgctcgatttagcactcgcacgttgggttggccgtattaaaagtgaaactgatggtgggacaacagactacgctgcacccgtgaaaggcagattcaccatctcaagagatgattcaacgaacacgctctttctacaaatgatcagcctgaaaaccgaggacacagccgtgtattactgtaccacagggaanagcagttattatgatagtagtggttatctgtactactacggtatggacgtctggggccaagggaccacggtcattgtctccccagcctccaccaagggcccatcggtctcccctggcaccctcctcaagngcacctctcggggcacagcggcctggctgcctggtcaaggcctacttccacgtgatcgactgagcgggctggcaaggcgcatagnnnnnnnn

SEQ ID NO: 324774 - DNA, 787 bp, Homo sapiens
  misc_feature: GZ8MTXP02FYSPH.38.55.E11.1.454.CMB.2.raw
  modified_base (207)..(207): a, c, t, g, unknown or other
  misc_feature (207)..(207): n is a, c, g, or t
tcagtcgatcacgtcacgaccggtgctcgatttagcactcgcacgttgggtttgggacaatcttcatcatgacctgctcccctctcctcctcacccttctcattcactgcacagggtcctgggcccagtctgtgttgacgcagccgccctcagtgtctgcggcccaggacagaagtcaccatctcctgctctggagcagctccaacnttggagtattaattttgtctctggtaccagcagctcccgaggaacacgcccccaaatcctacatttatgaccataagtacggccaccctgaggtacttccgtgaccgtattctctggcctaccaagtctggcaccgtcacgcccaccgtgggccactcccgaacccgggtcctaccgaacggtaccgtacggggggaaccgacggggtacccgtaaagttttaacgttaccgtaggaacccgggtaaaactacggtacgggggtaaacttaaccccgaaggtaaaccgtagggtaaaaccgttggaccggttttgggggtacgtcccggtttagggggacgggaaccggggaaacccgttggggacccgtttaaccgggtaaccccggttacccgggttaacggggtacccgtaaaaccggggtacccccgaaaacggggtccccgtttaaccccggggtaccccccccgtttcgggggttaaacccctacccgttttaccccgggttcccgttttaccccccccggaacccctttccccgttacccgtaaacccggtttcgtacccgtttaaccccggg

SEQ ID NO: 324775 - DNA, 621 bp, Homo sapiens
  misc_feature: GZ8MTXP02GQ7SP.38.55.E11.1.454.CMB.2.raw
  modified_base (373)..(373): a, c, t, g, unknown or other
  misc_feature (373)..(373): n is a, c, g, or t
  modified_base (479)..(479): a, c, t, g, unknown or other
  misc_feature (479)..(479): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtcgtgggggaggcgttgggaaagccgtgggggtcccttagactctcctgtacagcctctggattcacttttagttatgcctggatgacctgggtccgccaggctccgaggaagggctggaagtgggtgcgtattaaaagtgaaactgagtggtaggacaanagactacgctgcaccgtagaagcagatcaccatcacaagagatgactacaaacgacacgcttactttacaaacaaatgactacaacgaccctaagaaaaacccggnggaaacccacgtaacgtacccgttagttaaactttacctacggtaaaccccaaacggaaacggggtaaacgaacggtaccgttaaaaggtttaatttaaagtacgtaaagttaacggttaaggtttacggtttaatttaccg

SEQ ID NO: 324776 - DNA, 529 bp, Homo sapiens
  misc_feature: GZ8MTXP02JGME3.38.55.E11.1.454.CMB.2.raw
  modified_base (301)..(301): a, c, t, g, unknown or other
  misc_feature (301)..(301): n is a, c, g, or t
  modified_base (459)..(459): a, c, t, g, unknown or other
  misc_feature (459)..(459): n is a, c, g, or t
tcagtcgatcacgtcacgaccggtgctcgatttagcactcgcacgttgggtttggggagatctgggagaggagcccagccttgggattcccaagtgtttcattcagtgatcaggactgaacacagaggactcaccatggagtttgggctgagctggattttccttgctgctattttaaaaggtgtccagtgtgaggtgcagctggtggagtctgggggagcttgggaaagcctgggggtcccttagactctcctgtacagcctctggattcactttagtatgcctggatgacctgggtccncaggctccaggaaagggctggaatgggttgccgtattaaaagtgaaactgatggtggacaacagactacgctgcacccgtgaaaaggcagattcaccatctcaagagatgattcaacgaacacgctctttcacaaatgatcagccctagaaaacccgnggaacacagccgtagtaacttactgtaccacagggaagagcaagttaatatgatagtagtcggtaattcg

SEQ ID NO: 324777 - DNA, 562 bp, Homo sapiens
  misc_feature: GZ8MTXP02I74EA.38.55.E11.1.454.CMB.2.raw
  modified_base (393)..(393): a, c, t, g, unknown or other
  misc_feature (393)..(393): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttcctgctgctatttaaaaggtgtccagtgtgaggtgcagctggtggagtcgtgggggaggcttgggaaagccgtgggggtcccttagactctcctgtacagcctctggattcacttttagttatgcctggatgacctgggtccgcaggctccgaggaaagggctggaatgggtgccgtattaaagtgaaactgatggtaggacaacagactacgctgcacccgtgaaacgnagatcaccatcacaagagatagaattacaaacgaaacaccgtcttactttacaacaaattgatccaagaccctagaaaaaccccgaggaccagacgtccgtagttaacttactacgtaacccaagacgggaagaagcaagttaatatagaatagtagtacggttaatcg

SEQ ID NO: 324778 - DNA, 517 bp, Homo sapiens
  misc_feature: GZ8MTXP02JCH6O.38.55.E11.1.454.CMB.2.raw
  modified_base (342)..(342): a, c, t, g, unknown or other
  misc_feature (342)..(342): n is a, c, g, or t
  modified_base (452)..(452): a, c, t, g, unknown or other
  misc_feature (452)..(452): n is a, c, g, or t
  modified_base (473)..(473): a, c, t, g, unknown or other
  misc_feature (473)..(473): n is a, c, g, or t
  modified_base (480)..(480): a, c, t, g, unknown or other
  misc_feature (480)..(480): n is a, c, g, or t
  modified_base (486)..(486): a, c, t, g, unknown or other
  misc_feature (486)..(486): n is a, c, g, or t
tcagtcgatcacgtcacgaccggtgctcgatttagcactcgcacgttgggtttgggagatctgggagaggagcccagccttgggattcccaagtgtttcattcagtgatcaggactgaacacagaggactcaccatggagtttgggctgagctggatttccttgctgctatttaaaggtgtccagtgtgaggtgcagctggtggagtctgggggaggcttgggaaagccgtgggggtcccttagactctcctgtacagcctctggattcactttagttatgcctggatgacctggtccgccaggctccaggaaagggctggaatgggtggccgtattaaagngaaactgatggtggacacagactacgctgcacccgtgaaagcagatcaccatctcaagagatgattcaaacgaacacgctcttctacaaatgatcagcctagaaaaccgngaacacagccgtagtactacngtaccanaggganagcagttaatagtgatagtagtcggttatcg

SEQ ID NO: 324779 - DNA, 698 bp, Homo sapiens
  misc_feature: GZ8MTXP02FO1X0.38.55.E11.1.454.CMB.2.raw
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctatttaaaaggtgtccagtgtgaggtgcagctggtggagtcgtgggggaggcgttgggaagccgtgggggtcccttagactctcctgtacagcctctggtattctacttttagtatgcctggatcgaccgtcgggtccgccgaggccgtacccggaaggggaaacggggtcgtagggtaaaggttggggtttacgggtacccggttaaagtttaaaaaggtacggtaaaacgtggtaagtggggtacggggaaaccaaacgacggaaccgtaaccggcttcggacccgaaccccggtaaggaaaacgggcaaacgtacttaccaaacctataccctagaaagtagaatacgacttaacaaacgtaaccaccgtctttactttaccaaataaatgactacgaacgtaccgtaacggaaaaccgaggaaccaacgagtaccgttagtaaacttacgagtaacccgaaggaagggaacgacgactaaagttaagtacgtagtaacgttagtagttacggttactttacg

SEQ ID NO: 324780 - DNA, 570 bp, Homo sapiens
  misc_feature: GZ8MTXP02FTLZ3.38.55.E11.1.454.CMB.2.raw
  modified_base (307)..(307): a, c, t, g, unknown or other
  misc_feature (307)..(307): n is a, c, g, or t
  modified_base (348)..(348): a, c, t, g, unknown or other
  misc_feature (348)..(348): n is a, c, g, or t
  modified_base (351)..(351): a, c, t, g, unknown or other
  misc_feature (351)..(351): n is a, c, g, or t
  modified_base (356)..(356): a, c, t, g, unknown or other
  misc_feature (356)..(356): n is a, c, g, or t
  modified_base (461)..(461): a, c, t, g, unknown or other
  misc_feature (461)..(461): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttgggaaagccgtggggggtcccttaggactctcctgtacagcctctggattcacttttagtatgcctggatgacctggtccnccaggctccaggaagggctggaatgggtgccgtattaaagnganagagngtggacgaacagacacgctcgcaccgtacgaagacgagagtctaccatctcaagagatagagttacaacgaacaacgctactttactaactaaatagtatactanacccgtagaaaccgaaacggacaacagaccgtagtacgttactatacccgaacaacgggaagaagcgtaagttaagttaatagtatagttaagtacggtttagtttacg

SEQ ID NO: 324781 - DNA, 575 bp, Homo sapiens
  misc_feature: GZ8MTXP02F8GN4.38.55.E11.1.454.CMB.2.raw
  modified_base (376)..(376): a, c, t, g, unknown or other
  misc_feature (376)..(376): n is a, c, g, or t
  modified_base (409)..(409): a, c, t, g, unknown or other
  misc_feature (409)..(409): n is a, c, g, or t
  modified_base (418)..(418): a, c, t, g, unknown or other
  misc_feature (418)..(418): n is a, c, g, or t
  modified_base (454)..(454): a, c, t, g, unknown or other
  misc_feature (454)..(454): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagcgtggagtttcctagctgctatttaaaggtgtcagtgtgaggtgcagctggtggagtcgtgggggaggcgttgggaaagccgtggggggtcccttagactctcctgtacagcctctggattctactttagttatgcctggatgacctgggtccgccaggctccgaggaaaggggctggaatgggtggaccgtaagttaaagtgaaactgagtggtggacaanagactacgctgcaccgtgaaagcagactcaccntctcaaganatagactacaaacacactcttacttactaacaagtnactacgacgaccgtaacggaaacgacgacaacgacgtacgttagtaacttacgacgtaaccgaaggaacggaagacgtagttaagttaagtagtacgtagttaggttagttacgttatacg

SEQ ID NO: 324782 - DNA, 560 bp, Homo sapiens
  misc_feature: GZ8MTXP02JFKRT.38.55.E11.1.454.CMB.2.raw
  modified_base (352)..(352): a, c, t, g, unknown or other
  misc_feature (352)..(352): n is a, c, g, or t
  modified_base (373)..(373): a, c, t, g, unknown or other
  misc_feature (373)..(373): n is a, c, g, or t
  modified_base (415)..(415): a, c, t, g, unknown or other
  misc_feature (415)..(415): n is a, c, g, or t
  modified_base (472)..(472): a, c, t, g, unknown or other
  misc_feature (472)..(472): n is a, c, g, or t
  modified_base (489)..(489): a, c, t, g, unknown or other
  misc_feature (489)..(489): n is a, c, g, or t
  modified_base (536)..(536): a, c, t, g, unknown or other
  misc_feature (536)..(536): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttcctgctgctattttaaaaggtgtccagtgtgaggtgcagctggtggagtctgggggaggcttgggaaagccgtgggggtcccttagactctcctgtacagcctctggattcactttagttatgcctggatgacctgggtccgccaggcctccgaggaaaggggctggaatgggtggccgtattaaaagngaaactgatggtagggacaanagactacgctgcaccgtgaaagcagattcacatactcaaagngatgattacaaacgtacacgctacttacaacaaatgaatcaagtcccagaaaaccgnggaacactacgaccgtntaacgtactaggtaacccaagacgggaacgaacgagagttaaagttntaagtagtagtagtagttactacg

SEQ ID NO: 324783 - DNA, 463 bp, Homo sapiens
  misc_feature: GZ8MTXP02FHEG9.38.55.E11.1.454.CMB.2.raw
  modified_base (183)..(183): a, c, t, g, unknown or other
  misc_feature (183)..(183): n is a, c, g, or t
  modified_base (218)..(218): a, c, t, g, unknown or other
  misc_feature (218)..(218): n is a, c, g, or t
  modified_base (440)..(463): a, c, t, g, unknown or other
  misc_feature (440)..(463): n is a, c, g, or t
tcagtcgatcacgtcacgaccggtgctcgatttagcactcgcacgttgggttggccgtattaaaagtgaaactgatggtgggacaacagactacgctgcacccgtgaaaggcagattcaccatctcaagagatgattcaacgaacacgtctcttttctacaaattgatcagcctgaaaaccgnggacacagccgtgtattactggtaccacagggaanagcagttattatgatagtagtggttatctgtactactacggtatggacgtctggggccaagggaccacggtcattgtctccccagcctccaccagggcccatcggtcttccccctggcaccctcctcctaagagcacctctcgggggcacagccggccctggctgccctggtcaaggctacttccacgtgatcgactgagcgggctggcaaggcgacatagnnnnnnnnnnnnnnnnnnnnnnnn

SEQ ID NO: 324784 - DNA, 647 bp, Homo sapiens
  misc_feature: GZ8MTXP02IH0XW.38.55.E11.1.454.CMB.2.raw
  modified_base (283)..(283): a, c, t, g, unknown or other
  misc_feature (283)..(283): n is a, c, g, or t
tcagtcgatcacgtcacgaccggtgctcgatttagcactcgcacgttgggtttggggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggagcagctccaacattggagtattaattttgtctcctggtaccagcagcctcccgaggaacacgacccccaaactcctctatttacncgaacccataactacggccgacccctgaagggtacttccctagaccgtatttcctcgtcggtcctccaaagtctggccaccgtcacgcccacccgtgggccactccgacccggcctaccgagaccgtgggggacacggaccgtattacttacgcggacggaaacagtggggaactacccgaagtactgaaagttggtacgtttggggtgtccggttcggggtagggaacggggacctagggccgtacggtacccgttaccgagggtccaacggacccgaaacggccttacccggcccccgttggtacccctacgttcccgtccgtttacccccacccttccgtaccgacgttcgacgtacccgg

SEQ ID NO: 324785 - DNA, 510 bp, Homo sapiens
  misc_feature: GZ8MTXP02JCA28.38.55.E11.1.454.CMB.2.raw
  modified_base (271)..(271): a, c, t, g, unknown or other
  misc_feature (271)..(271): n is a, c, g, or t
  modified_base (382)..(382): a, c, t, g, unknown or other
  misc_feature (382)..(382): n is a, c, g, or t
  modified_base (420)..(420): a, c, t, g, unknown or other
  misc_feature (420)..(420): n is a, c, g, or t
tcagtcgatcacgtcacgaccggtgctcgatttagcactcgcacgttgggtttgggacaatcttcatcatgacctgctccctctcctcctcacccttctcattcactgcacagggtcctgggcccagtctgtgttgacgcagccgccctcagtgtctgcggccccaggacagaaggtcaccatctcctgctctggaggcagctccaacattggagataattttgctcctggtaccagcagctcccaggaacagccccaaatcctcatttangaccataataggcgaccctcagggattcctgaccgattctctggctccaagtctggcacgtcagccacctggcatcaccgctccagactggggacaggcccgattactacngcggaacagtgggataccagactgaaatgcttggggtncgtcgggtggaggaccaggctggaccgtcaggtcagcccaaggcctagccccctgtcactctcgttccccgcctacctcaccgtgactcg

SEQ ID NO: 324786 - DNA, 438 bp, Homo sapiens
  misc_feature: GZ8MTXP02HHJ1B.38.55.E11.1.454.CMB.2.raw
  modified_base (214)..(214): a, c, t, g, unknown or other
  misc_feature (214)..(214): n is a, c, g, or t
  modified_base (327)..(327): a, c, t, g, unknown or other
  misc_feature (327)..(327): n is a, c, g, or t
  modified_base (431)..(438): a, c, t, g, unknown or other
  misc_feature (431)..(438): n is a, c, g, or t
tcagtcgatcacgtcacgaccggtgctcgatttagcactcgcacgttgggttggccgtattaaaagtgaaactgatggtgggacaacagactacgctgcacccgtgaaaggcagattcaccatctcaagagatgattcaacgaacacgctctttctacaaatgatcagcctgaaaaccgaggacacagccgtgtattactgtaccacagggaanagcagttatatgatagtagtggttatctgtactactacggtatggacgtcgtggggccaagggaccacggtcattgtcctccccagcctccaccaggtccatcggtctccccnggcaccctctccagcgcacctcgcggggcacagcggccctgggctgcctggtcaaggcctacttccacgtgatcgactggagcgggctggcaaggcgcagtagnnnnnnnn

SEQ ID NO: 324787 - DNA, 650 bp, Homo sapiens
  misc_feature: GZ8MTXP02G4UD7.38.55.E11.1.454.CMB.2.raw
  modified_base (406)..(406): a, c, t, g, unknown or other
  misc_feature (406)..(406): n is a, c, g, or t
  modified_base (409)..(409): a, c, t, g, unknown or other
  misc_feature (409)..(409): n is a, c, g, or t
  modified_base (415)..(415): a, c, t, g, unknown or other
  misc_feature (415)..(415): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggatttccttgctgctatttaaaggtgtccagtgtgaggtgcagctggtggagtcgtgggggaggcgttggggaaagccgtggggggtcccttagactctcctgtacagcctctggattcacttttagttatgcctggatgacctggtccgccgaggctccgaggaaggggctggaagtgggtggacgtaattaaagtgaaactgatggtaggacaacgagactacgctgcaccgtgaagcagatcaccntcncaaganatagacttacaaacgaacacgtcttacttactaacaaattgaacttacgaacgtaccctaaggaaaaccccggaggaaacccacgaacggtacccgttagttaaacgtttaacccgtacggtaaaccccgacggaaaacgggggtaaacgtaaacggtaccgttaaaaggttttaagttaaagttaggtaaacgtttaaagggttacggtttacggggtttaaaatttacccggg

SEQ ID NO: 324788 - DNA, 435 bp, Homo sapiens
  misc_feature: GZ8MTXP02FO370.38.55.E11.1.454.CMB.2.raw
  modified_base (214)..(214): a, c, t, g, unknown or other
  misc_feature (214)..(214): n is a, c, g, or t
  modified_base (431)..(435): a, c, t, g, unknown or other
  misc_feature (431)..(435): n is a, c, g, or t
tcagtcgatcacgtcacgaccggtgctcgatttagcactcgcacgttgggttggccgtattaaaagtgaaactgatggtgggacaacagactacgctgcacccgtgaaaggcagattcaccatctcaagagatgattcaacgaacacgctctttctacaaatgatcagcctgaaaaccgaggacacagccgtgtattactgtaccacagggaanagcagttattatgatagtagtggttatctgtactactacggtatggacgtctggggccaagggaccacgggtcattgtctccccagcctccaccagggcccatcggtctcccctggcaccctcctccagagcacctctcgggggcacagcggccctgggctgcctggtcaacgctacttccacgtgatcgactgagcgggctggcaaggcgcatagnnnnn

SEQ ID NO: 324789 - DNA, 580 bp, Homo sapiens
  misc_feature: GZ8MTXP02HVMWF.38.55.E11.1.454.CMB.2.raw
  modified_base (358)..(358): a, c, t, g, unknown or other
  misc_feature (358)..(358): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctatttaaaggtgtccagtgtgaggtgcagctggtggagtcgtgggggaggcgttgggaagccgtgggggtcccttagactctcctgtacagcctctggattctacttttagttatgcctggatgaccgtgggtccgccaggcctccgaggaaaggggctggaagtgggttgaccgttattaaaagngaaactgatggtaggacaacagactacgctgccacccgtgaaaggcagattcacctatctacaaagagatagattacaaacgaacacgtcttactttacaactaaattgatcgacgaccgaagaaaacccgaggaacacgtacgaccgttagtaacttactacgtacccaagaacgggaagacgactagttaattagtagtattaggtagttcggtttatag

SEQ ID NO: 324790 - DNA, 739 bp, Homo sapiens
  misc_feature: GZ8MTXP02GQUX4.38.55.E11.1.454.CMB.2.raw
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctatttaaaggtgtccagtgtgagtgcagctggtggagtcgtgggggagcgttgggaaagccgtgggggtcccttagactctcctgtacagcctctggattcacttttagttatgcctggatgaccggtcggtccgcgacgccgtacgaagggaggcgtaggtaggtgggtacggacgttaaagttaaagtacgtaacgtagtagtgggtacgaacaagacgtacgtacgacgtcgacccgtaccggtaaggaacgacgtaacgtacttaccaacctagttaccgaaagaaagtagtattaaacgtaccttaaaccgaaaacccgtaacgtaccttcgtttaacctttaacccaaaataaacggttgaaccttaacggaaccgtaacccgtaaaaaggaaaccccggaagggtaaccaacgggtacggtacccggttaatttaaaaccgttccggttaaaccgaaacccggaagggaaaacggggtactaaccgggtatttaaaaggtttaacgttaagacggttaaaacggtaaaacggttttcggtaaggtttaacctttaacggg

SEQ ID NO: 324791 - DNA, 543 bp, Homo sapiens
  misc_feature: GZ8MTXP02F1099.38.55.E11.1.454.CMB.2.raw
  modified_base (276)..(276): a, c, t, g, unknown or other
  misc_feature (276)..(276): n is a, c, g, or t
  modified_base (296)..(296): a, c, t, g, unknown or other
  misc_feature (296)..(296): n is a, c, g, or t
  modified_base (437)..(437): a, c, t, g, unknown or other
  misc_feature (437)..(437): n is a, c, g, or t
  modified_base (505)..(505): a, c, t, g, unknown or other
  misc_feature (505)..(505): n is a, c, g, or t
tcagtcgatcacgtcacgaccggtgctcgatttagcactcgcacgttgggtttggggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaggcagctccaacattggagattaattttgtctcctggtaccagcagctcccaggacacgcccccaaatcctcatttangaccataataggcgaccctnagggattcctgaccgtattctctggctcaagtctggcaccgtcacgccacccgtggccatccgaccggcctccgagaccgtggggacaggccgattatactgacggaaacagtgggataccgagactgaaatgcgttgggncgtcgggtgacgggaccaggctagaccgtcgtaggtcacggcccgaaggcctcggccccctggtaccncgttctccgttccccaccgttcctcgacgtcgactccg

SEQ ID NO: 324792 - DNA, 588 bp, Homo sapiens
  misc_feature: GZ8MTXP02GIGC9.38.55.E11.1.454.CMB.2.raw
  modified_base (432)..(432): a, c, t, g, unknown or other
  misc_feature (432)..(432): n is a, c, g, or t
  modified_base (490)..(490): a, c, t, g, unknown or other
  misc_feature (490)..(490): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtcgtgggggaggcgttgggaaagccgtggggggtcccttagactctcctgtacagcctctggattcacttttagtatgcctggatgaccgtggtccgccaggctccgaggaaaggggctaggaagtggggttggaccgtaattaaaagtagaaactgatggtagggacaacgagactacgctcgcacccgtagaaacggcagacttcaaccatcacaagngatagattacaaacgacacgcttacttacaacaaatgatcaagccctaagaaaaccgnggaaccagacgccgtagtacttacgtacgtaccaacgaagggaacgacggtataaagttaattaagtagtaaagttagtaacggtttggttaactttg

SEQ ID NO: 324793 - DNA, 537 bp, Homo sapiens
  misc_feature: GZ8MTXP02JICLQ.38.55.E11.1.454.CMB.2.raw
  modified_base (385)..(385): a, c, t, g, unknown or other
  misc_feature (385)..(385): n is a, c, g, or t
  modified_base (463)..(463): a, c, t, g, unknown or other
  misc_feature (463)..(463): n is a, c, g, or t
  modified_base (504)..(504): a, c, t, g, unknown or other
  misc_feature (504)..(504): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctatttaaaggtgtccagtgtgaggtgcagctggtggagtctgggggaggcgttgggaaagccgtgggggtcccttagactctcctgtacagcctctggattcacttttagtatgcctggatgacctggtccgcaggctccgaggaagggctggaatgggtgcgtattaaagtgaactgatggtaggacaacagactacgctgcaccgtgaagnagatcaccatcacaagagatgattcaaacgaacacgcttactttactaacaaatgatcaacgccctaagaaaacccgngaacacagaccgtgtaacttacgtgtaacccagaacggganacgctaagttaatagtgatagtagtgttaatcg

SEQ ID NO: 324794 - DNA, 525 bp, Homo sapiens
  misc_feature: GZ8MTXP02GAUWL.38.55.E11.1.454.CMB.2.raw
  modified_base (352)..(352): a, c, t, g, unknown or other
  misc_feature (352)..(352): n is a, c, g, or t
  modified_base (370)..(370): a, c, t, g, unknown or other
  misc_feature (370)..(370): n is a, c, g, or t
  modified_base (410)..(410): a, c, t, g, unknown or other
  misc_feature (410)..(410): n is a, c, g, or t
  modified_base (460)..(460): a, c, t, g, unknown or other
  misc_feature (460)..(460): n is a, c, g, or t
  modified_base (472)..(472): a, c, t, g, unknown or other
  misc_feature (472)..(472): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttgggaaagccgtggggggtcccttagactctcctgtacagcctctggattcacttttagtatgcctggatgacctggtccgccaggctccgaggaaaggggctggaatgggtggccgtattaaaagngaaactgatggtggacanagctacgctgcaccgtgaaagcagattcacatctcaaganatgattacaacgaacacgctctttactacaaatgatcagcctagaaaccngacacagccgtntactactgtaccagaggaacagctaagttaatatgatagtagtaggttatacg

SEQ ID NO: 324795 - DNA, 729 bp, Homo sapiens
  misc_feature: GZ8MTXP02G3ALO.38.55.E11.1.454.CMB.2.raw
  modified_base (259)..(259): a, c, t, g, unknown or other
  misc_feature (259)..(259): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctatttaaaggtgtccagtgtgaggtgcagctggtggagtcgtgggggagcgttgggaagccgtgggggtccttagactctctgtacngcctctggattctacttttagtatgcctggatcgaccgtcggtccgccgacggcctaccggaaggggaaacggggcgtagggtaagttggggttacggtaccgttaaagttaaaaggtagtaaacgtggtagtcggggtacggaacaacgacgacgtacgctcggaccgtaacccggtagaaacggcacggtacttacccgaaccctattaccctaagaaaaggtataagtacgtaacttaacccgaaaaccggtaacaccgtacctttaccttttaaccaaacgtaaagtcgaacttaccgaaacgtaccccgtaaaggaaaaccccggaggaacccaacgacggtacccgttaagtttaacttaaccgtacggtaaacccgaaagggtaaaggggaacgtaacgactttaaagtttaacgttaagtaacggttagttaaggtttacggtttacggtttaatttaccgg

SEQ ID NO: 324796 - DNA, 448 bp, Homo sapiens
  misc_feature: GZ8MTXP02GHHU2.38.55.E11.1.454.CMB.2.raw
  modified_base (441)..(448): a, c, t, g, unknown or other
  misc_feature (441)..(448): n is a, c, g, or t
tcagtcgatcacgtcacgaccggtgctcgatttagcactcgcacgttgggttggccgtattaaaagtgaaactgatggtgggacaacagactacgctgcacccgtgaaaggcagattcaccatctcaagagatgattcaacgaacacgctctttctacaaatgatcagcctgaaaaccgaggacacagccgtgtattactgtaccacagggaagagcagttatatgatagtagtgttatctgtactactacggtatggacgtctggggccaagggaccacggtcattgtctccccagccctccaccacgggcccatcggtccttccccctggccacccctcctccagacgcacctctcgggggcacgagccggccctggctcgcctggtcaggacctactccacgtgatcgactgagtcgggctggcaacgggcgcatagnnnnnnnn

SEQ ID NO: 324797 - DNA, 541 bp, Homo sapiens
  misc_feature: GZ8MTXP02IN45T.38.55.E11.1.454.CMB.2.raw
  modified_base (364)..(364): a, c, t, g, unknown or other
  misc_feature (364)..(364): n is a, c, g, or t
  modified_base (405)..(405): a, c, t, g, unknown or other
  misc_feature (405)..(405): n is a, c, g, or t
  modified_base (449)..(449): a, c, t, g, unknown or other
  misc_feature (449)..(449): n is a, c, g, or t
  modified_base (461)..(461): a, c, t, g, unknown or other
  misc_feature (461)..(461): n is a, c, g, or t
  modified_base (467)..(467): a, c, t, g, unknown or other
  misc_feature (467)..(467): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctatttaaaaggtgtccagtgtgaggtgcagctggtggagtctgggggaggcttgggaaagccgtgggggtcccttaggactctcctgtacagcctctggattcactttagtatgcctggatgacctgggtccgccaggctccgaggaagggctggaatgggttgcgtataaagtgaaatgatggtggacaanagactacgctgcacccgtgaaagcagattcacatctcaagngatagacttacaaacgacacgctactttactacaaatgatcacnctagaaaaccgngaacanagcgtagtatacgtgtaacccaagacgggaagacgtactaaggttaatagagtatagtaagttggtttaattcg

SEQ ID NO: 324798 - DNA, 630 bp, Homo sapiens
  misc_feature: GZ8MTXP02HIVN3.38.55.E11.1.454.CMB.2.raw
  modified_base (269)..(269): a, c, t, g, unknown or other
  misc_feature (269)..(269): n is a, c, g, or t
  modified_base (358)..(358): a, c, t, g, unknown or other
  misc_feature (358)..(358): n is a, c, g, or t
  modified_base (399)..(399): a, c, t, g, unknown or other
  misc_feature (399)..(399): n is a, c, g, or t
  modified_base (424)..(424): a, c, t, g, unknown or other
  misc_feature (424)..(424): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctatttaaaggtgtccagtgtgaggtgcagctggtggagtcgtgggggaggcttgggaaagccgtggggggtcccttaggactctcctgtacagcctntggattcacttttagttatgcctggatgacctgggtcccgccaggcctccgaggaagggctaggaagtgggttaggccgtattaaaggngtaacgtagtagaggtaggggtacgaacaagacgtacgtcncggtacaccgtacgtaaggaacganacgttaccaccactactaccaagaagtaatagtacttaacaaaccggaaacctaacgccgttacctttaccttaacaaaacttagactactaacgacccgtaacgaaaacggaacggaacacacgacgtacgttaataccgtacgtacccaacggaacggacgaagcctaagttaatatagtagtaagttacggtagtttattacg

SEQ ID NO: 324799 - DNA, 552 bp, Homo sapiens
  misc_feature: GZ8MTXP02HVR8K.38.55.E11.1.454.CMB.2.raw
tcagtcgatcacgtcacgaccggtgctcgatttagcactcgcacgttgggtttggggagatctgggagaggagccccagccttgggattcccaagtgttttcattcagtgatcaggactgaacacagaggactcagcatggagtttgggctgagctggattttccttgctgctattttaaaaggtgtccagtgtgaggtgcagctggtggagtcgtgggggaggcgttgggaaagccgtggggggtcccttagactctcctgtacagcctctggtattcacttttagttatgcctggatcgactgggtccgccaggctccgagggaagggctggaatgggtgcgtattaaaagtgaaactgatggtaggacaacgagactacgctgcacccgtgaaagcagattccacatctacaagagtatagaattacaaacgacacgtcttactttacaactaaatgactacagccctaagaaaccgagacacacgacctagtattacgacgtacccaagacgggaatgactaagttatatgaattaggtattggttta

SEQ ID NO: 324800 - DNA, 732 bp, Homo sapiens
  misc_feature: GZ8MTXP02JBZUH.38.55.E11.1.454.CMB.2.raw
  modified_base (270)..(270): a, c, t, g, unknown or other
  misc_feature (270)..(270): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctaattttaaaaggtgtccagtgtgaggtgcagctggtggagtcgtgggggaggcgttgggaagccgtgggggtcccttagactctcctgtacagcctntggattctacttttagttatgcctggtatcgaccgtgggtcccgccgacggcctaccgaaggggaaacggggcgtagggtaagttcggggtttacgggaaccgttaaagttaaaacgtagtaaaacgtaggtagtaggggtagggaacaaacgaacgaactacggctcggaccgtaacccggtaggaaacgcgaagtacttaccaaccctatcctaacgaaagagtatagacttaacaaacgaactacgtccttactttacaaacgtaaaatgtaactacgaacgaacccgtaaacgaaaaacccggagaaaccaaccgtacggtacccgttaagttaactttaaaccgtacggtaaaccccgaaaaggtaaagggggaaaacctaacgtacgttaaaaggtttaaacttaagttaacggtaaaacggtttagtttaaggggtttacggtttaattaccggg

SEQ ID NO: 324801 - DNA, 564 bp, Homo sapiens
  misc_feature: GZ8MTXP02ICU6S.38.55.E11.1.454.CMB.2.raw
  modified_base (404)..(404): a, c, t, g, unknown or other
  misc_feature (404)..(404): n is a, c, g, or t
  modified_base (407)..(407): a, c, t, g, unknown or other
  misc_feature (407)..(407): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttcctgctgctattttaaaaggtgtccagtgtgaggtgcagctggtggagtcgtgggggaggcttggggaaagccgtgggggtcccttagactctcctgtacagcctctggattcacttttagttatgcctggatgacctgggccgcaggctccgaggaagggctggaagtgggttggcgtattaaagtgaaactgatggtaggacaacagactacgctgcaccgtagaaagcagatcaccanctnaagagatgacttacaaacgaacacgcttacctttacaacaaattgatcaagccctagaaaacccgaggacacgacgccgtagttaacttacgtgtaaccgaacgaacggggaagacgctaagttaattaagtgtaattagtagtttaggttacttcg

SEQ ID NO: 324802 - DNA, 546 bp, Homo sapiens
  misc_feature: GZ8MTXP02G3VTA.38.55.E11.1.454.CMB.2.raw
  modified_base (349)..(349): a, c, t, g, unknown or other
  misc_feature (349)..(349): n is a, c, g, or t
  modified_base (369)..(369): a, c, t, g, unknown or other
  misc_feature (369)..(369): n is a, c, g, or t
  modified_base (416)..(416): a, c, t, g, unknown or other
  misc_feature (416)..(416): n is a, c, g, or t
  modified_base (499)..(499): a, c, t, g, unknown or other
  misc_feature (499)..(499): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctatttaaaggtgtccagtgtgaggtgcagctggtggagtcgtgggggaggcgttgggaaagccgtgggggtcccttaggactctcctgtacagcctctggattcacttttagtatgcctggatgaccgtggtccgcgaggctccgaggaagggctaggatgggtgacgtattaaagngaactgagtggtaggacaanagactacgctcgacacccgtgaaacgcagatacaccatctacaaganatagatacgaaacgacacgtcttactttactaaacaattgatcacgacctaagaaaaccgagacacgagccgtagtatacgtntaccagaggtaagcgatagtaatatagtatagacgtttggtattacg

SEQ ID NO: 324803 - DNA, 493 bp, Homo sapiens
  misc_feature: GZ8MTXP02HNOJ9.38.55.E11.1.454.CMB.2.raw
  modified_base (282)..(282): a, c, t, g, unknown or other
  misc_feature (282)..(282): n is a, c, g, or t
  modified_base (301)..(301): a, c, t, g, unknown or other
  misc_feature (301)..(301): n is a, c, g, or t
  modified_base (346)..(346): a, c, t, g, unknown or other
  misc_feature (346)..(346): n is a, c, g, or t
  modified_base (366)..(366): a, c, t, g, unknown or other
  misc_feature (366)..(366): n is a, c, g, or t
  modified_base (375)..(375): a, c, t, g, unknown or other
  misc_feature (375)..(375): n is a, c, g, or t
  modified_base (401)..(401): a, c, t, g, unknown or other
  misc_feature (401)..(401): n is a, c, g, or t
  modified_base (403)..(406): a, c, t, g, unknown or other
  misc_feature (403)..(406): n is a, c, g, or t
  modified_base (413)..(413): a, c, t, g, unknown or other
  misc_feature (413)..(413): n is a, c, g, or t
  modified_base (416)..(417): a, c, t, g, unknown or other
  misc_feature (416)..(417): n is a, c, g, or t
  modified_base (423)..(423): a, c, t, g, unknown or other
  misc_feature (423)..(423): n is a, c, g, or t
  modified_base (425)..(425): a, c, t, g, unknown or other
  misc_feature (425)..(425): n is a, c, g, or t
  modified_base (427)..(428): a, c, t, g, unknown or other
  misc_feature (427)..(428): n is a, c, g, or t
  modified_base (430)..(431): a, c, t, g, unknown or other
  misc_feature (430)..(431): n is a, c, g, or t
  modified_base (433)..(433): a, c, t, g, unknown or other
  misc_feature (433)..(433): n is a, c, g, or t
  modified_base (437)..(437): a, c, t, g, unknown or other
  misc_feature (437)..(437): n is a, c, g, or t
  modified_base (444)..(444): a, c, t, g, unknown or other
  misc_feature (444)..(444): n is a, c, g, or t
  modified_base (446)..(446): a, c, t, g, unknown or other
  misc_feature (446)..(446): n is a, c, g, or t
  modified_base (448)..(448): a, c, t, g, unknown or other
  misc_feature (448)..(448): n is a, c, g, or t
  modified_base (450)..(450): a, c, t, g, unknown or other
  misc_feature (450)..(450): n is a, c, g, or t
  modified_base (457)..(457): a, c, t, g, unknown or other
  misc_feature (457)..(457): n is a, c, g, or t
  modified_base (468)..(468): a, c, t, g, unknown or other
  misc_feature (468)..(468): n is a, c, g, or t
  modified_base (470)..(470): a, c, t, g, unknown or other
  misc_feature (470)..(470): n is a, c, g, or t
  modified_base (479)..(479): a, c, t, g, unknown or other
  misc_feature (479)..(479): n is a, c, g, or t
  modified_base (493)..(493): a, c, t, g, unknown or other
  misc_feature (493)..(493): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctatttaaaggtgtcagtgtgagtgcagctggtggagtctgggggagcttgggaaagccgtgggggtcccttaggactctcctgtacagcctctggattcactttagttangcctggatgacctggtccncaggctccgaggaaagggctggaagtgggttggcgtaataaaagngaaactgatggtaggacaanagactacgntgcaccgtgaaagcagatcacatcanannnnatacaanacnnctctananannannanacanaacagananancntatatanacacgagagananataatatanatagtagtagtatn

SEQ ID NO: 324804 - DNA, 672 bp, Homo sapiens
  misc_feature: GZ8MTXP02G4XPU.38.55.E11.1.454.CMB.2.raw
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctatttaaaggtgtccagtgtgaggtgcagctggtggagtcgtgggggaggcgttgggaaagccgtgggggtcccttagactctcctgtacagcctctggattcacttttagttatgcctggatgaccgtggtccgcaggctccgaggaaggggctggaagtgggttggccgtaagttaaagtgaaactgagtggtgggaacaacgagactacgctcgccgacccgtagaaaggcaagacttacaccatcctacgaagagatagattacaaacgaacacgtaccttactttacctaaacgtaaatggaactaccgtaaggaccccttaaacggaaaaaacccggacggaaccaaacgaacgggtaccccgttaaggtttaaaccttaaccgttacgtaaaccccgggtaaacggaaacgggggtaaacgaacggtaccgttaaaggtttaaattagttaggtaaagttaacggtttaggtttacgggtttaatttaaccgg

SEQ ID NO: 324805 - DNA, 456 bp, Homo sapiens
  misc_feature: GZ8MTXP02HSKBL.38.55.E11.1.454.CMB.2.raw
  modified_base (448)..(456): a, c, t, g, unknown or other
  misc_feature (448)..(456): n is a, c, g, or t
tcagtcgatcacgtcacgaccggtgctcgatttagcactcgcacgttgggttggccgtattaaaagtgaaactgatggtgggacaacagactacgctgcacccgtgaaaggcagattcaccatctcaagagatgattcaacgaacacgctctttctacaaatgatcagcctgaaaaccgaggacacagccgtgtattactgtaccacagggaagagcagttatatgatagtagtggttatctgtactactacggtatggacgtctggggccaagggaccacgggtcattgtctccccagcctccaccaagggcccatcggtcttccccctggccaccctcctccaagacgcacctctcgggggcacagccggccctcggggctcgcctggtccaaggacctacttccacgtgatcgactggagcggggctgggcaagggcgcgatagnnnnnnnnn

SEQ ID NO: 324806 - DNA, 576 bp, Homo sapiens
  misc_feature: GZ8MTXP02GA2N9.38.55.E11.1.454.CMB.2.raw
  modified_base (344)..(344): a, c, t, g, unknown or other
  misc_feature (344)..(344): n is a, c, g, or t
  modified_base (362)..(362): a, c, t, g, unknown or other
  misc_feature (362)..(362): n is a, c, g, or t
  modified_base (397)..(397): a, c, t, g, unknown or other
  misc_feature (397)..(397): n is a, c, g, or t
  modified_base (402)..(402): a, c, t, g, unknown or other
  misc_feature (402)..(402): n is a, c, g, or t
  modified_base (476)..(476): a, c, t, g, unknown or other
  misc_feature (476)..(476): n is a, c, g, or t
  modified_base (530)..(530): a, c, t, g, unknown or other
  misc_feature (530)..(530): n is a, c, g, or t
  modified_base (535)..(535): a, c, t, g, unknown or other
  misc_feature (535)..(535): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtcgtgggggaggcgttgggaaagccgtgggggtcccttagactctcctgtacagcctctggattcacttttagtatgcctgatgactggtccgcagctcgaggaagggctggagtgggtgacgtattaaagngaatgatggtaggacaanagactacgctgcaccgtgaagcagatcacatccanaaganatgaattcaaacgtacacgtcttactttacaaactaaattcgaattaccgaacgtaccctaaggaaaaacccgnggaaccaacgacgtccgtagtaacttacgtacgtaacccaaaggaacgggtaanacggnttaaagttaattagtagtagttagtaggtacgtttattacg

SEQ ID NO: 324807 - DNA, 561 bp, Homo sapiens
  misc_feature: GZ8MTXP02JHN2H.38.55.E11.1.454.CMB.2.raw
  modified_base (403)..(403): a, c, t, g, unknown or other
  misc_feature (403)..(403): n is a, c, g, or t
  modified_base (415)..(415): a, c, t, g, unknown or other
  misc_feature (415)..(415): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctatttaaaaggtgtccagtgtgaggtgcagctggtggagtcgtgggggaggcgttgggaaagccgtggggggtcccttaggactctcctgtacagcctctggattcactttagttatgcctggatgacctgggtccgccaggctccgaggaaaggggctggaagtgggttggccgtaattaaaagtgaaactgatggtagggacaacagactacgctgcacccgtgaaagnagatcaccatcncaaagagatagattacaaacgtaacacgcttacttactaacaaattgatcagacctagaaaaccgaggacacgagccgtagtacttacgagtaacccagaagggaagacggcaagttaatagtagactagtagtaggttaacttcg

SEQ ID NO: 324808 - DNA, 582 bp, Homo sapiens
  misc_feature: GZ8MTXP02JU5GT.38.55.E11.1.454.CMB.2.raw
  modified_base (307)..(307): a, c, t, g, unknown or other
  misc_feature (307)..(307): n is a, c, g, or t
  modified_base (552)..(552): a, c, t, g, unknown or other
  misc_feature (552)..(552): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcgttgggaaagccgtggggggtcccttagactctcctgtacagcctctggattcactttagttatgcctggatgacctggtccnccaggctccgaggaagggctggaagtgggtggcgtataaaagtgaaactgatggtagggacaacagactacgctgcacccggtgaaacggcagattcacccagtctcgaagagatagattacgaaacgacaacgccttactttactaaaccaaattgaactcaagaccctaggaaaaacccgaggaaccacgaacgcccgtagttaacttactacgtaaccacgaaggggacgaagctaaagttnttaatgagtacgttagttacggttattacg

SEQ ID NO: 324809 - DNA, 643 bp, Homo sapiens
  misc_feature: GZ8MTXP02H10LF.38.55.E11.1.454.CMB.2.raw
  modified_base (447)..(447): a, c, t, g, unknown or other
  misc_feature (447)..(447): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctattttaaaggtgtccagtgtgaggtgcagctggtggagtcgtgggggaggcgttggggaaagccgtgggggtcccttagactctcctgtacagcctctggattcacttttagttatgcctggatgaccgtgggtccgccaggcctaccgaggaaacggggctaggaagtggggttggaccgttaagttaaaagtagaaactgagtgggtagggaacaacgagactacggctcggacctacccgtagaaagcagattacaccatacctacaaganaacgtgaacttacaaaacgaacacgtacttacctttacctaaactaaaattgaaactcaacgacctaaacgaaaaccgaggaaccaacgagtaccgttaagtacttaaccgtacgtaaacccaaggaacgggtaaacgaggtaactaggttttaaatagttaacgtaagttaaggtttagttaggtttaataccgg

SEQ ID NO: 324810 - DNA, 590 bp, Homo sapiens
  misc_feature: GZ8MTXP02HCWXX.38.55.E11.1.454.CMB.2.raw
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctatttaaaggtgtccagtgtgaggtgcagctggtggagtcgtgggggaggcgttgggaaagccgtgggggtcccttagactctcctgtacagcctctggattctacttttagttatgcctggatcgaccgtgggtcccgccgaggcctccgagggaaggggcgtggaagtggggttggaccggtaattaaaaggtagaaactgagtgggtaggacaacagactacgctcgccaccgtagaagcagatacacatcctacaagagatagacttacaaacgaacacgtcttctttactaacaaatcgatacacgacctaagaaaacccgaggacacgacgtccgtagtaactaccgtagtaacccagaagggacgacgtactaagttaattagtagtagttaagtagttacggttattacg

SEQ ID NO: 324811 - DNA, 596 bp, Homo sapiens
  misc_feature: GZ8MTXP02HH30K.38.55.E11.1.454.CMB.2.raw
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctattttaaaggtgtccagtgtgaggtgcagctggtggagtctgggggaggcttgggaaagccgtggggggtcccttagactctcctgtacagcctctggattcactttagttatgcctggatgacctgggtccgccaggctccgaggaaggggctggaagtgggtggccgtattaaagtgaaactgatggtagggacaacagactacgctgcaccgtgaaagcagactcaccatctacaagagatgattacaaacgtaacacgtcttactttactaaacaaattgaacttcgaagtacccgtaaggaaaaccccgagggaaccaacgacggacccgttagtaacgttactacgtaaaccccagaaggggaacgagtacctaaaggttaattaataggtactaggttacggttaggtttattacg

SEQ ID NO: 324812 - DNA, 596 bp, Homo sapiens
  misc_feature: GZ8MTXP02IBCZ2.38.55.E11.1.454.CMB.2.raw
  modified_base (423)..(423): a, c, t, g, unknown or other
  misc_feature (423)..(423): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctatttaaaggtgtccagtgtgaggtgcagctggtggagtcgtggggagcgttgggaagccgtgggggtccctagactctctgtacagcctcgtggattctactttagttatgcctggatgaccgtggtcccgccgaggcctcgaggaaaggggcgtaggaagttggggttggaccgttaagttaaaagtagaaaactgagtgggtagggacaaacgagactacgctgcacccgtgaaaggcagattcacanctacagagatagattacaaacgaacacgacttactttactaaactaaatgaatcacgcctaacgaaaacgacgaacacagtaccgtagttaacttacgtacgtaaccgaacgaaggaacgaacggtctaaagttaattagtagtaagtaaggttacggttaggttaactttcg

SEQ ID NO: 324813 - DNA, 642 bp, Homo sapiens
  misc_feature: GZ8MTXP02FY5W8.38.55.E11.1.454.CMB.2.raw
  modified_base (427)..(427): a, c, t, g, unknown or other
  misc_feature (427)..(427): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtcgtgggggaggcgttgggaagccgtgggggtcccttagactctcctgtacagcctctggattctacttttagttatgcctggatcgaccgtgggtcccgccaggcctaccgagggaaaggggctaggaagtgggtggaccgttaagttaaaagtgaaactggatgggtagggacaagagactacgctcgcaccgtagaagcagactcacatcanaagagatgacttacgaaacgacacgtccttactttacaaactaaatgaacttacgaacgtacccgtaaaggaaaaaccccggaggaaaccacggaaacgtcccggttagttaacttaaccgtacggttaaacccaaacgggaaacgggaaacgtaacgacggttaaagtttaagtagttaggtaaagttacgttaggttaggtttaccttaacgg

SEQ ID NO: 324814 - DNA, 622 bp, Homo sapiens
  misc_feature: GZ8MTXP02F913R.38.55.E11.1.454.CMB.2.raw
  modified_base (311)..(311): a, c, t, g, unknown or other
  misc_feature (311)..(311): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttcctgctgctattttaaaaggtgtccagtgtgaggtgcagctgggtggagtcgtgggggaggcgttgggaaagccgtgggggtcccttagactctcctgtacagcctctggattctacttttagtatgcctggatcgaccgtgggtccnccgaggcctccgaaggaaaggggctgggaagtggggttggaccgttaagttaaaagtgaaactgagtgggtagggacaaacgagactacgcgtgaccacccggtagaaaacggccaagtacttccaacctatcctacgaaagagtactagtattaacaaacgaacacgtcttactttaccaacaaattcgataccaagtaccctaacggaaaaccgacggaaacacgacgtccggtattaacttacgtactaaccgacgaacgggaagacggtataagttaataagtagtacgtagtagtacgttattacg

SEQ ID NO: 324815 - DNA, 545 bp, Homo sapiens
  misc_feature: GZ8MTXP02IJ742.38.55.E11.1.454.CMB.2.raw
  modified_base (390)..(390): a, c, t, g, unknown or other
  misc_feature (390)..(390): n is a, c, g, or t
  modified_base (415)..(415): a, c, t, g, unknown or other
  misc_feature (415)..(415): n is a, c, g, or t
tcagtcgatcacgtcacgaccggtgctcgatttagcactcgcacgttgggtttggggacaatcttcatcatgacctgctccctctcctcctcacccttctcattcactgcacagggtcctgggcccagtctgtgttgacgcagccgccctcagtgtctgcggccccaggacagaaggtcaccatctcctgctctggaggcagctccaacattggagataattttgctctggtaccagcagctcccaggaacagccccaaactcctcatttatgaaccataataggcgaccctcagggattcctgaccgattctctggctccaagtctggcaccgtcacgccacctggcactcgaccggcctcgagacgtggggacgaggccattattacngacgaacagtgggataccgagtacngaaatcggacttggggtgcgttcggggtaggacggggaccagggtctcggacccgttcgtagggcacggacccgaaggcctcgccccgtcggcctactctcgttccccaccgttcactacgtcgactccg

SEQ ID NO: 324816 - DNA, 817 bp, Homo sapiens
  misc_feature: GZ8MTXP02H3PU2.38.55.E11.1.454.CMB.2.raw
  modified_base (152)..(152): a, c, t, g, unknown or other
  misc_feature (152)..(152): n is a, c, g, or t
tcagtcgatcacgtcacgaccggtgctcgatttagcactcgcacgttgggtttggggacaatcttcatcatgacctgctcccctctcctcctcacccttctcattcactgcacagggtcctgggcccagtctgtgttgacgcagccgccctnagtgtctgcgcccaggacagaagtcacatctcctgctcgtggaggcagcctaccaaactagttggaagtatttaattttgcctcctaggtacagcagcctacccgaaggaaccaccgacccccaaactcctactatttacacgaacctaataacgtacggacccgtaccccgtacggaacgggtacttcccgagtaacccgttatttccgtacgtcggtacctaccgtaaacgttcgcgggacctacccggtcaacccggccctaaccccggttggacctaaccgttccggaccccgggtccctaccgaacggtaccgggtcgggggaaacctaccgggtaccgttaagttaacgttaccgtacggaaaccggtaacgtaaaggttacggggaaacttaacccggaaagtaccgtaagtaaacggtttccgggttaccggtttagggggtacgtccggggtttaacgggggtacggggaaaccggggtaccgacgggtaccggttaaccggtaaccccgggtttcgaaccgggttaccgaacccgggaccccgtaaacgggtccccgtccccgggtaacccccgtttcggtaccccttacccgttcccgtttcccggttacccccctaccgttccccgttacgaccggttcgtaaaccgtccggg

SEQ ID NO: 324817 - DNA, 572 bp, Homo sapiens
  misc_feature: GZ8MTXP02H6XPR.38.55.E11.1.454.CMB.2.raw
  modified_base (407)..(407): a, c, t, g, unknown or other
  misc_feature (407)..(407): n is a, c, g, or t
tcagtcgatcacgtcacgaccggtgctcgatttagcactcgcacgttgggtttgggagatctgggagaggagccccagccttgggattcccaagtgttttcattcagtgatcaggactgaacacagaggactcaccatggagtttgggctgagctggattttccttgctgctatttaaaggtgtccagtgtgagtgcagctggtggagtcgtgggggaggcgttggggaaagccgtgggggtcccttagactctcctgtacagcctctggattcactttagttatgcctggatgaccgtgggtcccgcaggctccgaggaaggggctggaagtgggtgacgtaataaaagtgaaactgatgggaggaacaacgagactacgctgccaccgagaaagcagatcaccanctacaagagatagatacaaacgaacacgtactctttacaactaaatgaatcaagtacctaaagaaaacccgaggaaccaacgagtcccgtagttacttaacgtcgtaaacccagaacgggaaacgagacgtaagttaatagagtataggtagttacgtttatacg

SEQ ID NO: 324818 - DNA, 538 bp, Homo sapiens
  misc_feature: GZ8MTXP02GDXNK.38.55.E11.1.454.CMB.2.raw
  modified_base (278)..(278): a, c, t, g, unknown or other
  misc_feature (278)..(278): n is a, c, g, or t
  modified_base (297)..(297): a, c, t, g, unknown or other
  misc_feature (297)..(297): n is a, c, g, or t
  modified_base (440)..(440): a, c, t, g, unknown or other
  misc_feature (440)..(440): n is a, c, g, or t
  modified_base (504)..(504): a, c, t, g, unknown or other
  misc_feature (504)..(504): n is a, c, g, or t
tcagtcgatcacgtcacgaccggtgctcgatttagcactcgcacgttgggtttggggacaatcttcatcatgacctgctcccctctcctcctcacccttctcattcactgcacagggtcctgggcccattctgtgttgacgcagccgccctcagtgtctgcggccccaggacagaaggtcaccatctcctgctctggaggcagctccaacattggagattaattttgtctcctggtaccagcagctcccaggaacacgcccccaaactcctcatttangaccataataggcaccctnaggattcctgaccgtattctctggctccaagtctggcaccgtcagcccacctggcatccgaccggcctcgagcgtggggacgaggccgtattactactggacggaaacagtagggaactaccgagactgaaactgcgttgggncgttcgggaggacgggaccaggctagaccgtcgagtcacgcccgaaggcctcgcccctgtaccnctccgtcgttccccgcctcctcgacgtcgactcg

SEQ ID NO: 324819 - DNA, 552 bp, Homo sapiens
  misc_feature: GZ8MTXP02IU8UB.38.55.E11.1.454.CMB.2.raw
  modified_base (342)..(342): a, c, t, g, unknown or other
  misc_feature (342)..(342): n is a, c, g, or t
  modified_base (526)..(526): a, c, t, g, unknown or other
  misc_feature (526)..(526): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtcgtgggggaggcgttgggaaagccgtgggggtcccttagactctcctgtacagcctctggattcactttagttatgcctggatgacctggtccgcaggctcaggaagggctggatggtgcgtataaagnaatgatggtggacaacagactacgctgcaccgtgaagcagatcaccagtctacaagagatagacttacaaacgaaccacgtctactttcctaacaaattagatcagtacctaagaaaccgagaacacgagaccgtagtaacttacgtactaaccgaacgagggaacgaacgactagttaattanagtacgtagtagttaggttatttacg

SEQ ID NO: 324820 - DNA, 482 bp, Homo sapiens
  misc_feature: GZ8MTXP02GV9IJ.38.55.E11.1.454.CMB.2.raw
  modified_base (180)..(180): a, c, t, g, unknown or other
  misc_feature (180)..(180): n is a, c, g, or t
  modified_base (214)..(214): a, c, t, g, unknown or other
  misc_feature (214)..(214): n is a, c, g, or t
  modified_base (473)..(482): a, c, t, g, unknown or other
  misc_feature (473)..(482): n is a, c, g, or t
tcagtcgatcacgtcacgaccggtgctcgatttagcactcgcacgttgggttggccgtattaaaagtgaaactgatggtgggacaacagactacgctgcacccgtgaaaggcagattcaccatctcaagagatgattcaacgaacacgctctttctacaaatgatcagcctgaaaaccgnggacacagccgtgtattactgtaccacagggaanagcagttatatgatagtagtgttatctgtactactacggtatggacgtcgtggggccaagggaccacggtcattgtcctccccagccctccacccaacgggccccagtccggtccttcccccgtggccacccctcctccaacgacgccacctcgtcgggggcacgacgccggcccgtgggctcgccgtcggtcaacgggcctaccgttccacgttcgagtccgactcggaggcggggctcgggcgaagggcgcagtagnnnnnnnnnn

SEQ ID NO: 324821 - DNA, 471 bp, Homo sapiens
  misc_feature: GZ8MTXP02HBQQY.38.55.E11.1.454.CMB.2.raw
  modified_base (207)..(207): a, c, t, g, unknown or other
  misc_feature (207)..(207): n is a, c, g, or t
  modified_base (214)..(214): a, c, t, g, unknown or other
  misc_feature (214)..(214): n is a, c, g, or t
  modified_base (463)..(463): a, c, t, g, unknown or other
  misc_feature (463)..(463): n is a, c, g, or t
  modified_base (466)..(471): a, c, t, g, unknown or other
  misc_feature (466)..(471): n is a, c, g, or t
tcagtcgatcacgtcacgaccggtgctcgatttagcactcgcacgttgggttggccgtattaaaagtgaaactgatggtgggacaacagactacgctgcacccgtgaaaggcagattcaccatctcaagagatgattcaacgaacacgctctttctacaaatgatcagcctagaaaaccgaggacacagcgtgtattactgtaccanagggaanagcagttatatgatagtagtggttatctgtactactacggtatggacgtcgtggggccgaagggaccacggtcattcgtcctccccagcctccaccaacgggcccactccggtccttccccctcggccacccctcctaccaacgacgccaccgtcgtcgggggccacgacgccggcccgtcgggctcgccgtggtaccaaggacctacttccacgtgactcgactgacggcggcgtggcaaggcgacanagnnnnnn

SEQ ID NO: 324822 - DNA, 537 bp, Homo sapiens
  misc_feature: GZ8MTXP02H1CNE.38.55.E11.1.454.CMB.2.raw
  modified_base (323)..(323): a, c, t, g, unknown or other
  misc_feature (323)..(323): n is a, c, g, or t
  modified_base (463)..(463): a, c, t, g, unknown or other
  misc_feature (463)..(463): n is a, c, g, or t
  modified_base (507)..(507): a, c, t, g, unknown or other
  misc_feature (507)..(507): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttcctgctgctattttaaaggtgtccagtgtgaggtgcagctggtggagtcgtgggggaggcgttgggaaagccgtgggggtcccttagactctcctgtacagcctctggattcactttagttatgcctggatgacctgggtccgcaggctcaggaagggcnggatgggtgcgtataaagtgaaactgatggtaggacaacagactacgctgcaccgtgaaaggcagattcacccatctacaagagatagattacaaacgaacacgctactttcaacaaatcgaatcagcctagaaaaccgngaacacgagccgtagtacttacgtgtaacccagaaggaagcganaagttaatagtagatacgtagttgtactag

SEQ ID NO: 324823 - DNA, 603 bp, Homo sapiens
  misc_feature: GZ8MTXP02FOXEH.38.55.E11.1.454.CMB.2.raw
  modified_base (379)..(379): a, c, t, g, unknown or other
  misc_feature (379)..(379): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtcgtgggggaggcgttgggaaagccgtgggggtcccttagactctcctgtacagcctctggattcacttttagtatgcctggatgacctggtccgccaggctccgaggaaaggggctaggaagtggggtggccgtaagttaaaagtgaaactgatggtagggacaanagactacgctgcaccgtgaaagcagatcacatctacaagagatgacttacaaacgtaacaccgcttacttactaaacaaattgatacgagaccctaggaaaaccgaggaacacgaacgtcccgtagtaactttacgacgttaaccaaaccgaaaggggaaacgaacggctaaaaggtttaatttaacgtaggtaaattaggtttaaggttggtttaactttacg

SEQ ID NO: 324824 - DNA, 441 bp, Homo sapiens
  misc_feature: GZ8MTXP02GVGJM.38.55.E11.1.454.CMB.2.raw
  modified_base (180)..(180): a, c, t, g, unknown or other
  misc_feature (180)..(180): n is a, c, g, or t
  modified_base (200)..(200): a, c, t, g, unknown or other
  misc_feature (200)..(200): n is a, c, g, or t
  modified_base (214)..(214): a, c, t, g, unknown or other
  misc_feature (214)..(214): n is a, c, g, or t
  modified_base (226)..(226): a, c, t, g, unknown or other
  misc_feature (226)..(226): n is a, c, g, or t
  modified_base (256)..(256): a, c, t, g, unknown or other
  misc_feature (256)..(256): n is a, c, g, or t
  modified_base (355)..(355): a, c, t, g, unknown or other
  misc_feature (355)..(355): n is a, c, g, or t
  modified_base (434)..(441): a, c, t, g, unknown or other
  misc_feature (434)..(441): n is a, c, g, or t
tcagtcgatcacgtcacgaccggtgctcgatttagcactcgcacgttgggttggccgtattaaaagtgaaactgatggtgggacaacagactacgctgcacccgtgaaaggcagattcaccatctcaagagatgattcaacgaacacgctctttctacaaatgatcagcctgaaaaccgnggacacagccgtgtattacngtaccacagggaanagcagttattangatagtagtgttatctgtactactacggtntggacgtctggggccaagggaccacggtcattgtctccccagcctccaccagggcccatcggtcctcccctggccacccctcctccaagacgcacctcncggggcacagcggccctggctgcctggtcaaggactactccagtgatcgactgacgcgggctcggcaaggcgacatagnnnnnnnn

SEQ ID NO: 324825 - DNA, 598 bp, Homo sapiens
  misc_feature: GZ8MTXP02I1AWY.38.55.E11.1.454.CMB.2.raw
  modified_base (306)..(306): a, c, t, g, unknown or other
  misc_feature (306)..(306): n is a, c, g, or t
  modified_base (380)..(380): a, c, t, g, unknown or other
  misc_feature (380)..(380): n is a, c, g, or t
  modified_base (413)..(413): a, c, t, g, unknown or other
  misc_feature (413)..(413): n is a, c, g, or t
  modified_base (458)..(458): a, c, t, g, unknown or other
  misc_feature (458)..(458): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtcgtgggggaggcgttgggaaagccgtgggggtcccttagactctcctgtacagcctctggattcacttttagtatgcctgatgacctggtccncaggctccgaggaaagggctaggaatgggtgacgtaataaaagtgaaactgagtggtaggacaacagactacgntgccaaccgtagaaagcaagattcaacatctanaagagatgattacgaaacaacacgcttacttactaaagaaaattnatacaacgaccgtaaacgaaaaccgaggaaacacgaacgtaccgttaagttaacttaccgtaacgtaaaccgaaaggaaacggaaagaacgtaactaaagtttaattaagtagtaagttaaggtagtttacgttaatacg

SEQ ID NO: 324826 - DNA, 578 bp, Homo sapiens
  misc_feature: GZ8MTXP02G4Q5V.38.55.E11.1.454.CMB.2.raw
  modified_base (269)..(269): a, c, t, g, unknown or other
  misc_feature (269)..(269): n is a, c, g, or t
  modified_base (416)..(416): a, c, t, g, unknown or other
  misc_feature (416)..(416): n is a, c, g, or t
  modified_base (492)..(492): a, c, t, g, unknown or other
  misc_feature (492)..(492): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctattttaaaggtgtccagtgtgaggtgcagctggtggagtctgggggaggcgttgggaaagccgtgggggtcccttaggactctcctgtacagcctntggattcacttttagtatgcctggatgacctggtccgccaggcctccgaggaaggggctaggaagtggggttggaccgtaattaaaagtagaaacgtgagtggtgggacaacgagactacgctgccaccgtagaagcagattcaccntcacaagagatgattacgaaacgacacgcttactttacaaacaaattgactacgacacccgtaaaggaaaacccgnggaaacactacggacgttacgttatacgtcgtaacccagaaggggaacgagtactagttaatagagtactagtacgtgttactacg

SEQ ID NO: 324827 - DNA, 431 bp, Homo sapiens
  misc_feature: GZ8MTXP02G442E.38.55.E11.1.454.CMB.2.raw
  modified_base (214)..(214): a, c, t, g, unknown or other
  misc_feature (214)..(214): n is a, c, g, or t
  modified_base (397)..(397): a, c, t, g, unknown or other
  misc_feature (397)..(397): n is a, c, g, or t
  modified_base (427)..(431): a, c, t, g, unknown or other
  misc_feature (427)..(431): n is a, c, g, or t
tcagtcgatcacgtcacgaccggtgctcgatttagcactcgcacgttgggttggccgtattaaaagtgaaactgatggtgggacaacagactacgctgcacccgtgaaaggcagattcaccatctcaagagatgattcaacgaacacgctctttctacaaatgatcagcctgaaaaccgaggacacagccgtgtattactgtaccacagggaanagcagttattatgatagtagtggttatctgtactactacggtatggacgtctggggccaagggaccacggtcattgtctccccagcctccaccaagggcccatcggtctcccctggcaccctcctccagagcacctctcggggcacagcggccctgggctgcctggtcaggctacttcacgtnatcgatgagcgggctggcaaggcgcatagnnnnn

SEQ ID NO: 324828 - DNA, 576 bp, Homo sapiens
  misc_feature: GZ8MTXP02FY3AY.38.55.E11.1.454.CMB.2.raw
  modified_base (487)..(487): a, c, t, g, unknown or other
  misc_feature (487)..(487): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtcgtgggggaggcgttgggaaagccgtgggggtcccttagactctcctgtacagcctctggattcacttttagtatgcctggatgacctgggtccgccaggctccgaggaaggggctggaagtgggtgcgtaattaaaagtgaaactgatggtaggacaacgagactacgctgacacccgtgaaagcagactcaaccatctacaagagatgacttacaaacgacacgtcttactttactaaacgaaattgaattacaagacccgtagaaaaccgnggaacacgagtccgtagtaacttacgagtaaccacgaagggtaacgagctaagttaattagtagtaacttaggtagtacgtttattacg

SEQ ID NO: 324829 - DNA, 554 bp, Homo sapiens
  misc_feature: GZ8MTXP02IVEIO.38.55.E11.1.454.CMB.2.raw
  modified_base (347)..(347): a, c, t, g, unknown or other
  misc_feature (347)..(347): n is a, c, g, or t
  modified_base (408)..(408): a, c, t, g, unknown or other
  misc_feature (408)..(408): n is a, c, g, or t
  modified_base (528)..(528): a, c, t, g, unknown or other
  misc_feature (528)..(528): n is a, c, g, or t
tcagtcgatcacgtcacgaccggtgctcgatttagcactcgcacgttgggtttggggagatctgggagaggagacccagccttgggattcccaagtgttttcattcagtgatcaggactgaacacagaggactcaccatggagtttgggctgagctggattttccttgctgctatttaaaggtgtccagtgtgaggtgcagctggtggagtctgggggaggcgttggggaaagccgtggggggtcccttagactctcctgtacagcctctggattcactttagttatgcctggatgacctgggtccgcaggctccgaggaagggctggaagtgggtgcgtataaagngaaactgatggtggacaacagactacgctgcaccgtagaaagcagatcaacatcacaaganatgattacaaacgaacacgcttacttcaacaaattgatcagaccctaagaaaacccgaggaacacgagaccgtgtaactttacgcgtaaaccacgaaggggaacagactaagtttaatanagtactaagtagttaggttattaccg

SEQ ID NO: 324830 - DNA, 559 bp, Homo sapiens
  misc_feature: GZ8MTXP02F86VW.38.55.E11.1.454.CMB.2.raw
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttgggaaagccgtggggggtcccttagactctcctgtacagcctctggattcacttttagtatgcctggatgacctgggtccgccaggctccgaggaaaggggctggaatggggttggccgtaattaaaagtgaaaactgatggtagggacaacagactacgctgcaccgtgaaagcagatcaccatctcaagagatgattacaaacgaacaacgcttactttactaactaaaatgaatcaagaccctagaaaacccgaggaacacagacagtagtaattactacgtaaccacgagggaaacgagactaagttatatagattagtagtaggttta

SEQ ID NO: 324831 - DNA, 566 bp, Homo sapiens
  misc_feature: GZ8MTXP02FOZXS.38.55.E11.1.454.CMB.2.raw
  modified_base (408)..(408): a, c, t, g, unknown or other
  misc_feature (408)..(408): n is a, c, g, or t
  modified_base (414)..(414): a, c, t, g, unknown or other
  misc_feature (414)..(414): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcgttgggaaagccgtggggggtcccttagactctcctgtacagcctctggattcacttttagtatgcctggatgacctgggtccgccaggctccgaggaaggggctggaatgggttgccgtattaaaagtgaaactgatggtgggacaacagactacgctgcaccgtgaaagcagatcaccatcncaaganatgattcaaacgacacgctactttcaacaaatgatcaagccctagaaaaccgaggacacgacgccgtagtaactacgttagtaccgaacgaacggggaagaacgacgtaagttaatttaagtagtaagtaagttaaggtaggttaactttcg

SEQ ID NO: 324832 - DNA, 563 bp, Homo sapiens
  misc_feature: GZ8MTXP02HSBVL.38.55.E11.1.454.CMB.2.raw
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctatttaaaggtgtccagtgtgaggtgcagctggtggagtcgtgggggaggcttgggaaagccgtgggggtcccttagactctcctgtacagcctctggattcacttttagtatgcctggatgacctgggtccgccgaggctccgaggaaaggggctggagtgggtggcgtattaaaagtgaaactgatggtaggacaacagactacgctgcaccgtgaaggcagattcacatctacaagagatgattacaacgacacgctctttcaacaatgatacacgacctagaaaaccgaggacaacgagaccgtagtacttacgtagtaacccacgtaaggggaagacgtacgtaagtttaattaagtgtattaaggtagtttacggtttattacgg

SEQ ID NO: 324833 - DNA, 660 bp, Homo sapiens
  misc_feature: GZ8MTXP02HLO7Z.38.55.E11.1.454.CMB.2.raw
  modified_base (417)..(417): a, c, t, g, unknown or other
  misc_feature (417)..(417): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctattttaaaggtgtccagtgtgaggtgcagctggtggagtcgtgggggaggcgttgggaaagccgtgggggtcccttagactctcctgtacagcctctggattctacttttagtatgcctggatgacctgggtccgccaggctccgaggaaggggctggaagtgggtgcgtaattaaagtgaaactgagtggtagggacaacagactacgctgacaccgtagaagcagattacacatcacaaganatagattacgaaacgaaccacgtacctactttactaaacaaattgaacttcgaagtaccctaaggaaaaacccggaggaaaccaacgaacggtacccgtaggtttaaacttaaccgttacggttaaaccccgaacggaaacgggggtaaaacgaaccggtaacgttaaaggtttaaacggtttaattaacgggttaaacgtttaacggttaaacgggtttacgggttttaaacttttaacggg

SEQ ID NO: 324834 - DNA, 591 bp, Homo sapiens
  misc_feature: GZ8MTXP02I0MJF.38.55.E11.1.454.CMB.2.raw
  modified_base (303)..(303): a, c, t, g, unknown or other
  misc_feature (303)..(303): n is a, c, g, or t
  modified_base (398)..(398): a, c, t, g, unknown or other
  misc_feature (398)..(398): n is a, c, g, or t
  modified_base (425)..(425): a, c, t, g, unknown or other
  misc_feature (425)..(425): n is a, c, g, or t
  modified_base (476)..(476): a, c, t, g, unknown or other
  misc_feature (476)..(476): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttcctgctgctattttaaaggtgtccagtgtgaggtgcagctggtggagtctgggggaggcttgggaagccgtgggggtcccttagactctcctgtacagcctctggattcacttttagtatgcctggatgacctgggtccncaggctccgaggaagggctggaagtgggtgcgtattaaagtgaaactgatggtaggacaacgagactacgctgcaccgtgaaacgcagattcacntcacaagcatagacttacaaacgaacncgacttacgttactaacaaattcgactctaacgaccgtaaggaaaacccgngggaaccacgtacgtaccgttagttaacttaccgtagtaacccgaagtaacggggaagtaacgacgttaagtttaagtagtagaacgttagttaacggttggtttaacttaccgg

SEQ ID NO: 324835 - DNA, 442 bp, Homo sapiens
  misc_feature: GZ8MTXP02FWBR4.38.55.E11.1.454.CMB.2.raw
  modified_base (430)..(430): a, c, t, g, unknown or other
  misc_feature (430)..(430): n is a, c, g, or t
  modified_base (433)..(433): a, c, t, g, unknown or other
  misc_feature (433)..(433): n is a, c, g, or t
  modified_base (436)..(442): a, c, t, g, unknown or other
  misc_feature (436)..(442): n is a, c, g, or t
tcagtcgatcacgtcacgaccggtgctcgatttagcactcgcacgttgtgttggccgtattaaaagtgaaactgatggtgggacaacagactacgctgcacccgtgaaaggcagattcaccatctcaagagatgattcaacgaacacgctctttctacaaatgatcagcctgaaaaccgaggacacagccgtgtattactgtaccacagggaagagcagttattatgatagtagtggttatctgtactactacggtatggacgtctggggccaagggaccacggtcattgtctccccagcctccaccaaggcccatcggtcttccccctggccaccctcctccaagacgccacctcctcgggggcacagcggccctgggctgcctggtcaggactactccacgtgatcgactgagcggctggcaaggcgntanagnnnnnnn

SEQ ID NO: 324836 - DNA, 496 bp, Homo sapiens
  misc_feature: GZ8MTXP02JQGWS.38.55.E11.1.454.CMB.2.raw
  modified_base (181)..(181): a, c, t, g, unknown or other
  misc_feature (181)..(181): n is a, c, g, or t
  modified_base (208)..(208): a, c, t, g, unknown or other
  misc_feature (208)..(208): n is a, c, g, or t
  modified_base (215)..(215): a, c, t, g, unknown or other
  misc_feature (215)..(215): n is a, c, g, or t
  modified_base (486)..(496): a, c, t, g, unknown or other
  misc_feature (486)..(496): n is a, c, g, or t
tcagtcgatcacgtcacgaccggtgctcgatttagcactcgcacgttgggttggccgtattaaaagtgaaactgatggtgggacaacagactacgctgcacccgtgaaaggcagattcaccatctcaagagatgattcaacgaacacgctctttctacaaatgatcagcctagaaaaccgnggacacagccgtgtattactgtaccanagggaanagcagttattatgatagtagtgttatctgtactactacggtatggacgtcgtggggccaagggaccacggtcattcgtcctccccagccctccaccgaaagggccccagtccggtccttcccccgtggccaccctcctccaaacgacgccaccgtcgtcgggggccacgaggccggccgtgggctcgccgtgggtaccaacgggacttaccttccgacgttgacttacgacgtggacggccggggactcgggacgaacgggcgacagtagnnnnnnnnnnn

SEQ ID NO: 324837 - DNA, 619 bp, Homo sapiens
  misc_feature: GZ8MTXP02F5D23.38.55.E11.1.454.CMB.2.raw
  modified_base (309)..(309): a, c, t, g, unknown or other
  misc_feature (309)..(309): n is a, c, g, or t
  modified_base (373)..(373): a, c, t, g, unknown or other
  misc_feature (373)..(373): n is a, c, g, or t
  modified_base (414)..(414): a, c, t, g, unknown or other
  misc_feature (414)..(414): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttcctgctgctattttaaaaggtgtccagtgtgaggtgcagctggtggagtcgtgggggaggcgttgggaaagccgtggggggtcccttagactctcctgtacagcctctggattctacttttagtatgcctggatgacctgggtccncaggctccgaggaagggctaggagtggtggaccgtaagttaaagtgaaactgatggtggacaanagactacgctgcaccgtagaaagcagatcactatcacaagngatagacttacgaaacgtacaccgtcttacctttacaaagtaaaactcgaaacttacgaacgtacccgtaacggaaaaaccggacggaaccaacgtacgtacccgtagttaacttacgtaccgtaaccaaacggaacggggaaagtacgacgttaaaggttaattaaacgtagtaaagttaggttaaggttacggtttattaccg

SEQ ID NO: 324838 - DNA, 562 bp, Homo sapiens
  misc_feature: GZ8MTXP02I54PI.38.55.E11.1.454.CMB.2.raw
  modified_base (307)..(307): a, c, t, g, unknown or other
  misc_feature (307)..(307): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttgggaaagccgtggggggtcccttagactctcctgtacagcctctggattcacttttagttatgcctggatgacctggtccncaggctccaggaagggctggaatgggtgccgtattaaagtgaaactgatggtggacaacagactacgctgcacccgtgaaagcagattcaccatctacaaagagatgattacaaacgtaacacgctactttactaacaaattgaattcagacctagaaaaccgaggaacacgagacccgtagtacttactacgtaaccaacgaagggaacgacgctaaggtttaatagtagattaaggtacgttggttaatttcg

SEQ ID NO: 324839 - DNA, 705 bp, Homo sapiens
  misc_feature: GZ8MTXP02GDNR1.38.55.E11.1.454.CMB.2.raw
  modified_base (648)..(648): a, c, t, g, unknown or other
  misc_feature (648)..(648): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctattttaaaaggtgtccagtgtgaggtgcagctgggtggagtcgtgggggaggcgttagggaagccgtgggggtcccttagactctcctgtacacgcctcgtggattctacttttagtatcgccgtggactcgaccgtcggtcccgccgaggcctaccggaaggggaaggggtctagggtaaggttcggggttacggaccgttaaagttaaaagtagtaaacgtggaggtacggggtacggaacaacgacgtaccgtacgcgtcggaccgaacccggtaaggaaacggacagtacttaccaacctataaccctaaagaaaagtatacgtaactaccaaacggtaacctaccgtacttacctttaaccaaataaagtcgaactaccgaacggtaacccgtaaacgaaaaccggacgaaccgacgtacggtacccgttaagttaaccttaccgacggtaaaccgaagaaacggggaanacgtacgttaagtttataagtagtacgtaggttagttacggttacttacggttaacg

SEQ ID NO: 324840 - DNA, 726 bp, Homo sapiens
  misc_feature: GZ8MTXP02HKIVY.38.55.E11.1.454.CMB.2.raw
  modified_base (567)..(567): a, c, t, g, unknown or other
  misc_feature (567)..(567): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctatttaaaggtgtcagtgtgaggtgcagctggtggagtcgtgggggaggcgttggggaaagccgtgggggtcccttaggactctcctgtacagcctctggattctacttttagtatgcctggatcgaccgtgggtcccgccaggcctaccgaggaaaggggctaggaagtggggttaggaccgttaagtaaaagtagtaaactggtagtgggtagggaacaacgagaactacgactcgacctaacccggagaaacgacgaagacttacccaaacctacttaccacgaaaaggaggtaattcgtaaacttaccgaaaacgaacctacgtaccttacgttttaacaaacaaagtttacaacttaccgaaacgttaccgaaaacggaaaaaccccggnggaaacccaaccgtacggtacccgttaagttaacttaccgttacggaaaaccccaaaggggaaaggggtaaaccgacggttaaacttaagggtttaaaacttacgttaaagggtaacgttaaagggtttacggtttacggggtttttaaaacccctacg

SEQ ID NO: 324841 - DNA, 547 bp, Homo sapiens
  misc_feature: GZ8MTXP02HGR7C.38.55.E11.1.454.CMB.2.raw
  modified_base (452)..(452): a, c, t, g, unknown or other
  misc_feature (452)..(452): n is a, c, g, or t
  modified_base (465)..(465): a, c, t, g, unknown or other
  misc_feature (465)..(465): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtcgtgggggaggcttgggaaagccgtgggggtcccttagactctcctgtacagcctctggattcacttttagttatgcctggatgacctgggtccgcaggctccaggaagggctggaatgggtgccgtattaaagtgaaactgatggtggacaacagactacgctgccaccgtagaaaggcagattcaccatctcaagagatgattcaaacgacacgctacttactaacaaattgatcancctagaaaaccgnggaacacgagtccgtagtaacttacgtgtaacccagaagggaacgacgctaagttaattatgatagtacgttggttaattcg

SEQ ID NO: 324842 - DNA, 637 bp, Homo sapiens
  misc_feature: GZ8MTXP02HT42J.38.55.E11.1.454.CMB.2.raw
  modified_base (373)..(373): a, c, t, g, unknown or other
  misc_feature (373)..(373): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctatttaaaggtgtccagtgtgaggtgcagctggtggagtcgtgggggaggcgttgggaaagccgtgggggtcccttagactctcctgtacagcctctggattcacttttagttatgcctggatgaccgtggtccgccaggctccgaggaaggggctggaagtgggtggcgtaattaaagtgaaactgagtggtaggacaanagactacgctcgcacccgtagaaacgcaagacttcacctatcctacaaagcgaatgaacttcaaacgaaccacgccttacttttaccaaactaaatttcgattaccgagtacccgtaaggaaaaaccccggaggaaccaacgaacggtcccggttagttaaactttaccgttacgtaaacccaacggtaaagggaaccgtaagtcgtaaaggtttaataacgtagttaaagttaggttaaccggttaggtttaaacctttccgg

SEQ ID NO: 324843 - DNA, 446 bp, Homo sapiens
  misc_feature: GZ8MTXP02GPAH2.38.55.E11.1.454.CMB.2.raw
  modified_base (215)..(215): a, c, t, g, unknown or other
  misc_feature (215)..(215): n is a, c, g, or t
  modified_base (436)..(436): a, c, t, g, unknown or other
  misc_feature (436)..(436): n is a, c, g, or t
  modified_base (439)..(446): a, c, t, g, unknown or other
  misc_feature (439)..(446): n is a, c, g, or t
tcagtcgatcacgtcacgaccggtgctcgatttagcactcgcacgttgggttggccgtattaaaaagtgaaactgatggtgggacaacagactacgctgcacccgtgaaaggcagattcaccatctcaagagatgattcaacgaacacgctctttctacaaatgatcagcctgaaaaccgaggacacagccgtgtattactgtaccacagggaanagcagttatatgatagtagtgttatctgtactactacggtatggacgtcgtggggccaaagggaccacggtcattgtctccccagcctcaccaagggcccatcggtccttccccctggccacccctcctccaagacgcacctctcgggggcacagccggccctggctgcctggtcaagactactccacgtgactcgatgagcgggactggcaaggcgacanagnnnnnnnn

SEQ ID NO: 324844 - DNA, 607 bp, Homo sapiens
  misc_feature: GZ8MTXP02HQR88.38.55.E11.1.454.CMB.2.raw
  modified_base (284)..(284): a, c, t, g, unknown or other
  misc_feature (284)..(284): n is a, c, g, or t
  modified_base (429)..(429): a, c, t, g, unknown or other
  misc_feature (429)..(429): n is a, c, g, or t
  modified_base (468)..(468): a, c, t, g, unknown or other
  misc_feature (468)..(468): n is a, c, g, or t
tcagtcgatcacgtcacgaccggtgctcgatttagcactcgcacgttgggtttggggacaatcttcatcatgacctgctcccctctcctcctcacccttctcattcactgcacagggtcctgggcccagtctgtgttgacgcagccgccctcagtgtctgccggccccaggacagaaggtcaccatctcctgctctggaggcagctccaaacattggaagtattaattttgtctcctggtaccagcagctcccaggaaccacgcccccaaactcctacatttangaaccaataatacggccgacccctcgaagggtacttccctagaaccgtatttcctctcggcctaccaagtctggcaccgtcacgccacccgtggccatccgaccggcctaccgacgacgtcggggacgacggcctaattattacnggacgaacagtggataccgagactgaattgcttggggtncgtcgggtaggacggaccgaggcgtcggacccgttcgtaacggtccaacgccccgaaaggcccttcccggcccccgtggtaccctaccgttcgtccccggttacccccgcccgttccctaccgccgtacgtacgtccgg

SEQ ID NO: 324845 - DNA, 629 bp, Homo sapiens
  misc_feature: GZ8MTXP02JOC15.38.55.E11.1.454.CMB.2.raw
  modified_base (217)..(217): a, c, t, g, unknown or other
  misc_feature (217)..(217): n is a, c, g, or t
  modified_base (276)..(276): a, c, t, g, unknown or other
  misc_feature (276)..(276): n is a, c, g, or t
tcagtcgatcacgtcacgaccggtgctcgatttagcactcgcacgttgggtttggggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaggcagctccaacattgganattaattttgctcctggtaccagcagctcccaggaacacgccccaaactcctcatttancgaccataatacggccaccctgagggtacttcctgaccgtattctctggctcaagtctggcaccgtcacgcccaccgtggccactccgaccggcctaccgagacgtcggggacgacggcccgtatttaactcgtaggacggaactagtacgggataacccgagtacctagaacgtggtacgttggggtcgcgttcggggtagggacggggtaccgagggtccgtacggtacccgttaccgtaagggtccaacgggacccccgaaggcccgtaccggcccccgtcgggtccctaccgtccgttaacccggttcccccacccgttccctaccgtaccggttacgaacgttcccgg

SEQ ID NO: 324846 - DNA, 637 bp, Homo sapiens
  misc_feature: GZ8MTXP02GKRGT.38.55.E11.1.454.CMB.2.raw
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctatttaaaggtgtccagtgtgaggtgcagctggtggagtcgtgggggaggcttgggaaagccgtgggggtcccttagactctcctgtacagcctctggattcacttttagttatgcctggatgaccgtgggtccgccgaggctaccgaggaaacggggctaggaagttggggttacgggaccgttaagttaaaaacggtgaaaacgtggagtcgggtagggacaacgagactacgctcgccacccggtagaaacgcaagacttcaccatcctacaagatagtagattaccgaaacgaaactaccgtcttacctttactaaactaaactagacttaccaacgacccgtaagaaaacccggtagaactaaccgacgaccgttagtaacttaccgtagtaccccaaaggaacgggaacgaacgacgtaagttaagttagtagtaattaggtaggtttgttatttaccg

SEQ ID NO: 324847 - DNA, 624 bp, Homo sapiens
  misc_feature: GZ8MTXP02GPQFA.38.55.E11.1.454.CMB.2.raw
  modified_base (353)..(353): a, c, t, g, unknown or other
  misc_feature (353)..(353): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtcgtgggggaggcgttgggaaagccgtggggggtcccttagactctcctgtacagcctctggattcactttagtatgcctggatgacctggtccgccaggctccgaggaagggctaggagtgggtgaccgtaattaaaagngaaactggatggtaggaacaacgagactacgctgaccaacccggtagaaacgcaagtacttaccaaccattccaacgaagaagtagtagtaacttacaaacgaaacacgtcttacttactaaactaaatgaactacaacgtacccgtaaacggaaaacccggaggaaacccaacgtacgtaccgttaagtaaaccgttacgtacgtaacccgaagaagggaacacgacgttaagttaagttagtagtaagttagtacgttacgttattacg

SEQ ID NO: 324848 - DNA, 535 bp, Homo sapiens
  misc_feature: GZ8MTXP02GDNP6.38.55.E11.1.454.CMB.2.raw
  modified_base (365)..(365): a, c, t, g, unknown or other
  misc_feature (365)..(365): n is a, c, g, or t
  modified_base (482)..(482): a, c, t, g, unknown or other
  misc_feature (482)..(482): n is a, c, g, or t
  modified_base (498)..(498): a, c, t, g, unknown or other
  misc_feature (498)..(498): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctattttaaaggtgtccagtgtgaggtgcagctggtggagtctgggggaggcttgggaaagcctggggggtcccttagactctcctgtacagcctctggattcacttttagtatgcctggatgacctgggtccgcaggctccgaggaagggctggaatgggtgcgtattaaagtgaaactgatggtgggacaanagactacgctgcaccgtgaaagcagattcacatctcaagagatgattcaaacgaacacgctactttctaacaaattgatcagcctagaaaaccgaggaacacagccgtatacttacncgtaccacgagggaanacgctagttaattagtagatagtagtaggttattacg

SEQ ID NO: 324849 - DNA, 616 bp, Homo sapiens
  misc_feature: GZ8MTXP02GGVE7.38.55.E11.1.454.CMB.2.raw
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctatttaaaggtgtccagtgtgaggtgcagctggtggagtcgtgggggaggcgttggggaaagccgtggggggtcccttagactctcctgtacagcctctggattcacttttagttatgcctggatcgaccgtgggtccgccaggctccgaggaaaggggctaggaagtggggttggaccgtaagttaaaagtgaaactgagtggtagggacaagagactacgctgccaccgtagaaagcagacttacaccataccacaaagagaatgacttacaaacgtaacacgtcttactttactaacaaattcgaattacacggacccttaaggaaaacccgagggaaacaccgaacggtacccgttagttaacttaccgtagtaaacccaaggaacgggaaacgtagacgtaattaagtatacgtattaggtacgtaggttactttacgg

SEQ ID NO: 324850 - DNA, 638 bp, Homo sapiens
  misc_feature: GZ8MTXP02GRP62.38.55.E11.1.454.CMB.2.raw
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttcctgctgctatttaaaggtgtccagtgtgaggtgcagctggtggagtcgtgggggagcgttgggaagccgtgggggtccttagactctcctgtacagcctctggattcacttttagtatgcctggatgaccgtgggtccgcgaggcctccgaagggaaaggggctagggaagttggggttcggaccgttaagttaaaaagtgaaaacgtgagtgggtagggacaaacgagactacgctcgaccaacccggtagaaaacggcaagtacttaccgaacctatacctacgaaagagaatagaacttacaaaacgtaacacgtcttactttacaaactaaatgatacgacgaaccctaaggaaaaccggacggaacacgacgaccgtagtaacttacgtacgtaaccaacggaaagggaagaacgtactaagttaattaagtacgtaaacgtaggtttaacggtaggtttaacttacgg

SEQ ID NO: 324851 - DNA, 579 bp, Homo sapiens
  misc_feature: GZ8MTXP02IF2Q2.38.55.E11.1.454.CMB.2.raw
  modified_base (409)..(409): a, c, t, g, unknown or other
  misc_feature (409)..(409): n is a, c, g, or t
  modified_base (413)..(413): a, c, t, g, unknown or other
  misc_feature (413)..(413): n is a, c, g, or t
  modified_base (478)..(478): a, c, t, g, unknown or other
  misc_feature (478)..(478): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctattttaaaggtgtcagtgtgaggtgcagctggtggagtcgtgggggaggcttgggaaagccgtggggggtcccttagactctctgtacagcctctggattctacttttagttatgcctggatgaccgtggtcccgcaggctccgaggaaggggctggaagtgggttggaccgttaagtaaagtgaaactgatggtaggacacagactacgctgccaccgtagaaagcagatcacanctanagagatgacttacaacgaacacgtctactttactaacaaattgaattcagaccctagaaaaccgnggaacacgacgccgtattaacttactagtacccaaaggaaggggaacgagtacaaaggtttaattaagtagtagttaggttacggttaggtttaacttcgg

SEQ ID NO: 324852 - DNA, 624 bp, Homo sapiens
  misc_feature: GZ8MTXP02J3YDH.38.55.E11.1.454.CMB.2.raw
  modified_base (273)..(273): a, c, t, g, unknown or other
  misc_feature (273)..(273): n is a, c, g, or t
  modified_base (600)..(600): a, c, t, g, unknown or other
  misc_feature (600)..(600): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttcctgctgctattttaaaaggtgtccagtgtgaggtgcagctgggtggagtcgtgggggaggcgttaggggaaacgccggttggggggtacccttagacctctcctgtacngcctctggtattctacttttagtatgcctggatcgaccgtgggtcccgccaggcctaccgaggaaaggggctagggaagttggggtaggaccgttaagtaaaagtgaaaactggagtgggtaggacaacgagactacgctcgacacccggtgaaacgcagtattccaacctacgtctacgaagagatgaactaccgaaacgaactaccgcttacctttacaaccaaatcgactacgaacgacctaacggaaaaccgacgaacgacgacgtacccgtagtaccttacgtacgtaacccgaagagggaacacgtactaagttaattagngtagtagtacgtaggttacttacg

SEQ ID NO: 324853 - DNA, 604 bp, Homo sapiens
  misc_feature: GZ8MTXP02F0A9C.38.55.E11.1.454.CMB.2.raw
  modified_base (378)..(378): a, c, t, g, unknown or other
  misc_feature (378)..(378): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctattttaaaaggtgtccagtgtgaggtgcagctgggtggagtcgtgggggaggcgttgggaaagccgtggggggtcccttagactctcctgtacagcctctggattcacttttagtatgcctggatgacctgggtccgccaggctccgaggaagggctaggaagtggggttgccgtaagttaaagtgaaactgatggtaggacaanagactacgctgcacccgtagaagcagactacaccatctacaagagatgaacttacaaacgacaaccgcttactttactaacaaatcgatcgaagtaccctaaggaaaaccgacggaacaacgacggtacccgttagtaacttaacgtacgtaaacccgtaaacgaacgggaaagacgacgtaaagtttaattaagtagtagttaaggtagttacggttatttaccg

SEQ ID NO: 324854 - DNA, 609 bp, Homo sapiens
  misc_feature: GZ8MTXP02JAI71.38.55.E11.1.454.CMB.2.raw
  modified_base (565)..(565): a, c, t, g, unknown or other
  misc_feature (565)..(565): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctattttaaaggtgtccagtgtgaggtgcagctggtggagtcgtgggggaggcgttgggaagccgtgggggtcccttagactctcctgtacagcctctggtacttctacttttagttatgcctggatgaccgtgggtccgccaggctccgagggaaaggggctaggtaagtggggttaggaccgttaaagttaaaaggtgaaactggagtgggtagggacaacgagactacgctcgaccaccggtagaaacgcagactccacatactacaaaagatagattacaaacgaacacgtacttactttacaaactaaatacgtatacgaacgacctaacgaaaacccggaggaaccacgacgtaccgtagtaacttacgtacgtaccaaggaaggaanacgtactagttataagagtagtacgtagtggttactcgttaacg

SEQ ID NO: 324855 - DNA, 593 bp, Homo sapiens
  misc_feature: GZ8MTXP02HV85G.38.55.E11.1.454.CMB.2.raw
  modified_base (309)..(309): a, c, t, g, unknown or other
  misc_feature (309)..(309): n is a, c, g, or t
  modified_base (354)..(354): a, c, t, g, unknown or other
  misc_feature (354)..(354): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctatttaaaggtgtccagtgtgaggtgcagctggtggagtcgtgggggaggcgttggggaaagccgtggggggtcccttagactctcctgtacagcctctggtattcacttttagtatgcctggatgacctgggtccncgaggctccgaggaagggctggaagtgggtgacgtaattaaaagngaaactgatggtaggaacaacagactacgctcgcacccgtagaaaggcagattccacatcacgaagagatgattacaaacgaacaccgtcttactttacctaaacgtaaaattgaacttacgaaccgtaccgaaacgaaaaacccggaggaacctaacgagtcccgtaagtactttacgacgtaccaagaaacggacgacgataagttaatatagtatagttagttacggtttattacg

SEQ ID NO: 324856 - DNA, 607 bp, Homo sapiens
  misc_feature: GZ8MTXP02JAGXS.38.55.E11.1.454.CMB.2.raw
  modified_base (418)..(418): a, c, t, g, unknown or other
  misc_feature (418)..(418): n is a, c, g, or t
  modified_base (488)..(488): a, c, t, g, unknown or other
  misc_feature (488)..(488): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtcgtgggggaggcgttgggaaagccgtgggggtcccttagactctcctgtacagcctctggattcactttagtatgcctggatgaccgtggtccgccaggctccgaggaaggggctaggaagtggggttggccgtaattaaaagtgaaactgatggtaggacaacagactacgctgcaccgtgaaacgcagatcacatcacaaganatgattacaaacgacacgcttactttactaacaaattgaacttacgaacgtaccctaaggaaaaacccgnggaaaaccacgaacggtacccgttagttaaacttaccgttacgtaacccgaaacgtaaacggggaaagacgtacgtaagtttaattataggtaataggtttaacgtggtttactttacg

SEQ ID NO: 324857 - DNA, 557 bp, Homo sapiens
  misc_feature: GZ8MTXP02F4VWN.38.55.E11.1.454.CMB.2.raw
  modified_base (413)..(413): a, c, t, g, unknown or other
  misc_feature (413)..(413): n is a, c, g, or t
  modified_base (505)..(505): a, c, t, g, unknown or other
  misc_feature (505)..(505): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttgggaaagccgtggggggtcccttagactctcctgtacagcctctggattcacttttagtatgcctggatgacctgggtccgccaggctccgaggaaaggggctggaagtggggttgccgtattaaaagtgaaactgatggtagggacaacagactacgctgcacccggtagaaagcagattcaaccntctcaaagagatgattacaaacgaacacgcttactttcaacaaatgatcagacctaggaaaacccgggaaaccacgagccgtagtacttacngtaccagaggggaacaggctaagttaattagagtatagttagtcggttatcg

SEQ ID NO: 324858 - DNA, 560 bp, Homo sapiens
  misc_feature: GZ8MTXP02FM9RG.38.55.E11.1.454.CMB.2.raw
  modified_base (418)..(418): a, c, t, g, unknown or other
  misc_feature (418)..(418): n is a, c, g, or t
  modified_base (424)..(424): a, c, t, g, unknown or other
  misc_feature (424)..(424): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtcgtgggggaggcgttgggaaagccgtgggggtcccttagactctcctgtacagcctctggattcacttttagtatgcctggatgacctgggtccgccaggctccgaggaaaggggctaggaagtggggttggaccgtaagttaaaagtgaaactgagtggtaggacaagagactacgctgccaccgtgaaagcagatcacatctnaaaagngatgatacaacgacacgcttacttactaacaaatgatcagacctagaaaaccgagaacacagaccgtagtaacttactacgtaaccaacgaagggaacgacgataagttaagtatagatagtagtaggttactacg

SEQ ID NO: 324859 - DNA, 642 bp, Homo sapiens
  misc_feature: GZ8MTXP02H5W56.38.55.E11.1.454.CMB.2.raw
  modified_base (316)..(316): a, c, t, g, unknown or other
  misc_feature (316)..(316): n is a, c, g, or t
  modified_base (375)..(375): a, c, t, g, unknown or other
  misc_feature (375)..(375): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctaatttaaaaggtgtccagtgtgaggtgcaggtgtcggagtcgtgggggagtcgttgggttcaggcccggggggtccctggacgactctccgtgtgctagtctcgtggtattaaccgttagtgactatgccatgatcgtggccnccgagctccgaggggaggcgtggagtgggtctcgagactaaagttagtgggtaggggtntacttacgacattacttcgacgtacgaccgtccgggtacggggggtcccttacaacccgactaccaaccgaacgaacgaacccgaacgtacccgaggacgacaacactaataatactaaacaatagacaacgagaccgtggaacgtacggtacggacggaacgaacggccggttaagttatttagttcgaggtacgaacgaacgaccgtaacccgaaacggtaccgaaacccgttacgttacggttcgtttccgttttaacggttcg

SEQ ID NO: 324860 - DNA, 552 bp, Homo sapiens
  misc_feature: GZ8MTXP02JTTGL.38.55.E11.1.454.CMB.2.raw
  modified_base (308)..(308): a, c, t, g, unknown or other
  misc_feature (308)..(308): n is a, c, g, or t
  modified_base (378)..(378): a, c, t, g, unknown or other
  misc_feature (378)..(378): n is a, c, g, or t
  modified_base (410)..(410): a, c, t, g, unknown or other
  misc_feature (410)..(410): n is a, c, g, or t
  modified_base (464)..(464): a, c, t, g, unknown or other
  misc_feature (464)..(464): n is a, c, g, or t
  modified_base (488)..(488): a, c, t, g, unknown or other
  misc_feature (488)..(488): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttcctgctgctattttaaaagtgtccagtgtgaggtgcagctggtggagtcgtgggggaggcgttgggaaagccgtggggggtcccttagactctcctgtacagcctctggattcacttttagtatgcctggatgaccgtgggtccncgaggctccgaggaagggctggaagtgggtgccgtataaagtgaaactgatggtggacaacagacacgcngcaccgtgaaagcagacttcacatctacaagngatgattacaacgaacacgcttacttctaacaatgatcaagcctagaaaaccgnggacacgacgcgtagtacttacgngtaccagaacgggagaacgtcgtaagttaagttagagtaattaggtagttacggttactttacg

SEQ ID NO: 324861 - DNA, 561 bp, Homo sapiens
  misc_feature: GZ8MTXP02HKLBQ.38.55.E11.1.454.CMB.2.raw
  modified_base (218)..(218): a, c, t, g, unknown or other
  misc_feature (218)..(218): n is a, c, g, or t
  modified_base (262)..(262): a, c, t, g, unknown or other
  misc_feature (262)..(262): n is a, c, g, or t
  modified_base (526)..(526): a, c, t, g, unknown or other
  misc_feature (526)..(526): n is a, c, g, or t
  modified_base (534)..(561): a, c, t, g, unknown or other
  misc_feature (534)..(561): n is a, c, g, or t
tcagtcgatcacgtcacgaccggtgctcgatttagcactcgcacgttgggttggccgtattaaaaagtgaaactgatggtgggacaacagactacgctgcacccgtgaaaggcagattcaccatctcaagagatgattcaacgaacacgctctttctacaaatgaatcagcctagaaaaccgaggacacagccgtgtattactgtaccacgagggaanagcagtttattatgatagtagtgttatctgtactacgtacggtntggacgtcgtcggggaccaacgggaccacggtcattcgtccttcccccgaagccccttacccaacccgaaacggggccccctaagtcccgggttccctttcccccccgtggcccctaccccctcccgtacccgaaacgaccgcctaacccgtcggtacccgggggacccacgacggccggtcccgtgggcctcgtcccgtggtaccaacgtaccttactccgacgtacgtatccgacgtaggcgtccgggctggaccgaaggcncgaatcgnnnnnnnnnnnnnnnnnnnnnnnnnnnn

SEQ ID NO: 324862 - DNA, 637 bp, Homo sapiens
  misc_feature: GZ8MTXP02JS6GX.38.55.E11.1.454.CMB.2.raw
  modified_base (186)..(186): a, c, t, g, unknown or other
  misc_feature (186)..(186): n is a, c, g, or t
  modified_base (314)..(314): a, c, t, g, unknown or other
  misc_feature (314)..(314): n is a, c, g, or t
  modified_base (363)..(363): a, c, t, g, unknown or other
  misc_feature (363)..(363): n is a, c, g, or t
  modified_base (423)..(423): a, c, t, g, unknown or other
  misc_feature (423)..(423): n is a, c, g, or t
  modified_base (466)..(466): a, c, t, g, unknown or other
  misc_feature (466)..(466): n is a, c, g, or t
  modified_base (526)..(526): a, c, t, g, unknown or other
  misc_feature (526)..(526): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctattttaaaaggtntccagtgtgaggtgcagctggtggagtcgtgggggaggcgttggggaaagccggttggggggtcccttagactctcctgtacagcctctggattctacttttagtatgcctggactgaccgtggtccncgaggcctccgaggaagggctggaatgggttgaccgttaattaaaaggngaaactgatgggtggaacaacgacgactacgctgccaccggtagaagcagtactcgaccntcctagaagagattagattaccgaaaacgaccgactacctttntttaaacaaaccaaaagttgaattaccacggtacctaaaggaaaaccccgaggaccaaanacggtaccgtagttaaacttacggacgttaaccccgaaggttaacgggggaaaactacgtacgttaaagttaagtaagtacgtaacgttaggttacggttagttacttacg

SEQ ID NO: 324863 - DNA, 564 bp, Homo sapiens
  misc_feature: GZ8MTXP02FLF73.38.55.E11.1.454.CMB.2.raw
  modified_base (408)..(408): a, c, t, g, unknown or other
  misc_feature (408)..(408): n is a, c, g, or t
  modified_base (470)..(470): a, c, t, g, unknown or other
  misc_feature (470)..(470): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggagcgttgggaaagccgtgggggtcccttagactctcctgtacagcctctggattctacttttagtatgcctggatgacctgggtccgccaggctccgaggaagggctggaagtgggttggaccgtattaaaacgtgaaactgatggtaggacaagagactacgctgcacccgtagaaagcagctcacntcacaagagatgatacaacgacacgctacttcaactaatgatacagccctaaggaaaaccgnggaacacacgtaccgtagtaacttacgtagtaaccacgaaaggggaacgagactaaagttaatagttagacttaggttaggttagtacctttag

SEQ ID NO: 324864 - DNA, 571 bp, Homo sapiens
  misc_feature: GZ8MTXP02H1KH4.38.55.E11.1.454.CMB.2.raw
  modified_base (456)..(456): a, c, t, g, unknown or other
  misc_feature (456)..(456): n is a, c, g, or t
  modified_base (569)..(569): a, c, t, g, unknown or other
  misc_feature (569)..(569): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctatttaaaggtgtcagtgtgagtgcagctggtggagtcgtgggggaggcgttgggaaagccgtggggggtcccttaggactctcctgtacagcctctggattcactttagttatgcctggatgacctggtccgcaggctccaggaagggctaggaatgggtgacgtaataaaagtgaaactgatggtggaacaagagactacgctgccgaacccgtgaaaaggcaaggattacgaccatctacaagagatagaattcaaacgaaccacgtactctttacctaanaaattgatacagtaccaagaaaacccgaggacaacagaccgtagttactaacgttgaaaccacgaagggaacgagacgtagttaatagtagtataagttacgtaggtttaacncg

SEQ ID NO: 324865 - DNA, 584 bp, Homo sapiens
  misc_feature: GZ8MTXP02JJA1P.38.55.E11.1.454.CMB.2.raw
  modified_base (431)..(431): a, c, t, g, unknown or other
  misc_feature (431)..(431): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacttacagaggactcaccatggagtttgggctgagctggattttccttgctgctattttaaaaggtgtccagtgtgaggtgcagctggtggagtcgtgggggaggcgttgggaaagccgtgggggtcccttagactctcctgtacagtcctctggattcacttttagttatgcctggatgacctgggtcccgcgaggctccgaggaaaggggctaggaagtgggttaggccgtaattaaagtgaaactgagtggtaggacaaacagactacgctgcacccgtgaaagcagattcacctatcctacaaganatagacttacaaacgtacaccgtcttactttactaaactaaatgaacttcaacgaccctagaaaaccgagaacacgacgcgtagtaacttacgagtaccaacgaacggggaatacgactaagtaatagtagtatagtagttacggtattaccg

SEQ ID NO: 324866 - DNA, 611 bp, Homo sapiens
  misc_feature: GZ8MTXP02FPWVZ.38.55.E11.1.454.CMB.2.raw
  modified_base (426)..(426): a, c, t, g, unknown or other
  misc_feature (426)..(426): n is a, c, g, or t
  modified_base (431)..(431): a, c, t, g, unknown or other
  misc_feature (431)..(431): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtcgtgggggaggcgttgggaaagccgtgggggtcccttagactctctgtacagcctctggtattctacttttagttatgcctggatgaccgtggtccgcgacggctaccgaggaaggggcgtggaagtgggttagggccgtaagttaaaagtagaaacgtgagtggtaggacaacagactacgctgacaccgtagaagcagactcacataccanaaganatgaacttacaaacgaacacgtcttacctttacaaactaaatgataccgaagaccccgtaaagaaaacccgaggaaccacgaacgtccgtaagttaacttaccgtacgtaacccgaacggaaagggaacaggacttaaaggtttaatagtagtaattaaggttaggtacgtttagttacg

SEQ ID NO: 324867 - DNA, 640 bp, Homo sapiens
  misc_feature: GZ8MTXP02GDE2Y.38.55.E11.1.454.CMB.2.raw
  modified_base (270)..(270): a, c, t, g, unknown or other
  misc_feature (270)..(270): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtcgtgggggagcgttgggaagcgtgggggtccttagactctcctgtacagcctctggnttctacttttagtatgcctggatgaccgtggtcccgcgaggcctaccgaagggaaagggcgtaggaagttggggttacggaccggttaaagtttaaaacgtagaaaacgtggtaagtgggtaggaacaaacgagactacgctcgaccgaacccgtagaaaacgcaagtacttaccgacctatctaacgaaagagatagacttacgaaacgaacacgtcttacttacaactaaatgatacgacgaaccgtagaaaaccgcggaacaacgacgtaccgttagtaacttaccgtactaacccgaaagaaacggggtaaacaacgtacttaaagttaagttaagagttaagttaggttaacgttagttactacg

SEQ ID NO: 324868 - DNA, 577 bp, Homo sapiens
  misc_feature: GZ8MTXP02G2BJA.38.55.E11.1.454.CMB.2.raw
  modified_base (313)..(313): a, c, t, g, unknown or other
  misc_feature (313)..(313): n is a, c, g, or t
  modified_base (350)..(350): a, c, t, g, unknown or other
  misc_feature (350)..(350): n is a, c, g, or t
  modified_base (417)..(417): a, c, t, g, unknown or other
  misc_feature (417)..(417): n is a, c, g, or t
  modified_base (483)..(483): a, c, t, g, unknown or other
  misc_feature (483)..(483): n is a, c, g, or t
  modified_base (542)..(542): a, c, t, g, unknown or other
  misc_feature (542)..(542): n is a, c, g, or t
  modified_base (550)..(550): a, c, t, g, unknown or other
  misc_feature (550)..(550): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctatttaaaaggtgtccagtgtgaggtgcagctggtggagtcgtgggggaggcgttgggaaagccgtgggggtcccttagactctcctggtacagcctctggattctacttttagttatgcctggatcgacctgggtccgcnggctccgaggaagggctggagtgggtgcgtataaagngaatgagtggtaggacaacgagactacgctgacacccgtgaaacgcgagactcaccatctacaaagngatagactcaaacgacacgtctacctttacaactaaatgatcaacgaccgtaacggaaaacccggnggaaaccacgagtcccgttaagttacttaccgtagtaacccgagaaacggggatacggntaaagttnttagagtagtagtcgttagttactacg

SEQ ID NO: 324869 - DNA, 587 bp, Homo sapiens
  misc_feature: GZ8MTXP02HMDSF.38.55.E11.1.454.CMB.2.raw
  modified_base (431)..(431): a, c, t, g, unknown or other
  misc_feature (431)..(431): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtcgtgggggaggcgttgggaaagccgtgggggtcccttagactctcctgtacagcctctggattcacttttagttatgcctggatgacctggtcccgccaggctccgaggaaaggggctgggaagtggggttggaccgttaagttaaaagtgaaaacgtgaagtggtagggacaacgacgactacgctcgcacccgtagaaagcagattcaccatctanaagagaatgaacttacaaacgaacacgcttactttacctaataaatgattacgaagacctaagaaaaccgagaacacgagccgtagtacttacagtaaccagaacggaagacgtactaagttaagttaagtgtagtagtagttggtttaacttacg

SEQ ID NO: 324870 - DNA, 652 bp, Homo sapiens
  misc_feature: GZ8MTXP02HYJ8C.38.55.E11.1.454.CMB.2.raw
  modified_base (278)..(278): a, c, t, g, unknown or other
  misc_feature (278)..(278): n is a, c, g, or t
  modified_base (299)..(299): a, c, t, g, unknown or other
  misc_feature (299)..(299): n is a, c, g, or t
  modified_base (309)..(309): a, c, t, g, unknown or other
  misc_feature (309)..(309): n is a, c, g, or t
  modified_base (333)..(333): a, c, t, g, unknown or other
  misc_feature (333)..(333): n is a, c, g, or t
tcagtcgatcacgtcacgaccggtgctcgatttagcactcgcacgttgggtttggggacaatcttcatcatgacctgctcccctctcctcctcacccttctcattcactgcacagggtcctgggcccagtctgtgttgacgcagccgccctcagtgtctgcggcccaggacagaaggtcaccatctcctgctctggaggcagctccaacattggagtattaattttgctcctggtaccagcagcctcccaggaacacgcccccaaactcctcatttangaccataatacggcacccctnagggattccngaccgtattctctggctcaagtcngcaccgtcacgccaccgtggcatccaccgtcctccgagaccggtggggacgagggcccgtattactacgtgtaccggaacgtagtacggggactaacccgaagtaccgtagtaaacttggtacgtttaggggttcgccgtttcggggtaggggaacggggacccgagggtccgtacggaaccccggttcgtacgggttcccgaaaggcccccggtaaagggccccgtaccggccccccgttacgggtccctaaccgttcccgttcccggtttccccccgtccccttcccgttccgtaaccgtcggtaacccgtttccgg

SEQ ID NO: 324871 - DNA, 546 bp, Homo sapiens
  misc_feature: GZ8MTXP02J2OOB.38.55.E11.1.454.CMB.2.raw
  modified_base (289)..(289): a, c, t, g, unknown or other
  misc_feature (289)..(289): n is a, c, g, or t
  modified_base (367)..(367): a, c, t, g, unknown or other
  misc_feature (367)..(367): n is a, c, g, or t
  modified_base (472)..(472): a, c, t, g, unknown or other
  misc_feature (472)..(472): n is a, c, g, or t
tcagtcgatcacgtcacgaccggtgctcgatttagcactcgcacgttgggtttgggggagatctgggagaggagccccagccttgggattcccaagtgttttcattcagtgatcaggactgaacacagaggactcaccatggagtttgggctgagctggattttccttgctgctattttaaaaggtgtccagtgtgagtgcagctggtgagtctggggaggcttgggaaagcctgggggtcccttagactctcctgtacagcctctggattcactttagtatgcctggntgacctggtccgccaggctccgaggaaaggggctggaaatgggttgggccgttagttaaaacgtgtaaaactgatggngggacaacagactacgctgcacccgtgaaagcagattacaccatctcaagagatgattcaaacgaacacgcttctttactaacaatgatcagcctagaaaaccgngaccacacgcgtagtactactgtaccaacgaggaaacgtacgcagttaatattagattagtagtgttacttacg

SEQ ID NO: 324872 - DNA, 653 bp, Homo sapiens
  misc_feature: GZ8MTXP02FQDW3.38.55.E11.1.454.CMB.2.raw
  modified_base (308)..(308): a, c, t, g, unknown or other
  misc_feature (308)..(308): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtcgtgggggaggcttgggaaagccgtgggggtcccttagactctctgtacagcctctggattctacttttagtatgcctggatgaccgtgggtccncaggctaccgaggaaaggggctaggaagtggggttacggaccgttaaagttaaaaggtagaaacgtggagtgggtacgggacaacgacgactacgctgccaaccggtagaaacgcagtactttacccgatctacgaaagacgtatagtaattaccgaaaacgtaacacgtacttctttaacaaacaaattcgaactacaacgaccctaaaacggaaaaaccgaggaaccgtaacacggtaccgttaggtaaacttacgtacgtaaacccgaacggaaagggaaacgagtacttaagtttaataagtagtaaattacggttaggttagttaacgttctttaaacgg

SEQ ID NO: 324873 - DNA, 679 bp, Homo sapiens
  misc_feature: GZ8MTXP02JXTR1.38.55.E11.1.454.CMB.2.raw
  modified_base (211)..(211): a, c, t, g, unknown or other
  misc_feature (211)..(211): n is a, c, g, or t
  modified_base (217)..(217): a, c, t, g, unknown or other
  misc_feature (217)..(217): n is a, c, g, or t
  modified_base (272)..(272): a, c, t, g, unknown or other
  misc_feature (272)..(272): n is a, c, g, or t
  modified_base (443)..(443): a, c, t, g, unknown or other
  misc_feature (443)..(443): n is a, c, g, or t
tcagtcgatcacgtcacgaccggtgctcgatttagcactcgcacgttgggtttggggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaggcagctccaacnttgganataattttgctctggtaccagcagctcccaggacacgccccaaatcctcatttangaccataatacggccaccctcgagggtacttcctgaccgtattcctctcggctccgaaagttccgtggccaaccgtcacgcccaaccccgtggggaccatccgacccgggtcctaccgagaccgtgggggaaccagggcccgtaatttaacgtacgtggaccggtaaaacngtacggggaacttaacccgaaggtacctaggaaacgttggtaccgtttggggtcgcggttccggggagggaacgggtacccgagggtcctcgggaaccccgttccgtaacgggtaccgaacggacccccgtaaaggggtccccttacccggcccccccgttgggtaccctaacccgttccgtttcccggttcccccgtccccttcccgttaccgaaccgggtttcaacgttcccgg

SEQ ID NO: 324874 - DNA, 427 bp, Homo sapiens
  misc_feature: GZ8MTXP02FOE89.38.55.E11.1.454.CMB.2.raw
  modified_base (214)..(214): a, c, t, g, unknown or other
  misc_feature (214)..(214): n is a, c, g, or t
  modified_base (325)..(325): a, c, t, g, unknown or other
  misc_feature (325)..(325): n is a, c, g, or t
  modified_base (328)..(328): a, c, t, g, unknown or other
  misc_feature (328)..(328): n is a, c, g, or t
  modified_base (334)..(334): a, c, t, g, unknown or other
  misc_feature (334)..(334): n is a, c, g, or t
  modified_base (337)..(338): a, c, t, g, unknown or other
  misc_feature (337)..(338): n is a, c, g, or t
  modified_base (344)..(344): a, c, t, g, unknown or other
  misc_feature (344)..(344): n is a, c, g, or t
  modified_base (421)..(427): a, c, t, g, unknown or other
  misc_feature (421)..(427): n is a, c, g, or t
tcagtcgatcacgtcacgaccggtgctcgatttagcactcgcacgttgggttggccgtattaaaagtgaaactgatggtgggacaacagactacgctgcacccgtgaaaggcagattcaccatctcaagagatgattcaacgaacacgctctttctacaaatgatcagcctgaaaaccgaggacacagccgtgtattactgtaccacagggaanagcagttattatgatagtagtggttatctgtactactacggtatggacgtcgtggggccaagggaccacgggtcattgtctccccagcctccaccaggccatcgtctcccngcnccctcncanncactcncggggcacagcgcctggctcgcctggtcaaggactacttccacgtgatcgactgagcgggctggcaaggcgcatagnnnnnnn

SEQ ID NO: 324875 - DNA, 696 bp, Homo sapiens
  misc_feature: GZ8MTXP02H7L0F.38.55.E11.1.454.CMB.2.raw
  modified_base (267)..(267): a, c, t, g, unknown or other
  misc_feature (267)..(267): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggtattttccttgctgtcttaattttaaaaggtgtcagtgtgaggtgcagctggtggagtcgtgggggaggcgttgggaaagccgtgggggtcccttagactctctgtacngcctcgtggacttctacttttagttatcgtcctggtatcgtaccgtgggtcccgcgacggcctaccgaagggaaacggggcgtaggggaagttcggggtttacggtaccgttaaagttaaaaaggtagtaaaacgtggaagttggggtacggaacaaacgacggtaacctacgctcgaccgtaacccggtaaggaaacggcaacgtacttaccgaaacctagtactaacgaaagagtaatacgtaacttaaccgaaaacgaaccgtacctactttacctttaacaaacaaattcgaacttacgaaccgttacgaaaaccgaaaacccggacggaaaccaacgacgtaccgttaattaacttaccgtacgaaccgtaaacggaaaggaaacgagtactaagttaatagagtaagtagtagtgtttaatcg

SEQ ID NO: 324876 - DNA, 603 bp, Homo sapiens
  misc_feature: GZ8MTXP02IDDIC.38.55.E11.1.454.CMB.2.raw
  modified_base (379)..(379): a, c, t, g, unknown or other
  misc_feature (379)..(379): n is a, c, g, or t
  modified_base (577)..(577): a, c, t, g, unknown or other
  misc_feature (577)..(577): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctatttaaaggtgtccagtgtgaggtgcagctggtggagtctgggggaggcgttggggaaagccgtggggggtcccttaggactctcctgtacagcctctggattcacttttagttatgcctggatgacctgggtcccgcaggctccaggaaaggggctggaagtgggttcggccgtaattaaaagtgaaactgagtggtaggacaanagactacgctgaccaccgtaggaaacgctacgattcccaaacctatctacgaaagagaatgaacttacgaaacgaaccgacgtcttacctttactaaaccaaattcgatacaacgaccctaaaggaaaacccgaggaaccagacgtccgtagttactacgtacgtaccaaagacggaacgatacgtaagttaagttanagtataagtagttaggttaatttacg

SEQ ID NO: 324877 - DNA, 649 bp, Homo sapiens
  misc_feature: GZ8MTXP02JQV5V.38.55.E11.1.454.CMB.2.raw
  modified_base (262)..(262): a, c, t, g, unknown or other
  misc_feature (262)..(262): n is a, c, g, or t
  modified_base (317)..(317): a, c, t, g, unknown or other
  misc_feature (317)..(317): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttcctgctgctatttaaaaggtgtccagtgtgaggtgcagctggtggagtcgtgggggagcgttgggaaagccgtgggggtcccttagactctcctgtacngcctctggatttcgtacttttagttatgcccgttggatcgacctcggggtccccnccgaggctaccgaagggaaacggggctagggaagttggggttaggaccgttaagttaaaacgtcgaaaacgtgacgtaggtacggaacaacgagactacgcgtcgccacccgtagaaacgcagtacttaccaaccctatacgacgaaagagtatagtacgttacaaacgaacacgtccttacgtttactaaaacctaaagttagactaccggaagtaccccgtaaagaaaaccgggacgaacaaccgaagtcccgtaagtacttacgtacgtaacccgagaaagggacaggtaactagttaagtctagaagttagtaggttaccgttatacg

SEQ ID NO: 324878 - DNA, 612 bp, Homo sapiens
  misc_feature: GZ8MTXP02J2P9D.38.55.E11.1.454.CMB.2.raw
  modified_base (308)..(308): a, c, t, g, unknown or other
  misc_feature (308)..(308): n is a, c, g, or t
  modified_base (378)..(378): a, c, t, g, unknown or other
  misc_feature (378)..(378): n is a, c, g, or t
  modified_base (427)..(427): a, c, t, g, unknown or other
  misc_feature (427)..(427): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtcgtgggggaggcgttgggaaagccgtgggggtcccttagactctctgtacagcctctggattcacttttagtatgcctggatgaccgtgggtccnccgaggctaccgaggaaaggggctagggaagttggggttggaccgttaataaaagtgaaactgatcgggnggacacagactacgctgccaccgtgaaagcagatcgacatctacgaagngtatgaacttacgaaacgaactcgtcttacgtttacaacaaattcgactacgaacgacctacggaaaaccgcggaacacgaacgtccgttagttaaccgttacgcgtaacccgaagtaacggggaaagacgtacttaaaggttaattaacgtgtaaacgttaggtagttacggtttaattaccgg

SEQ ID NO: 324879 - DNA, 640 bp, Homo sapiens
  misc_feature: GZ8MTXP02J1HNC.38.55.E11.1.454.CMB.2.raw
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtcgtgggggaggcgttgggaaagccgtgggggtcccttagactctctgtacagcctcgtggattctacttttagtatgctggatgaccgtggtccgcagctccgaggaagggctggagtgggtgacgtaataaagtagaaactgagtagggtggacaacgagactacgcgtcgccacccggtagaaggcaagacttcaacctagtactacgaaagtagatagacttacgaaacgaacaccgtacttacgtttacaactaaaatcaattccgagaccctaaacggaaaaaccgacggtaaaccaaccgtaggacccgttaagtaacgttaaccgtacggaaaccccgaaacggaaggggaaaccgaagtaccgtaaagtttaagttaaagtaggtaaattaaggttacggttaggtttaactttaacgg

SEQ ID NO: 324880 - DNA, 521 bp, Homo sapiens
  misc_feature: GZ8MTXP02HNY3G.38.55.E11.1.454.CMB.2.raw
  modified_base (245)..(245): a, c, t, g, unknown or other
  misc_feature (245)..(245): n is a, c, g, or t
  modified_base (259)..(259): a, c, t, g, unknown or other
  misc_feature (259)..(259): n is a, c, g, or t
  modified_base (356)..(356): a, c, t, g, unknown or other
  misc_feature (356)..(356): n is a, c, g, or t
  modified_base (509)..(521): a, c, t, g, unknown or other
  misc_feature (509)..(521): n is a, c, g, or t
tcagtcgatcacgtcacgaccggtgctcgatttagcactcgcacgttgggttggccgtattaaaagtgaaactgatggtgggacaacagactacgctgcacccgtgaaaggcagattcaccatctcaagagatgattcaacgaacacgctctttctacaaatgatcagcctgaaaaccgaggacacagccgtgtattactgtaaccacgagggaagagactagttatatgatagtagtggttatntgtactactaggtntggacgtcgtggggccaagggaccacgggtctattcgtcctccccgacgccctccaccgaacgggcccctactccggtcccttcccccgtcggcccncccctccctaccaacgacgccaccgtcggtccgggggccacgacggccggcccgtgggcctcggccgttcgggtaccaaacgggaccttaccgtccgacgttcgactccggtaactgggacggcgggtcgtgggaccgaagggccgcagtagnnnnnnnnnnnnn

SEQ ID NO: 324881 - DNA, 423 bp, Homo sapiens
  misc_feature: GZ8MTXP02JLVA1.38.55.E11.1.454.CMB.2.raw
  modified_base (180)..(180): a, c, t, g, unknown or other
  misc_feature (180)..(180): n is a, c, g, or t
  modified_base (199)..(199): a, c, t, g, unknown or other
  misc_feature (199)..(199): n is a, c, g, or t
  modified_base (213)..(213): a, c, t, g, unknown or other
  misc_feature (213)..(213): n is a, c, g, or t
  modified_base (324)..(324): a, c, t, g, unknown or other
  misc_feature (324)..(324): n is a, c, g, or t
  modified_base (334)..(334): a, c, t, g, unknown or other
  misc_feature (334)..(334): n is a, c, g, or t
  modified_base (339)..(339): a, c, t, g, unknown or other
  misc_feature (339)..(339): n is a, c, g, or t
  modified_base (344)..(344): a, c, t, g, unknown or other
  misc_feature (344)..(344): n is a, c, g, or t
  modified_base (388)..(388): a, c, t, g, unknown or other
  misc_feature (388)..(388): n is a, c, g, or t
  modified_base (418)..(423): a, c, t, g, unknown or other
  misc_feature (418)..(423): n is a, c, g, or t
tcagtcgatcacgtcacgaccggtgctcgatttagcactcgcacgttgggttggccgtattaaaagtgaaactgatggtgggacaacagactacgctgcacccgtgaaaggcagattcaccatctcaagagatgattcaacgaacacgctctttctacaaatgatcagcctgaaaaccgngacacagccgtgtattacngtaccacagggaanagcagttatatgatagtagtgttatctgtactactacggtatggacgtctggggccaagggaccacggtcattgtctccccagccctcaccagggcccatcggtctccccnggcaccctcncagancactncggggcacagcggccctgggctgcctggcaaggctactccagtnatcgactgagcggctggcaaggcgcatagnnnnnn

SEQ ID NO: 324882 - DNA, 545 bp, Homo sapiens
  misc_feature: GZ8MTXP02HO9F4.38.55.E11.1.454.CMB.2.raw
  modified_base (307)..(307): a, c, t, g, unknown or other
  misc_feature (307)..(307): n is a, c, g, or t
  modified_base (349)..(349): a, c, t, g, unknown or other
  misc_feature (349)..(349): n is a, c, g, or t
  modified_base (530)..(530): a, c, t, g, unknown or other
  misc_feature (530)..(530): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctatttaaaaggtgtccagtgtgagtgcagctggtggagtctgggggaggcttggggaaagccgtggggggtcccttagactctcctgtacagcctctggattcacttttagttatgcctggatgacctgggtccncaggctccaggaaaggggctggaatgggtggcgtataaaagngaaactgatggtagggacaacagactacgctgcaccgtgaaagcagattcacatctacaagagatgaattacaaacgaaacacgctactttactaacaaaatgaatacaagtcctaagaaaaaccgaggacaacagaccgtagtaactactagtaaccagaacggacgagactagtaatanagatagagtgtatcg

SEQ ID NO: 324883 - DNA, 640 bp, Homo sapiens
  misc_feature: GZ8MTXP02I5U2M.38.55.E11.1.454.CMB.2.raw
  modified_base (264)..(264): a, c, t, g, unknown or other
  misc_feature (264)..(264): n is a, c, g, or t
  modified_base (269)..(269): a, c, t, g, unknown or other
  misc_feature (269)..(269): n is a, c, g, or t
  modified_base (504)..(504): a, c, t, g, unknown or other
  misc_feature (504)..(504): n is a, c, g, or t
  modified_base (549)..(549): a, c, t, g, unknown or other
  misc_feature (549)..(549): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctatttaaaggtgtccagtgtgaggtgcagctggtggagtcgtgggggaggcgttgggaaagccgtgggggtcccttaggactctcctgtacngcctntggtattctactttagttatcgcctggatgtaccgtggtccgcaggcctaccgaggaagggctaggaagttggggtcggtaccgtaagttaaaaggtagaaactggagtcgggtaggaactaacgagtactaccgctcgccaacccggtagaaacggcaaggtacttaccacctataccctagaaaggagtaacgtagtaacttaaccaacgaaaccacgtcctttacctttaanaaaccgtaaatcgtaaactcgtaacgaccgtaaacgaaaaccggnggaaacacgaacggtcctaggtacttactacgaaacccaaggtagggaacacgataaggttaatagagtagttagagtttcggtacttacg

SEQ ID NO: 324884 - DNA, 624 bp, Homo sapiens
  misc_feature: GZ8MTXP02G1UWZ.38.55.E11.1.454.CMB.2.raw
  modified_base (305)..(305): a, c, t, g, unknown or other
  misc_feature (305)..(305): n is a, c, g, or t
  modified_base (353)..(353): a, c, t, g, unknown or other
  misc_feature (353)..(353): n is a, c, g, or t
  modified_base (413)..(413): a, c, t, g, unknown or other
  misc_feature (413)..(413): n is a, c, g, or t
  modified_base (418)..(418): a, c, t, g, unknown or other
  misc_feature (418)..(418): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctatttaaaaggtgtccagtgtgaggtgcagctggtggagtcgtgggggaggcttgggaaagccgtggggggtcccttagactctcctgtacagcctctggattcacttttagtatgcctggatgactggtccncaggctccgaggaaaggggctggaagtgggttggccgtaattaaaagngaaaactgatcggtaggacaacgagactacgctgcaccgtgaaagcagatcacatctaanaaganatagatacaaacgaacacgtcttacttactaaacgaaatgaactacgaacgtaaccgtaaacgaaaacccggagaaaccaacgtaacgtaccgttaagttaaacttaaccgtaacgtaaaccgaaacggaaacggggaaacgtaacgtaacgttaaagttaacgttaagtacgtaagttaaggttaaggtttaggtttaactaccg

SEQ ID NO: 324885 - DNA, 629 bp, Homo sapiens
  misc_feature: GZ8MTXP02I1YV7.38.55.E11.1.454.CMB.2.raw
  modified_base (379)..(379): a, c, t, g, unknown or other
  misc_feature (379)..(379): n is a, c, g, or t
  modified_base (410)..(410): a, c, t, g, unknown or other
  misc_feature (410)..(410): n is a, c, g, or t
  modified_base (485)..(485): a, c, t, g, unknown or other
  misc_feature (485)..(485): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcgttgggaaagccgtgggggtcccttaggactctcctgtacagcctctggattcacttttagtatgcctggatgacctggtccgcaggctccgaggaaagggctggaagtgggttgccgtattaaagtgaaactgatggtggacaacagactacgntgcaccgtgaaagcagatcacatcacaaganatagattacaacgaacacgcttactttacctaacaaaattgaaacttcgaacgaccccgtaggaaaaaccccggngggaaaaccacgaaacggtcccgttaggttaaacgtttaacctacggttaaaccccgaaacggaaacgggggtaaaacgaacgtacgttaaagtttaagttaacgttaacgtaacgttagggtttacggttacggtttaactcg

SEQ ID NO: 324886 - DNA, 574 bp, Homo sapiens
  misc_feature: GZ8MTXP02GV375.38.55.E11.1.454.CMB.2.raw
  modified_base (306)..(306): a, c, t, g, unknown or other
  misc_feature (306)..(306): n is a, c, g, or t
  modified_base (351)..(351): a, c, t, g, unknown or other
  misc_feature (351)..(351): n is a, c, g, or t
  modified_base (454)..(454): a, c, t, g, unknown or other
  misc_feature (454)..(454): n is a, c, g, or t
  modified_base (483)..(483): a, c, t, g, unknown or other
  misc_feature (483)..(483): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctatttaaaaggtgtccagtgtgaggtgcagctggtggagtctgggggaggcttgggaaagccgtggggggtcccttagactctcctgtacagcctctggattcacttttagtatgcctggatgacctgggtccncaggctccaggaaagggctggaagtgggtggaccgtattaaaagngaaaactgatggtgggacaacgagactacgctgccaccgtagaaaggctaagattcaaccatctcaaagagtatagattacaaacgacacgcttacttctaanaaatgatacgagaccctagaaaaacccgnggaacacgacgtccgtagttaacttacctagacccaaacgaacgggaacgacgagtaattaagttaatagtaatagtagtaggtttactag

SEQ ID NO: 324887 - DNA, 564 bp, Homo sapiens
  misc_feature: GZ8MTXP02G1RP0.38.55.E11.1.454.CMB.2.raw
  modified_base (217)..(217): a, c, t, g, unknown or other
  misc_feature (217)..(217): n is a, c, g, or t
  modified_base (277)..(277): a, c, t, g, unknown or other
  misc_feature (277)..(277): n is a, c, g, or t
  modified_base (324)..(324): a, c, t, g, unknown or other
  misc_feature (324)..(324): n is a, c, g, or t
  modified_base (339)..(339): a, c, t, g, unknown or other
  misc_feature (339)..(339): n is a, c, g, or t
  modified_base (545)..(545): a, c, t, g, unknown or other
  misc_feature (545)..(545): n is a, c, g, or t
tcagtcgatcacgtcacgaccggtgctcgatttagcactcgcacgttgggtttggggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaggcagctccaacattgganattaattttgtctcctggtaccagcagctcccaggaacacgcccccaaatcctcatttangaacccataactaggccgacccctcagggacttcctgaccgtattcncgtggctccaagtcnggcacgtcacgccaccgtggcatccgaccggcctccagacgtgggggacgacggcccgtattactacgtggacggaacagtcgggaactaccgagtactagaaagtcgtacgttggggtacgtcgtcggggtaggacggtaccgagggtctcggaccgtcgtaggtcacgccgaggctcgcccctcggtccacgtctcgttccccncctctcacgtcgacgtccg

SEQ ID NO: 324888 - DNA, 582 bp, Homo sapiens
  misc_feature: GZ8MTXP02FJCMS.38.55.E11.1.454.CMB.2.raw
  modified_base (481)..(481): a, c, t, g, unknown or other
  misc_feature (481)..(481): n is a, c, g, or t
  modified_base (539)..(539): a, c, t, g, unknown or other
  misc_feature (539)..(539): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcgttgggaaagccgtggggggtcccttagactctcctgtacagcctctggattcacttttagtatgcctggatgacctgggtccgccaggctccgaggaaggggctggaagtgggttggcgtattaaaagtgaaactgatggtggacaacagactagctgcaccgtgaaaggcagatcacatctacaagagatgacttacaaacgaacacgcttactttacaactaaatgaacttcaagtccctaaggaaaaacccgnggaaaccaacgacggacccgttagtaacttacgtacgtaacccaacgaacggggaaanacggctaaggttaattagtaggattaggtagtggttattacgg

SEQ ID NO: 324889 - DNA, 579 bp, Homo sapiens
  misc_feature: GZ8MTXP02J5FFM.38.55.E11.1.454.CMB.2.raw
  modified_base (262)..(262): a, c, t, g, unknown or other
  misc_feature (262)..(262): n is a, c, g, or t
  modified_base (353)..(353): a, c, t, g, unknown or other
  misc_feature (353)..(353): n is a, c, g, or t
  modified_base (389)..(389): a, c, t, g, unknown or other
  misc_feature (389)..(389): n is a, c, g, or t
  modified_base (458)..(458): a, c, t, g, unknown or other
  misc_feature (458)..(458): n is a, c, g, or t
  modified_base (495)..(495): a, c, t, g, unknown or other
  misc_feature (495)..(495): n is a, c, g, or t
tcagtcgatcacgtcacgaccggtgctcgatttagcactcgcacgttgggtttgggagatctgggagaggagccccagccttgggattcccaagtgttttcattcagtgatcaggactgaacacagagactcaccatggagtttgggctgagctggatttcctgctgctatttaaaggtgtccagtgtgagtgcagctggtggagtcgtggggagcgttgggaaacgccgtgggggtcccttagactctcctgtacagcctntggtattcactttaggtatgcctggatgacctgggtccgccaggctccgaggaaaggggtctaggaagtggttaggtccgtaattaaacgngaaacgtgagttggagggacaacactcacgcgtcgngaccgtcgagagacatctacactagtcaagagatagacttacacgaaacactactccttattccgaatnactacagacgacaaccgaacgtacgacttacgacgtntacggttactacgtaacgacgacgaacgtacgtagaccgtttaataggttattaccgtaagtaccggtttagttagttttaacg

SEQ ID NO: 324890 - DNA, 602 bp, Homo sapiens
  misc_feature: GZ8MTXP02F3P9V.38.55.E11.1.454.CMB.2.raw
  modified_base (359)..(359): a, c, t, g, unknown or other
  misc_feature (359)..(359): n is a, c, g, or t
  modified_base (381)..(381): a, c, t, g, unknown or other
  misc_feature (381)..(381): n is a, c, g, or t
  modified_base (429)..(429): a, c, t, g, unknown or other
  misc_feature (429)..(429): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttcctgctgctatttaaaggtgtccagtgtgaggtgcagctggtggagtctgggggaggcgttgggaaagccgtgggggtcccttagactctcctgtacagcctcgtggattcacttttagtatgcctggatgacctgggtccgccgaggcctccgaggaaaggggctaggaagtgggttggaccgtaagttaaaagngaaactgagtggtagggacaanagactacgctgccacccgtagaaacgcagacttcgaacctatccctanaaagtagatagacttacgaaacgaacacgtcttactttacaacaatgattcagacccgtaagaaaacccgaggaaccacgacgaccgtacgtaattactcggaaaccaacggaacgggaagtacgacttaaggttaattaagtagtaattaagtacggttagtttacgttacg

SEQ ID NO: 324891 - DNA, 496 bp, Homo sapiens
  misc_feature: GZ8MTXP02H3Q4M.38.55.E11.1.454.CMB.2.raw
  modified_base (350)..(350): a, c, t, g, unknown or other
  misc_feature (350)..(350): n is a, c, g, or t
  modified_base (444)..(444): a, c, t, g, unknown or other
  misc_feature (444)..(444): n is a, c, g, or t
  modified_base (484)..(496): a, c, t, g, unknown or other
  misc_feature (484)..(496): n is a, c, g, or t
tcagtcgatcacgtcacgaccggtgctcgatttagcactcgcacgttgggttggccgtattaaaagtgaaactgatggtgggacaacagactacgctgcacccgtgaaaggcagattcaccatctcaagagatgattcaacgaacacgctctttctacaaatgatcagcctagaaaaaccgaggacacagccgtgtattactgtaccacgaagggaagagctaagttatatgatagtagtggttatctagtactatacggtatggacgtcgtggggaccaaggggaccacggtcattcgtcctccccagcccctacaaccgaacgggcccagtcccggtccttcccccgngccctaccctcctacaagcgccaccgtcgcggggacacgcgccggcccgtgggcctcgccgtaggaccgaaacggtactaccgtcacgtgtacncgacgtggacggcggtcgtaggacgaaggccgagtagagnnnnnnnnnnnnn

SEQ ID NO: 324892 - DNA, 660 bp, Homo sapiens
  misc_feature: GZ8MTXP02GGJ3B.38.55.E11.1.454.CMB.2.raw
  modified_base (186)..(186): a, c, t, g, unknown or other
  misc_feature (186)..(186): n is a, c, g, or t
  modified_base (309)..(309): a, c, t, g, unknown or other
  misc_feature (309)..(309): n is a, c, g, or t
  modified_base (554)..(554): a, c, t, g, unknown or other
  misc_feature (554)..(554): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctattttaaaaggtntccagtgtgaggtgcagctggtggagtcgtgggggaggcgttgggaaagccgtggggggtcccttaggactctcctgtacagcctctggattcacttttagtatgcctggatgacctggtccncgaggctccgaggaaaggggctagggaagttggggttacggaccggtttaaagtttaaaaacggtgtaaaacgtggtaagtggggtaggggaaacaaacgaaggacttaaccgcgtcgaccgaaaccccggtagaaaaacgggccaaggtacttccaaaccattccagaaagagatagacttacaaacgtacacgcttaactttcaaacgtaaattgaatacgaagaccctaaacggaaaaccgnggaaacaccgagtacccgttagttacttaactcggtaaaccaaacggtaggggaacaggactaagtttaagtagtacgtagtaaggtttagttaggtttacttacg

SEQ ID NO: 324893 - DNA, 640 bp, Homo sapiens
  misc_feature: GZ8MTXP02JJ3TT.38.55.E11.1.454.CMB.2.raw
  modified_base (457)..(457): a, c, t, g, unknown or other
  misc_feature (457)..(457): n is a, c, g, or t
  modified_base (534)..(534): a, c, t, g, unknown or other
  misc_feature (534)..(534): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctatttaaaggtgtccagtgtgaggtgcagctgggtggagtcgtgggggaggcgttgggaaagccgtggggggtcccttagactctcctgtacagcctcgtggattctacttttagttatgcctggatgaccgtgggtcccgccgaggctccgagggaaaggggctggaagtggggttcggaccggttaagttaaaaggtgtaaaactggagtcggggtagggacaacgagactacgctgccacccgtagaaacggcaaggtacttcaccctatactacaaggtanatagaacttaccgaaacgaaccacgtccttactttacaaacctaaattcgactcaacgaccgtaacgaaaacccggngaaaccacgacggtaccgtagttaacttacctcggtaaaccccagaagggaaacgtacggacttaaggtttaataagtagtaagtaggtacgtttggttatttacg

SEQ ID NO: 324894 - DNA, 585 bp, Homo sapiens
  misc_feature: GZ8MTXP02IYZ5D.38.55.E11.1.454.CMB.2.raw
  modified_base (324)..(324): a, c, t, g, unknown or other
  misc_feature (324)..(324): n is a, c, g, or t
  modified_base (347)..(347): a, c, t, g, unknown or other
  misc_feature (347)..(347): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttcctgctgctatttaaaggtgtccagtgtgaggtgcagctggtggagtcgtggggaggcgttgggaagccgtgggggtcccttagactctcctgtacagcctctggattctactttagtatgcctggatgaccgtgggtccgcacggctccgaggaagggcnggaagtgggtgcgtaagtaaagngaactgatcgggagacaagagactacgctgccaccgtagaaacgcagacttcgaccatctacaaagacgatagtactacgaaacgaaccaccgtcttacttactaacctaaatgactcgaacgaccgtaagaaaaccgacggaaccacgacgtccgtataacttacgacgtaaccgaacggttaaggaacgacgtaactaagttaagtagtagtaactagttaggtcggttaattacg

SEQ ID NO: 324895 - DNA, 563 bp, Homo sapiens
  misc_feature: GZ8MTXP02HFYPE.38.55.E11.1.454.CMB.2.raw
  modified_base (410)..(410): a, c, t, g, unknown or other
  misc_feature (410)..(410): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctatttaaagtgtccagtgtgaggtgcagctggtggagtcgtgggggaggcgttgggaaagccgtggggggtcccttagactctcctgtacagcctctggattcactttagtatgcctgatgacctggtccgcaggctccgaggaagggctggagtggtgacgtataaagtgaactgatggtggacaacgagactacgctcgaccaccgtagaaacgcagattccacgatctacaaganagtagattacaacgactacgcttacttactaactaaactgaatccgaatccgtaaacgaaaaccggagaacgaccgagacgtagttactacgtgtaaccacgaaggaacgacgtaacagttaagtagtagaagtagtacgtagtttacttagg

SEQ ID NO: 324896 - DNA, 632 bp, Homo sapiens
  misc_feature: GZ8MTXP02FW36B.38.55.E11.1.454.CMB.2.raw
  modified_base (431)..(431): a, c, t, g, unknown or other
  misc_feature (431)..(431): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctattttaaaggtgtccagtgtgaggtgcagctggtggagtcgtgggggaggcgttgggaagccgtgggggtccttagactctcctgtacagcctctggattcacttttagtatgcctggatgaccgtgggtccgccgaggctccgaggaaaggggctaggaagtggggttggaccgtaagttaaaagtagaaactgagtggtaggacaagagactacgctgaccacccggtagaaacgcagatccaacatctacaaganatagaacttacaaacgaacacgtcttacttactaaactaaatcgacttacgaagtacccgtaaggaaaaccggacgaaccaacgacgtacccgttaggtaaactttacgtacggtaacccaaacgggaaacggggtaagaacgacgttaagtttaagttaagtacggtaagtaggtttaacggttaggtttaactttaccg

SEQ ID NO: 324897 - DNA, 563 bp, Homo sapiens
  misc_feature: GZ8MTXP02GKB7N.38.55.E11.1.454.CMB.2.raw
  modified_base (308)..(308): a, c, t, g, unknown or other
  misc_feature (308)..(308): n is a, c, g, or t
  modified_base (540)..(540): a, c, t, g, unknown or other
  misc_feature (540)..(540): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtcgtgggggaggcgttgggaagccgtgggggtcccttagactctcctgtacagcctctggattcacttttagttatgcctggatgacctgggtccnccaggctccgaggaaaggggctggaagtggggttggaccgtaattaaaagtgaaactgatgggtaggacaacgagactacgctgcacccgtgaaagcagatcaccatctacaagagatagattacaaacgaacacgctactttacaaacgaatgatacagacctagaaaaccgaggaacacgagccgtagtactacgtgtaacccagacgggaacacgacgtagttaagtanagtatagtaggttagttattacg

SEQ ID NO: 324898 - DNA, 682 bp, Homo sapiens
  misc_feature: GZ8MTXP02JK42S.38.55.E11.1.454.CMB.2.raw
  modified_base (536)..(536): a, c, t, g, unknown or other
  misc_feature (536)..(536): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgcttatttaaaaggtgtccagtgtgaggtgcagctggtggagtcgtgggggaggcgttgggaagccgtgggggtcccttagactctcctgtacagcctcgtggattctacttttagtatgcctggatgaccgtggtcccgcgacggctaccgagggaaacggggcgtaggtaaggtggggtttacggtaccggttaaagttaaaacggtagaaaacgtaggtagtgggtacgggaacaacgaagtaccgtacgcgtcgaccaacccggtagaaacggctacgacttaccgaaccctataccctaagaagaagtatagtaacttaccaaaaccggtaaccaccgtacctttacgtttaaccctaaanaaaagttcgtaactaccgaacgtaccgtaaacggaaaaccggcgaacacgaacgtacccgtattacttacgaccgtaaccgaacggaaagggaacgacgtagttaaattaagttatagtaacgttaagtcgtttaggtactttacg

SEQ ID NO: 324899 - DNA, 892 bp, Homo sapiens
  misc_feature: GZ8MTXP02IYWW3.38.55.E11.1.454.CMB.2.raw
  modified_base (317)..(317): a, c, t, g, unknown or other
  misc_feature (317)..(317): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggtattttccttgctgacttaatttaaaaggtgtccagtgtgaggtgcagcgtggtggagtcggtgggggaggcgttagggaaagcggtgggggtcccttagactctcctgtacacgcctcgtgtattctactttagttatcgcctgatgaccgtggtccncgagctacgaaggaaaggcgtaggaaggtggtacggtacgttaaagtaaaagtagtaaacgtagagtagggtaggacaaacgacgtacgtaccgctcgaccgaaaccggttaaggaaaacgcgtaaacgtaacttaccgaacctaacgttacctaaacgaaaggaacgttaacgtaggtttaaaaccgtaaacctaaaaacccggtaaacgaaacccgttacgtttaaacccgtttttaaaacccgtaaaaaacgtaaaacttacggttaaacctaaacccggtaaaacccggtaaaaccccgtaaaaaaccggggtaaaaaacccgggaaacggtaaaaccccgtaaaccggtaaaccgggttaaaacccggtttaaacgttttaaaaaccggttaaccccggtttaaaaccggtaaaaacccggtaaaacgggggttaaaaaccggggtaaaaacggttaaaaccggtaaacggttttaaaaacgtttaaaacgtttaaaacggttaaaacgggtttaaaccggtttaaaggttttaaaacgggtttaaacggttttaaaaccccgtttacgg

SEQ ID NO: 324900 - DNA, 594 bp, Homo sapiens
  misc_feature: GZ8MTXP02IT9W8.38.55.E11.1.454.CMB.2.raw
  modified_base (358)..(358): a, c, t, g, unknown or other
  misc_feature (358)..(358): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctattttaaaggtgtccagtgtgaggtgcagctggtggagtcgtgggggaggcgttgggaaagccgtgggggtcccttagactctcctgtacagcctctggattcactttagttatgcctggatgaccgtggtccgccaggcctccgaggaaagggcgtggaagtgggttggacgtaagttaaaagngaaactgagtggtaggacaacgagactacgctgccaccgtgaagcagatcaccatcacaagagatagattcaaacgacacgacttacttactaacaaattgaatcaagtaccgtaacgaaaaccggagaaccaacgaacgtccgtaagttaacgttacctacgtaaaccgtaaacgaaggggaacgagtacgtaagtttaactagtagtagtaggtagtttacggtttatttacgg

SEQ ID NO: 324901 - DNA, 721 bp, Homo sapiens
  misc_feature: GZ8MTXP02JMDG4.38.55.E11.1.454.CMB.2.raw
  modified_base (267)..(267): a, c, t, g, unknown or other
  misc_feature (267)..(267): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctatttaaaaggtgtccagtgtgaggtgcagctggtggagtcgtgggggagcttgggaaagccgtgggggtcccttagactctcctgtacagcctntggattcacttttagtatgcctggatgacctgggtccgcaggctccgaggaaacgggctaggatggggttggccgttaagtaaagtgaactggagtcggtagggacaacgagactacgctgaccgtaccggtagaaacggcaaggacttacgaaacctagttacctacgaaggttacgaattcgtaactttaccgaaaacgtaaccgtaccgtcctttacgtttaccctaaagaaaacgtttgaactttaccgaaggtccccgttaaaacgggaaaaccggacggtacccgtaacctaaacgggtcccgttaaggttaaacgtttaccgtaccggtaaacccggtaccggaaagggggttaaaacccgacggttaaccgttagtttaaaccgtttagtaacgggttaaaactttacggggttaaaggtttccgggtttaaaactttacccgggg

SEQ ID NO: 324902 - DNA, 593 bp, Homo sapiens
  misc_feature: GZ8MTXP02I7EZK.38.55.E11.1.454.CMB.2.raw
  modified_base (272)..(272): a, c, t, g, unknown or other
  misc_feature (272)..(272): n is a, c, g, or t
  modified_base (384)..(384): a, c, t, g, unknown or other
  misc_feature (384)..(384): n is a, c, g, or t
  modified_base (423)..(423): a, c, t, g, unknown or other
  misc_feature (423)..(423): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttcctgctgctattttaaaaggtgtccagtgtgaggtgcagctggtggagtcgtgggggaggcgttgggaaagccgtgggggtcccttagactctcctgtacagctctggnttcactttagttatgcctggatcgacctgggtccgcaggctccgaggaagggctaggaagtggggttgaccgtaattaaaagtgaaactgagtggtggacaacagactacgntcgcaccgtagaaagcagtatacacatcacaagataagnattacgaaacgaacacgcttactttacaacaaatgaatcgaagaccctaagaaaacccgtaggacacgacgtacgtagttaacttacgacgttaaaccccgaaagacgggggaaaacgaacgtagtaaagttaagttagtagtaaacgttaggttaggttacgttatacg

SEQ ID NO: 324903 - DNA, 562 bp, Homo sapiens
  misc_feature: GZ8MTXP02J1K28.38.55.E11.1.454.CMB.2.raw
  modified_base (183)..(183): a, c, t, g, unknown or other
  misc_feature (183)..(183): n is a, c, g, or t
  modified_base (218)..(218): a, c, t, g, unknown or other
  misc_feature (218)..(218): n is a, c, g, or t
  modified_base (516)..(516): a, c, t, g, unknown or other
  misc_feature (516)..(516): n is a, c, g, or t
  modified_base (541)..(541): a, c, t, g, unknown or other
  misc_feature (541)..(541): n is a, c, g, or t
  modified_base (544)..(562): a, c, t, g, unknown or other
  misc_feature (544)..(562): n is a, c, g, or t
tcagtcgatcacgtcacgaccggtgctcgatttagcactcgcacgttgggttggccgtattaaaaagtgaaactgatggtgggacaacagactacgctgcacccgtgaaaggcagattcaccatctcaagagatgattcaacgaacacgctctttctacaaatgatcagcctagaaaaaccgnggacacagccgtgtattactgtaccacgagggaanagcagttatatgatagtagtggttatctgtactactacggtatggacgtcgtggggccaagggaccacggtcattcgtcctacccccgagcccctcccaacccgaacggggcccctacgttcccgggtccctttcccccccgtggcccctacccccgttccctacccaaacgaccgccgtacccgtcggtccgggggacccacgacggcccggtcccgtggggcctcggcccgttcgggtaccaaacgggtccttaaccgttcccgacgtgacgtccggacgtggacgggcccggggngtaccggggactaacgggcgcaagngcnnnnnnnnnnnnnnnnnnn

SEQ ID NO: 324904 - DNA, 503 bp, Homo sapiens
  misc_feature: GZ8MTXP02I4ZT6.38.55.E11.1.454.CMB.2.raw
  modified_base (485)..(485): a, c, t, g, unknown or other
  misc_feature (485)..(485): n is a, c, g, or t
  modified_base (489)..(489): a, c, t, g, unknown or other
  misc_feature (489)..(489): n is a, c, g, or t
  modified_base (492)..(503): a, c, t, g, unknown or other
  misc_feature (492)..(503): n is a, c, g, or t
tcagtcgatcacgtcacgaccggtgctcgatttagcactcgcacgttgggttggccgtattaaaagtgaaactgatggtgggacaacagactacgctgcacccgtgaaaggcagattcaccatctcaagagatgattcaacgaacacgctctttctacaaatgatcagcctagaaaaccgaggacacagccgtgtattactgtaccacgagggaagagcagttattatgatagtagtgttatctgtactactacggtatggacgtcgtcggggaccaagggaccgacggtctagttcgtcctccccacgccctaccaccgaacgggccccagtccggtcccttcccccgtggccctaccccctcctaccaacgacgcctaccgtcggtcggggccaccgacggccggcccgtgggcctcggccgtcggtaccaacggtaccttacgtccacgtgactcgactggacggcgggcgtggcgaaggcncganagnnnnnnnnnnnn

SEQ ID NO: 324905 - DNA, 620 bp, Homo sapiens
  misc_feature: GZ8MTXP02HRI4Y.38.55.E11.1.454.CMB.2.raw
  modified_base (438)..(438): a, c, t, g, unknown or other
  misc_feature (438)..(438): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctatttaaaggtgtccagtgtgaggtgcagctggtggagtcgtgggggaggtcgttgggaaagccgtgggggtcccttagactctctgtacagtcctctggtattctacttttagttatcgcctggatgaccgtggtccgcagctccgaggaagggctaggagttgggtagtacggtaattaaagtagaaacgtgaagtgggtaggaacaagagactacgctcgaccaccgtagaaacgtcaagacttccgacagttccacaaaganactagaacttcaaaacgataccgtcttactttactaacgaattcgaatcgaacgtaccaaacggaaaaccgacggaacaacgagacccggttaatttacgtaacgtactaaacccgagaaaccgggaaacgagtactaaggtttaatagtaggtaattaccgggtatttaggttacttaacg

SEQ ID NO: 324906 - DNA, 582 bp, Homo sapiens
  misc_feature: GZ8MTXP02F9B6R.38.55.E11.1.454.CMB.2.raw
  modified_base (428)..(428): a, c, t, g, unknown or other
  misc_feature (428)..(428): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtcgtgggggaggcgttgggaagccgtgggggtcccttagactctcctgtacagcctctggattctacttttagtatgcctggatgaccgtcgggtccgccgaggcctaccgaaggaaggggctaggagtggggttggacgtaagttaaaagtagaaactgagtggtaggacaacagactacgctgccaccgtagaagcagatcacatctacaaganatagactacgaaaccgaacacgtcttactttacaataactgactacgacgtaccgtaacgaaaccgagaacacacgtacgtatactactagacctagacggaacgtacgtactaaggttaattagtagtaagtaggtacgttagtacgtttacg

SEQ ID NO: 324907 - DNA, 618 bp, Homo sapiens
  misc_feature: GZ8MTXP02GG97Q.38.55.E11.1.454.CMB.2.raw
  modified_base (282)..(282): a, c, t, g, unknown or other
  misc_feature (282)..(282): n is a, c, g, or t
  modified_base (501)..(501): a, c, t, g, unknown or other
  misc_feature (501)..(501): n is a, c, g, or t
  modified_base (590)..(590): a, c, t, g, unknown or other
  misc_feature (590)..(590): n is a, c, g, or t
  modified_base (601)..(601): a, c, t, g, unknown or other
  misc_feature (601)..(601): n is a, c, g, or t
tcagtcgatcacgtcacgaccggtgctcgatttagcactcgcacgttgggtttggggacaatcttcatcatgacctgctcccctctcctcctcacccttctcattcactgcacagggtcctgggcccagtctgtgttgacgcagccgccctcagtgtctgcggccccaggacagaagtcaccatctcctgctctggaggcagctccaaacattggatattaattttgtctcgtggtaccagcagctcccgaggaaccacgacccccaaactcctctatttancgaaccaataataggccgaccctcgaggacttccgtacgaccgtatttcctcgtcggcttaccgaagtccgtggaccacccggtcaaccgcccgtaccccgtgggaccctaactcccgacccgggccctaccgacgaccgtacgggggacacggtaccgtaatttacgtacgcgacggtaaacagtgggaactaaccgagactgaaatcgtagttgggngtcgtcgggtggaacggcgaggcgtcgaccgtcgaggtcgacgacccgtagccgtccgccccgtcgactcctaccgtccgttacccccncccgttacccncctacgtcgtactccgg

SEQ ID NO: 324908 - DNA, 645 bp, Homo sapiens
  misc_feature: GZ8MTXP02IW27K.38.55.E11.1.454.CMB.2.raw
  modified_base (301)..(301): a, c, t, g, unknown or other
  misc_feature (301)..(301): n is a, c, g, or t
tcagtcgatcacgtcacgaccggtgctcgatttagcactcgcacgttgggtttggggagatctgggagaggagccccagccttgggattcccaagtgttttcattcattgatcaggactgaacacagagactcaccatggagtttgggctgagctggattttccttgctgctattttaaaaggtgtccagtgtgaggtgcagctggtggagtcgtgggggagcgttgggaaagccgtgggggtcccttagactctcctgacagcctctggattcactttagtatgctgatgacctggtccncaggctccgaggaaacggggctaggaagtgggttacgcgtaagttaaaacgtgaaactgagtggtaggacaacgagactacgctcgccaccgtagaaaggcaagtacttcaacctatacctacgaagaacgtaagtgtaacgttacaaaaccggaactaccgtaccttactttaactaaacctaaattcgtaaactccgaacgacccgtaaacggaaaacccgagaaccgaccgacggtacgtacgttaacttacgtacgaaccgaacggaaacggaacgtagtaccgtaagtttaaactttaagaggttaaattaaggttacgttacgggtttaattaaccgg

SEQ ID NO: 324909 - DNA, 685 bp, Homo sapiens
  misc_feature: GZ8MTXP02HKMTR.38.55.E11.1.454.CMB.2.raw
  modified_base (471)..(471): a, c, t, g, unknown or other
  misc_feature (471)..(471): n is a, c, g, or t
  modified_base (509)..(509): a, c, t, g, unknown or other
  misc_feature (509)..(509): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctatttaaaggtgtccagtgtgaggtgcaggctgggtggagtcgtgggggaggcgttggggaagccggtgggggtcccttagactctcctgtacagcctctggactttctacttttagttatgcctggatcgaccgtgggtcccgcgaggcctaccggaagggaaggggctaggaacggttggggttcggtacgtaagttaaaagagtaaacgtggagtgggtagggaacaacgaagacgtacgctcgaccacccggtaaggaaacggccaagtaacttccaaacctataccacaagganatagtactaacaaacgacaccgtacttactttacaaanaagtgactacgaacgtacccgtaaaaggaaaacccgacggtaaacaaccgtacggtacccgttaagttaactttaccgtaacgtaaacccgtaaacggaaacggggaaagacgtacgttaaaggtttaaagttattaacggtaagttaaggttttacgtaggttttaactttacgg

SEQ ID NO: 324910 - DNA, 709 bp, Homo sapiens
  misc_feature: GZ8MTXP02GOPV2.38.55.E11.1.454.CMB.2.raw
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctatttaaaggtgtccagtgtgaggtgcagctggtggagtcgtgggggaggcgttgggaagccgtgggggtccttagctctcctgtacagcctcgtggtattctacttttagttatgcctggtatgacccgtgggtccgccgacggccgtaccgagggaaaggggcgtaggtaaggtggggttgggtaccggttaagttaaaaggtagtaaacgtagtaggtagggtagggaacaacgtacgaacgtacgcgtcggacccgtaacccggtaaggtaaaacgggacgtaacggtaacttaccaaaccctattaaccgtacgaaaaggaagtatacggaacttacgaaaaccgaactacgtcttaccctttactaaactaaattacgtactcgaaaccgacctaaaacggaaaaccggacggaaacaccgtaagtcccggttaacgtttactaaccgttcggtaaacccaaaggagggggaaaactacggattaacggtttaatagtaaggtctaaggtacggtttaacggtttactacg

SEQ ID NO: 324911 - DNA, 657 bp, Homo sapiens
  misc_feature: GZ8MTXP02HMUAS.38.55.E11.1.454.CMB.2.raw
  modified_base (262)..(262): a, c, t, g, unknown or other
  misc_feature (262)..(262): n is a, c, g, or t
  modified_base (267)..(267): a, c, t, g, unknown or other
  misc_feature (267)..(267): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctattttaaaggtgtccagtgtgaggtgcagctggtggagtcgtgggggaggcgttgggaagccgtgggggtcccttagctctcctgtacngcctntggtattctacttttagttatgcctggatcgaccgtggtcccgccgaggtccgtcgaagggaaggggcgtagggtaaggttggggttcgggtaccgttaagttaaaacggtagtaaacgtgtagtagggtacgggaactaacgacgtacgtacgctcggacctacccggtaggaaacgtacgaagtacttaccaacctagtacctacaaagagtatagattacgaaacgacacgtcttactttactaaacaagtcaatccgaaagaccctaaggaaaacccgagtacaacgacgtacgttacgtaacttactacgtaacccgaaaggtaaacgggaacgtagtaactaggtttaatagtaagttaacgtaggttacgttgtttaacttcg

SEQ ID NO: 324912 - DNA, 605 bp, Homo sapiens
  misc_feature: GZ8MTXP02I0FHJ.38.55.E11.1.454.CMB.2.raw
  modified_base (462)..(462): a, c, t, g, unknown or other
  misc_feature (462)..(462): n is a, c, g, or t
  modified_base (500)..(500): a, c, t, g, unknown or other
  misc_feature (500)..(500): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtcgtgggggaggcgttgggaagccgtgggggtcccttagctctctgtacagcctctggattctactttagtatgcctggatgaccgtgggtcccgccgaggcctaccgaggaaaggggctagggaacgtggggttaggaccgtaagttaaaagtgtaaactgacgtggtaggacaacagactacgctgccacccgtagaaacgcaagacttcaacccatctacaaagagatagacttacaaacgaacacncttacttacaactaatgatcaagaccctagaaaaccgnggaacaacgagacctagtaacttactacgtaaaccgacggaaaggtacgaacgtagttaaattaagttaagtagttaactaggttaacgtaggtttactttaacg

SEQ ID NO: 324913 - DNA, 631 bp, Homo sapiens
  misc_feature: GZ8MTXP02IPUHH.38.55.E11.1.454.CMB.2.raw
  modified_base (449)..(449): a, c, t, g, unknown or other
  misc_feature (449)..(449): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggtattttccttgctgctattttaaaaggtgtccagtgtgaggtgcagctgggtggagtcgtgggggaggcgttgggaagccgtgggggtcccttagactctactgtacagcctctggattctacttttagttatgcctggatcgaccgtgggtcccgccgaggcctaccgagggaaacggggctagggaagttggggttacggaccgttaagttaaaaggtgaaactgagtgggtaggacaacgagactacgctgccaccggtagaaagcagacttacaccatctacaaganatagaacttacaaacgaacacgtcttactttacaaactaaattgaactcgaacacccgtaaggaaaacccgagaaccacgtacgaccgttagttaacttaccgttacgaaccgaaacggaaagggaacgtacgtacttaagttaattagtagtaagttaaggttacgtttggttaatttacg

SEQ ID NO: 324914 - DNA, 587 bp, Homo sapiens
  misc_feature: GZ8MTXP02JCAMJ.38.55.E11.1.454.CMB.2.raw
  modified_base (416)..(416): a, c, t, g, unknown or other
  misc_feature (416)..(416): n is a, c, g, or t
  modified_base (478)..(478): a, c, t, g, unknown or other
  misc_feature (478)..(478): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctattttaaaaggtgtccagtgtgaggtgcagctgggtggagtcgtgggggaggcgttggggaaagccgtgggggtcccttagactctcctgtacagcctcgtggattctactttagttatgcctggatgaccgtgggtcccgccgaggcctccgagggaaaggggctaggaagtggggttcggaccgttaagttaaaagtgaaaactggagtgggtaggaacaacgagactacgctcgcaccgngaaacggcagactcaccatctacaagagagtgattacaaacgaacacgtcttacttactaanaaatgactcaagcctaaagaaacgacgacacgacgacctagtaactacgtacgtaccacgaagggacacgctagttaagttagtagtaatagtacgttaggttattacg

SEQ ID NO: 324915 - DNA, 525 bp, Homo sapiens
  misc_feature: GZ8MTXP02HYNBB.38.55.E11.1.454.CMB.2.raw
  modified_base (182)..(182): a, c, t, g, unknown or other
  misc_feature (182)..(182): n is a, c, g, or t
  modified_base (209)..(209): a, c, t, g, unknown or other
  misc_feature (209)..(209): n is a, c, g, or t
  modified_base (225)..(225): a, c, t, g, unknown or other
  misc_feature (225)..(225): n is a, c, g, or t
  modified_base (454)..(454): a, c, t, g, unknown or other
  misc_feature (454)..(454): n is a, c, g, or t
  modified_base (486)..(486): a, c, t, g, unknown or other
  misc_feature (486)..(486): n is a, c, g, or t
  modified_base (492)..(525): a, c, t, g, unknown or other
  misc_feature (492)..(525): n is a, c, g, or t
tcagtcgatcacgtcacgaccggtgctcgatttagcactcgcacgttgggttggccgtattaaaagtgaaactgatggtgggacaacagactacgctgcacctgtgaaaggcagattcaccatctcaagagatgattcaaacgaacacgctctttctacaaatgataagcctagaaaaccgnggacacagccgtgtattactgtaccanagggaagcagttatangatagtagtgttatctgtactactacggtatggacgtcgtggggaccaaagggaccaacgggtctaattgtcctccccagccctccaccaacgggcccacgtccggtccttaccccctcggcccaacccctccctaccaacgcgtccaccttcgccgggggcaccgacggccgccccgtggggcctcgccgtggtaccgaaagggtaccttaccttccgacgtagtacncggacctgacggcgggctggcgaaggccgtanagtagnnnnnnnnnnnnnnnnnnnnnnnnnnnnnnnnnn

SEQ ID NO: 324916 - DNA, 786 bp, Homo sapiens
  misc_feature: GZ8MTXP02JHH85.38.55.E11.1.454.CMB.2.raw
  modified_base (270)..(270): a, c, t, g, unknown or other
  misc_feature (270)..(270): n is a, c, g, or t
  modified_base (310)..(310): a, c, t, g, unknown or other
  misc_feature (310)..(310): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtcgtgggggaggcgttagggaagccgtgggggtcccttagactctcctgtacagcctntggattctactttagttatgcctggatgaccgtgggtccnccgaggctacccgaaggggaaacggggctaggtaagtggggttacgggtaccgttaagtttaaaaacggtgtaaaacgtggtaagttcggggtaggggaacaacgaacgacttaaaccgcgttcggacccgaaccccggtaaggaaaacgggcgaacggtaaactttacccaaaccctattacccgtaaccgaaaaggagtaaagttacggaactttaaccgaaaaccgtaaacgacccggttacctttaccgtttttaccaaaaccttaaaattgaaacttccgtaaccgacccgttaaacggaaaaacccgagggaaacccaccgaacggtacccgttaggttaaaactttaaccgttaccggtaaaaccccgaaacgggtaaaggggtaaaacgaaacgtaccgttaaaggttttaaattaaccgtaaggttaaacgtttaggttaacggtttagggttttaactttaaccgg

SEQ ID NO: 324917 - DNA, 574 bp, Homo sapiens
  misc_feature: GZ8MTXP02JWGYH.38.55.E11.1.454.CMB.2.raw
  modified_base (429)..(429): a, c, t, g, unknown or other
  misc_feature (429)..(429): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtcgtgggggaggcgttgggaaagccgtgggggtcccttagactctcctgtacagcctctggattcacttttagtatgcctggatgacctgggtcccgccgaggctccgaggaaaggggctaggaagtgggttggaccgtagttaaaagtgaaactgatggtaggacaacagactacgctgcaccgtagaaagcagacttcactatctcaagacagtnattacaaacgaaccacgtcctactttacaaactaatgatcagacctagaaaaccgaggaacacgagaccgtgtaacttacgttcgacccaagaagggaacgaggacaagtttaagtagttagataggtacgttaggttacttacg

SEQ ID NO: 324918 - DNA, 645 bp, Homo sapiens
  misc_feature: GZ8MTXP02FUBWK.38.55.E11.1.454.CMB.2.raw
  modified_base (256)..(256): a, c, t, g, unknown or other
  misc_feature (256)..(256): n is a, c, g, or t
  modified_base (279)..(279): a, c, t, g, unknown or other
  misc_feature (279)..(279): n is a, c, g, or t
  modified_base (589)..(589): a, c, t, g, unknown or other
  misc_feature (589)..(589): n is a, c, g, or t
tcagtcgatcacgtcacgaccggtgctcgatttagcactcgcacgttgggtttggggacaatcttcatcatgacctgctcccctctcctcctcacccttctcattcactgcacagggtccctgggcccagtctgtgttgacgcagccgccctcagtgtctgcggccccaggacagaaggtcaccatctcctgctctggaggcagctccaacattggagattaattttgtctcctggtaccagcagctcccaggacncgaccccaaactcctacatttangaccataagtaggccacccctgaggtacttcctagaccgtatttcctcgtggctaccaagtctggcaccgtcacgcccacccgtgggaccagtccacccggtcctaccgacgacgtgggggaccacgggccgtaatttactactggacggtaaacagtacggggaactacccgaagacctagtaaagtcggtcgtttgggggtcgtccggttacggggtaggaacggggtaccgagggccgttacggaccccgttacgtacggtccgaacggaccccgagggtccctccggaccccccgttgggtacccncccgttccgtccggtttcccccccgcccgttacccgtccgtacggtacgtacgtcg

SEQ ID NO: 324919 - DNA, 615 bp, Homo sapiens
  misc_feature: GZ8MTXP02GKBMQ.38.55.E11.1.454.CMB.2.raw
  modified_base (461)..(461): a, c, t, g, unknown or other
  misc_feature (461)..(461): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtcgtgggggaggcgttgggaagccgtgggggtcccttagactctcctgtacagcctctggattcacttttagttatgcctggatgacctggtccgcaggctccgaggaaaggggctaggaagtggggtcggaccgttaagttaaaagtgaaactggagtcgggtagggacaacagactacgctgaccacccgtagaaagtccagacttacaccattactacaaagagaagtacgattacaaacgaaacnccgtaccttctttactaaacaaactagactacgacgtacctaaggaaaacccgaggaaccacgacgtccgtagtacttacctagtacccgaagaggggaacacgacttaagttaagttaagtaggtattaacggtagttaggtttactttaacg

SEQ ID NO: 324920 - DNA, 545 bp, Homo sapiens
  misc_feature: GZ8MTXP02FI626.38.55.E11.1.454.CMB.2.raw
  modified_base (350)..(350): a, c, t, g, unknown or other
  misc_feature (350)..(350): n is a, c, g, or t
  modified_base (441)..(441): a, c, t, g, unknown or other
  misc_feature (441)..(441): n is a, c, g, or t
  modified_base (463)..(463): a, c, t, g, unknown or other
  misc_feature (463)..(463): n is a, c, g, or t
  modified_base (488)..(488): a, c, t, g, unknown or other
  misc_feature (488)..(488): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttgggaaagcctggggggtcccttagactctcctgtacagcctctggattcacttttagtatgcctggatgacctgggtccgccaggctccgaggaaggggctggaatgggtgccgtattaaaagngaaactgatggtgggacaacagactacgctgcaccgtgaaagcagatcaccatctacaagagatgattacaaacgacacgctacttacaanaatgatcagcctagaaaaccgngaaccacgagccgtagtaacttacngtaacccacgaagggaacgacgcaagtttaatatgatagtagttacggtattaccgg

SEQ ID NO: 324921 - DNA, 856 bp, Homo sapiens
  misc_feature: GZ8MTXP02JGNVX.38.55.E11.1.454.CMB.2.raw
tcagtcgatcacgtcacgaccggtgctcgatttagcactcgcacgttgggtttggggagagtctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtcgtgggggaggcgttaggggaaagccgtgggggtccccttagaccttcgtcctgtacagcctctggtattctactttagtatgcctggatgaccgtgggtcccgcgacggctaccgagggaaacggggcgtaggaagttggggttcggaccgttaaagttaaaacggtagtaaaacgtggaagtggggtagggaactaacgacgtacgtacgacgtcgacccgaacccggtaggaaaacggcgaacggtaacttcccaaaccctacgttaccttaacgaaaacgtagtaaagttacggtaactttaaccgaaaacccgtaaacgtacccggacctttttaaccgtttaaacccttaaaacctaaagtttacgggaaaccgtttccaaaacccgtaacccgttaaaacggggtaaaaaaacccccgggtagaaaaccccgaacgtaaacccggggtaccccgtttaagggtttaaaacctttaccccggtttaaacggaaaccccggttaaaacgtaaacggggggtaaagaaaaccccgggtttacgttaaaagggttttaaactttaacggtaaaacggtttaaaacgtttaagggggtttaaaaccccggttttaggtttaaacccggttttaaaccccg

SEQ ID NO: 324922 - DNA, 596 bp, Homo sapiens
  misc_feature: GZ8MTXP02JCN3A.38.55.E11.1.454.CMB.2.raw
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttcctgctgctattttaaaaggtgtccagtgtgaggtgcagctggtggagtcgtgggggaggcgttagggaagccgtgggggtcccgttagactctcctgtacagcctctggattctactttagttatgcctggatgaccgtcgggtccgccgagcgtccgagggaaaggggcgtaggaagtggggttgggaccgtaagttaaaagtgaaacgtgagtggtaggacaacagactacgctgccgaccgtagaagcagattcaccatcactaagagatcgaattacaaacgaacgactccttatttaccaaactaaaagttgactacgtaacgccgtaaagaaaacccggagaccagtacgccgttagtaacttacgtacgtaaccaaggaacggagaacgctaagttaagtatagattaagcgttagtacgtttac

SEQ ID NO: 324923 - DNA, 531 bp, Homo sapiens
  misc_feature: GZ8MTXP02IW8S2.38.55.E11.1.454.CMB.2.raw
  modified_base (512)..(531): a, c, t, g, unknown or other
  misc_feature (512)..(531): n is a, c, g, or t
tcagtcgatcacgtcacgaccggtgctcgatttagcactcgcacgttgggttggccgtattaaaagtgaaactgatggtgggacaacagactacgctgcacccgtgaaaggcagattcaccatctcaagagatgattcaacgaacacgctctttctacaaatgatcagcctagaaaaccgaggacacagccgtgtattactgtaccacagggaagagctagttatatgatagtagttggttatctgtactactacggtatggacgtcgtggggaccaagggacccacggtcaattcgtcctcccccagccctacccaccgaacggggccccatccggtccctttcccccccgtggccctaccccctcctaccgaagacgccaccgtcgtcgggggaccacgagccggcccgtgggctcggccctagggtccgaaaagggaccttacttacccgacgtcgtactccgtacgtcggacggcggggtcgtgggccgaaaggggccaccgagtagnnnnnnnnnnnnnnnnnnnn

SEQ ID NO: 324924 - DNA, 835 bp, Homo sapiens
  misc_feature: GZ8MTXP02J21F2.38.55.E11.1.454.CMB.2.raw
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctattttaaaaggtgtccagtgtgagtgcagctggtggagtcgtgggggaggcttgggaaagccgtggggggtcccttaggactctcctgtacagcctctggattcactttagttatgcctggatgacctgggtccgccagggcctccgaggaaagggggctaggaaacgttggggtttagggtacccggttaagtttaaaaacggtggtaaaaaccgtggaattggggtaggggaaccaaaccgaaggtaacccgttaaccggccgttgggaccctaaaccccccggggttagggaaaaacggggccaaacgggaatttttacccaaacccctaaacttacccgttaacccgaaaaacggtaaagggaatttacggggtaaaaccttttaccgaaaaaacccgggtaaaaccccctaaaccgggtaccctttaacccgtttttacccgtaaaacccgttaaaatttacggaacgtttacccaacggacccccgttaaacgggaaaaacccccggaaggggtaaacccaaccgaacgggtaccccggttaggttaaacttaccgttacgttaaacccgaccgtaaagggggaaacgaaggtacctaaggtttaaattagttaggaacgtttaacggttacggtttacgggtttaactttaccgg

SEQ ID NO: 324925 - DNA, 549 bp, Homo sapiens
  misc_feature: GZ8MTXP02IFD4S.38.55.E11.1.454.CMB.2.raw
  modified_base (373)..(373): a, c, t, g, unknown or other
  misc_feature (373)..(373): n is a, c, g, or t
  modified_base (404)..(405): a, c, t, g, unknown or other
  misc_feature (404)..(405): n is a, c, g, or t
  modified_base (408)..(408): a, c, t, g, unknown or other
  misc_feature (408)..(408): n is a, c, g, or t
  modified_base (410)..(410): a, c, t, g, unknown or other
  misc_feature (410)..(410): n is a, c, g, or t
  modified_base (412)..(413): a, c, t, g, unknown or other
  misc_feature (412)..(413): n is a, c, g, or t
  modified_base (415)..(415): a, c, t, g, unknown or other
  misc_feature (415)..(415): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctattttaaaaggtgtccagtgtgagtgcagctggtggagtcgtgggggaggcttgggaaagccgtgggggtccctaggactctctgtacagcctctggattcactttagtatgcctggatgacctggtccgcaggctccgaggaaggggctggaagtgggttggaccgttaagtaaaagtgaaactgatggtaggacaacngactacgctgcctaccgtgaagcagatcacnncananannanatacaacacactcttacttacaaacaatgactacgacaccgaagaaccgagactagacgtacgtaattactactacgtaaacaagaaggacgtacgtactaagttaagtacgtagtagtagtagttagttactg

SEQ ID NO: 324926 - DNA, 680 bp, Homo sapiens
  misc_feature: GZ8MTXP02FREHV.38.55.E11.1.454.CMB.2.raw
  modified_base (152)..(152): a, c, t, g, unknown or other
  misc_feature (152)..(152): n is a, c, g, or t
  modified_base (247)..(247): a, c, t, g, unknown or other
  misc_feature (247)..(247): n is a, c, g, or t
  modified_base (294)..(294): a, c, t, g, unknown or other
  misc_feature (294)..(294): n is a, c, g, or t
  modified_base (335)..(335): a, c, t, g, unknown or other
  misc_feature (335)..(335): n is a, c, g, or t
  modified_base (347)..(347): a, c, t, g, unknown or other
  misc_feature (347)..(347): n is a, c, g, or t
tcagtcgatcacgtcacgaccggtgctcgatttagcactcgcacgttgggtttggggacaatcttcatcatgacctgctcccctctcctcctcacccttctcattcactgcacagggtcctgggcccagtctgtgttgacgcagccgccctnagtgtctgccggccccaggacagaagtcaccatctcctgctcgtggagcagcctaccaatagttggaatattaattttcgtcctccgtggtaccngcacgcctacccgaaggaaccaccacccccaaactcctactatttancgaacctaataacgtacggccaccctgaacggtacttccgngaccgtatttcnccgtcggccttaccgaagtcgtacggacacccggtccacgacccctaccggtggaccctacgtccccgcccgtccctacgaacgtcgggtacggggaacgtcggacctagtttagtaccgtaggaacgtaactaggcggaaactacccgaagtactagtagtcggttcggtgggcgtacggttggggaggaaccgggtacgtcggccgtacggtacccgtacgtacgggaccgacggacccgacggtcccgttcccggcccccgttgtaaccctccgtttcccgtcccggtttccccctcccgttaccctacggtaccggtactacgtaccgg

SEQ ID NO: 324927 - DNA, 706 bp, Homo sapiens
  misc_feature: GZ8MTXP02GVD3S.38.55.E11.1.454.CMB.2.raw
  modified_base (264)..(264): a, c, t, g, unknown or other
  misc_feature (264)..(264): n is a, c, g, or t
  modified_base (579)..(579): a, c, t, g, unknown or other
  misc_feature (579)..(579): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggtattttccttgctgcttattttaaaggtgtccagtgtgaggtgcagctggtggagtcggtgggggagcgttagggaagccgtgggggtccttagactctctgtacngcctctggattctactttagttatgcctggatcgaccgtcggtccgcaggcctaccggaaggaaacggggctaggaaggttggggttcggaccggttaaagttaaaagtagtaaaacgtggtagtggggtaggaactaacgacgtaccgtacgcgtcggacccgaaccggtaggaaacgcaacgtacttacccaaaccgtattaccgtacgaaagtaagtattagtaacttaccgaaaacggtaaacaccgttacctttacctttaacctaaacgtaaattcgaacttacgaaccgtacctaaaggaaaacccgnggaaacccacgaacgtcccgttaagttaacttacgtacgtaaacccgaagggtaaagggaacgtaccgacgttaaagtttaagtaagtaggtaaagttagggttaagtttacgggttaatttaacgg

SEQ ID NO: 324928 - DNA, 662 bp, Homo sapiens
  misc_feature: GZ8MTXP02H5Y9Y.38.55.E11.1.454.CMB.2.raw
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgcttattttaaaggtgtccagtgtgaggtgcagcgtggtggagtcgtgggggaggcgttagggaagccgtgggggtcccttagacttctctgtacagccttcgtggattctactttagttatgcctggatgaccgtggtcccgcgaggcctacgaggaagggcgtggaagttggggttggaccggttaagttaaaacggagtaaacgtggaacgttgggtagggaacaaacgagtaactacgcttgacctaccggtaggaaacggactagacttaccgaacctactacctacaaagagtagttagaacttaaccgaaacgaaccacgtaactttccgtttaaactaaccgaaaattgtaacacgtaacgtaccgtaaaccgaaaaccggtacgaacaccgtaacgtacgtacgttacgtactacgtaacacggaaggacgacgtagtaagttaagttaagtagtaagttagttacgttagtttacgtttacg

SEQ ID NO: 324929 - DNA, 621 bp, Homo sapiens
  misc_feature: GZ8MTXP02IF60H.38.55.E11.1.454.CMB.2.raw
  modified_base (428)..(428): a, c, t, g, unknown or other
  misc_feature (428)..(428): n is a, c, g, or t
  modified_base (438)..(438): a, c, t, g, unknown or other
  misc_feature (438)..(438): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggtattttccttgctgactattttaaaaggtgtccagtgtgaggtgcagctgggtggagtcgtgggggaggcttgggaagccgtgggggtcccttagactctcctgtacagcctctgattcacttttgtatgcctggatgaccgtggtcccgccaggcctaccgaggaaaggggctagggtaagtggggttcggacgttaagttaaaacgtgaaaactgagtggtaggacaacgagactacgctcgccaccgtagaaagcagtacttcaccntcctacaagngatgaactacaaacgtaacacgtctacttttacaaacgtaaattgacactaacgcctaaacggaaaaccgagtaacccacaacgggtcccgttagttaacttaaccgaggtaaccccaaggaaacggggtaaacacgttacgtaagttaagtataagtagttaaggttacgttagttaactcg

SEQ ID NO: 324930 - DNA, 654 bp, Homo sapiens
  misc_feature: GZ8MTXP02FXXY5.38.55.E11.1.454.CMB.2.raw
  modified_base (427)..(427): a, c, t, g, unknown or other
  misc_feature (427)..(427): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggggaaagcctggggggtcccttagactctcctgtacagcctctggattcacttttagttatgcctggatgacctgggtccgccaggctccaggaaggggctggaagtgggttggccgtaagttaaaagtgaaacgtgagtggtaggacaagagactacggctgccacccggtagaaaggcaaggattcaacctatcctanaaagagatgacttacgaaacgaacaccgtacttacctttactaaactaaacgtagtacttaccaagtaccccctaaaggaaaaaaccccgacgggaaaacaacccgaaggtccccgttaagttaacttaacccgttagttaaccccgaaagaacgggggtaaacgaaggaccttaaggtttaatttagtaacggtaaatttacggttaagttacgggtttaataccg

SEQ ID NO: 324931 - DNA, 533 bp, Homo sapiens
  misc_feature: GZ8MTXP02FV84P.38.55.E11.1.454.CMB.2.raw
  modified_base (183)..(183): a, c, t, g, unknown or other
  misc_feature (183)..(183): n is a, c, g, or t
  modified_base (203)..(203): a, c, t, g, unknown or other
  misc_feature (203)..(203): n is a, c, g, or t
  modified_base (512)..(533): a, c, t, g, unknown or other
  misc_feature (512)..(533): n is a, c, g, or t
tcagtcgatcacgtcacgaccggtgctcgatttagcactcgcacgttgggttggccgtattaaaaagtgaaactgatggtgggacaacagactacgctgcacctgtgaaaggcagattcaccatctcaagagatgattcaaacgaacacgctctttctacaaatgataagcctagaaaaccgnggacacagccgtgtattacngtaccacagggaagagcagttattatgatagtgtgttatctgtactagtacggtatggacgtcgtgggacaagggaccgacggtcagttcgtcctccccacgcctcccaccgaacgggccctacgtccggtcccttcccccgtcggcccacccctccctaccaacgacgccaccgtcggtccggggccaccgacggccggtcccgcgggttttttccgcggtccgtcgggtaccgaacgtaccttaccgttaccgacgtagacgtcgacgtaggacggcgggcgtacgggacgaacggcgacgataggnnnnnnnnnnnnnnnnnnnnnn

SEQ ID NO: 324932 - DNA, 635 bp, Homo sapiens
  misc_feature: GZ8MTXP02G24AM.38.55.E11.1.454.CMB.2.raw
  modified_base (269)..(269): a, c, t, g, unknown or other
  misc_feature (269)..(269): n is a, c, g, or t
  modified_base (383)..(383): a, c, t, g, unknown or other
  misc_feature (383)..(383): n is a, c, g, or t
  modified_base (436)..(436): a, c, t, g, unknown or other
  misc_feature (436)..(436): n is a, c, g, or t
  modified_base (606)..(606): a, c, t, g, unknown or other
  misc_feature (606)..(606): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtcgtgggggagcgttgggaaagccgtgggggtcccttagactctcctgtacagcctntggattctacttttagtatgcctggatcgaccgtgggtccgccgagctccgaggaaaggggcgtggaagtgggtcggaccgttaagttaaaagtgaaactgagtggtaggacanagactacgctcgccaccgtagaaacgcaagtacttcaaccatactacaaaganatacgtacttaaccgaaacggtaaccaccgtctttacctttaactaaaccaaaagttgacttacgaaacgaccttaaacggaaaacccgagggaaccaacgacggtacccgtagttaacttaacgtcgtaaaccgacggaaaggggaacaagtacgttaagttaagttanagtacgttagtaggttagttacgtttacg

SEQ ID NO: 324933 - DNA, 597 bp, Homo sapiens
  misc_feature: GZ8MTXP02IUT69.38.55.E11.1.454.CMB.2.raw
  modified_base (276)..(276): a, c, t, g, unknown or other
  misc_feature (276)..(276): n is a, c, g, or t
  modified_base (495)..(495): a, c, t, g, unknown or other
  misc_feature (495)..(495): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggtattttccttgctgtacttaattttaaaaggtgtccagtgtgaggtgcagcgtggtggagtcgtgggggaggtcgtagggaagccgtgggggtcccttagactctcctgtacagcctntgtattctacttttagtatgcctgatcgaccgtcggccgcagctcgaggaagggctaggagtgggtgacgtaagtaaagtgaatgatggtaggaacaagagactacgctgccaccgtagaaacgcagtacttccaccgtatctacaaagatatatactacaaacgaacacgtcttactttacaactaaatgaactcgaacgtaccgtaacgaaaacggngaaaccacgtacgacgttagttaaactcgtacgtaccgaaaggaacggacgtactacgtaatttaatagtagtaagttagttacgttaggtttaactttacg

SEQ ID NO: 324934 - DNA, 767 bp, Homo sapiens
  misc_feature: GZ8MTXP02JLNVQ.38.55.E11.1.454.CMB.2.raw
  modified_base (267)..(267): a, c, t, g, unknown or other
  misc_feature (267)..(267): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctattttaaaaggtgtcagtgtgaggtgcagctggtggagtcgtgggggaggcgttgggaagccgtgggggtcccttagactctctgtacagcctntggattctactttagttatgccgtggactcgaccgtgggtcccgcgacggtccgtaccgaaggggaaacggggtcgtagggtaaggttggggtttacgggtaccggtttaaagttaaaaaggtaggtaaaacgtggtaagttacgggggtaacgggtaaaccgaaacgtaaggtaaccgttaaccggaccttcgggaccccgtaacccgggtaacgggaaaacggaccgtaaggtaacctttacccgaaccctaagttacccgtaaacgaaaggtagtaatacggtaacttaacccgaaaacgaaaccgtaccgtcctttacctttaacctaaactaaaacgtgaacttaccgaaacgaacccgtaaaggaaaacccggaggtaaaccaccgtaacggtacccgttaatttaacgttaccgacgtaaaccccgaaaggtaaggggaaacacgtaactaagtttaagtagtagtaagttaggtagtttagttacgttaacg

SEQ ID NO: 324935 - DNA, 555 bp, Homo sapiens
  misc_feature: GZ8MTXP02FENLH.38.55.E11.1.454.CMB.2.raw
  modified_base (306)..(306): a, c, t, g, unknown or other
  misc_feature (306)..(306): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttgggaaagcctggggggtcccttagactctcctgtacagcctctggattcacttttagtatgcctggatgacctgggtccnccaggctccaggaaaggggctggaatggggttggccgtagttaaaaagtgaaaactgatggtgggacaacagactacgctgcacccgtgaaaggcagattcaccatctcaaagagatgattacaaacgaacacgctactttctaacaaatgatcagccctagaaaacccgaggacacgagccgtagtacttactgtaaccacgaagggaaagagcaagttaattatagatagttaacgtggttattacg

SEQ ID NO: 324936 - DNA, 709 bp, Homo sapiens
  misc_feature: GZ8MTXP02F5ZD7.38.55.E11.1.454.CMB.2.raw
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgcttaattttaaaaggtgtccagtgtgaggtgcagctggtggagtcgtgggggaggcgtagggaagccggtgggggtcccttagactctctgtacacgcctctggtattctacttttagttatcgtcctggtatcgaccgtcggtcccgccgacggcctaccgaaggaaacggggtcgtagggtaaggttcggggttagggtaccggttaaagttaaaaggtagtaaaacgtaggtaggttacggggtacggaacgaaacgaaacgtaccgtaacggcgtcggacccgtaaacccgggtaaggaaaacggaccgtaagtaacgttacccaaacctactacctacgaaagaagattagaacttaacgaaaccgactaccgtctttaccttaacctaaataaactgaacttaccgaataacccgtaaacggaaaaccgagtacacgacgtacgtagttaaacttacgtactaaccgaaggtaacggaaacgacgtacgttagttaagttacgaagtagtacgttagttagtttaacttacg

SEQ ID NO: 324937 - DNA, 692 bp, Homo sapiens
  misc_feature: GZ8MTXP02HFAR0.38.55.E11.1.454.CMB.2.raw
  modified_base (662)..(662): a, c, t, g, unknown or other
  misc_feature (662)..(662): n is a, c, g, or t
tcagtcgatcacgtcacgaccggtgctcgatttagcactcgcacgttgggtttgggggagatctgggagaggagccccagccttgggattcccaagtgttttcattcagtgatcaggactgaacacagaggactcaccatggagtttgggctgagctggattttcctgctgctatttaaaggtgtccagtgtgagtgcagctggtggagtcgtgggggagcgttgggaagccgtgggggtccttagactctcctgtacagcctctggattcactttagtatgctggatgaccgtggtccgcaggctaccgagggaaacggggctagggtaagtggggtttacgggaccggttaaagttaaaaacggtcgtaaaacgtggaagtcggggtacgggaaccaaacgtacgactaccggctccggaccgaacccggtaaggaaacgggctaaggtacttacccaaccgtaatccgtaacgaaaggatactaggaacttaccgaaaacgtaaccaccgtactttacctttaactaaaccaaagtttcgaacttcgaactacccgtaaaggaaaacccggcggaaaccaacgtacggtacccgttaagttaaccttacggagtaaaccccgaacggaagggaaacgagtaccgttaaagttaagttanacgtaagtaggttagttaggtttacttacg

SEQ ID NO: 324938 - DNA, 600 bp, Homo sapiens
  misc_feature: GZ8MTXP02GK3G9.38.55.E11.1.454.CMB.2.raw
  modified_base (312)..(312): a, c, t, g, unknown or other
  misc_feature (312)..(312): n is a, c, g, or t
  modified_base (437)..(437): a, c, t, g, unknown or other
  misc_feature (437)..(437): n is a, c, g, or t
  modified_base (481)..(481): a, c, t, g, unknown or other
  misc_feature (481)..(481): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttcctgctgctattttaaaaggtgtccagtgtgaggtgcagctggtggagtcgtgggggaggcgttggggaaagccgtgggggtcccttaggactctcctgtacagcctgtggattctacttttagtatgcctggatgaccgtgggtcccnccgaggcctaccgaagggaaaggggctaggaagttggggttcggaccgttaattaaaaggtgaaaactggtatggggtaggacaagagactacgctgcaccggtagaagcagactcacatcctanaagacgatagactacaaacgacacgtcttacttacaacaagtanactacgacgaccgtaaacgaaacgagacacgtacgtacgtagttaactacgacgtaaaccgaggaacggacgacgtactaagttaagtagtaagtacgttaggtacgttcgttactacg

SEQ ID NO: 324939 - DNA, 648 bp, Homo sapiens
  misc_feature: GZ8MTXP02F0T7V.38.55.E11.1.454.CMB.2.raw
  modified_base (420)..(420): a, c, t, g, unknown or other
  misc_feature (420)..(420): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctaatttaaaaggtgtccagtgtgaggtgcagctggtggagtcgtgggggaggtcgttaggggaaacgtccgtggggggtcccttagactctcctgtaccagcctctggtacttctacgttttagttatgcctgatcgacctgggtcccgcacggctaccgagggaaagggcgtaggaagttgggtggaccgttaattaaaagtgaaatggagtcgggtaggacaacgagactaccgctgccaaccggngaaaacgcagtacttaccacctagtactacgaagaactatgaacttacgaaacgtaacaccgtacctttactttaacctaaaccaaactgtaataccgaagtaacccgaacgaaaaccgacggaaccacgacgtcgtagtacttacgtacgtacgaaacgtaacgggaactaacgtacgtaagttaattaagtacgtaagttaggttacgtttaggttacgtttaacg

SEQ ID NO: 324940 - DNA, 583 bp, Homo sapiens
  misc_feature: GZ8MTXP02FW05U.38.55.E11.1.454.CMB.2.raw
  modified_base (389)..(389): a, c, t, g, unknown or other
  misc_feature (389)..(389): n is a, c, g, or t
  modified_base (466)..(466): a, c, t, g, unknown or other
  misc_feature (466)..(466): n is a, c, g, or t
  modified_base (491)..(491): a, c, t, g, unknown or other
  misc_feature (491)..(491): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttcctgctgctattttaaaaggtgtccagtgtgaggtgcagctggtggagtcgtgggggaggcgttgggaaagccgtgggggtcccttagactctcctgtacagcctctggtattctacttttagtatgcctggatgaccgtgggtccgccaggcctccgaggaaaggggcgtaggaagtggggttggaccgtaagttaaaagtgaaactggagtgggtaggacaaanagacacgctcgcaccggtagaaacgcagatcaacatctacaagacgatgatacaaacgacacgcttacttactaaanaatgatacgacacctagaaaaccgnggaacagacgtaccgtagttactacgtacgaccaaagacgggtaaacacgtagttaagtaagtagtagtacgtagttagttacgttactacg

SEQ ID NO: 324941 - DNA, 715 bp, Homo sapiens
  misc_feature: GZ8MTXP02F6OVO.38.55.E11.1.454.CMB.2.raw
  modified_base (261)..(261): a, c, t, g, unknown or other
  misc_feature (261)..(261): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttcctgctgcttaattttaaaaggtgtccagtgtgaggtgcagcgtggtggagtcgtgggggagcgttgggaagcgtgggggtcctagactctctgtacncgctctggattctacttttagtatcgcctggtatcgaccgtcggtccgccgaggctaccgaaggggaacggggctaggaagtggggtcggaccggttaaagttaaaaggtgaaacgtggagtggggtagaacaacgacgactacgcgtcgaccgaccggtagaaacgctaaggtacttcccgaaacctattacccgtaacgaaaggtagtaacgttacgaactttaaccgaaaacccgggtaaacctaaccggttcctttaaaccctttttaacaaaaccttaaaagtcggtaaacttaccgaacgtaacccgtaaaacggaaaaacccggcggtaaaccacgacggttacccgttaggttaaaacttaccggtacgaaacccgaaaggaagggaaacacggtacttaaaaggttaataagtaaggtaacttagttaggtaggtttaaacttcg

SEQ ID NO: 324942 - DNA, 691 bp, Homo sapiens
  misc_feature: GZ8MTXP02JF09P.38.55.E11.1.454.CMB.2.raw
  modified_base (269)..(269): a, c, t, g, unknown or other
  misc_feature (269)..(269): n is a, c, g, or t
tcagtcgatcacgtcacgaccggtgctcgatttagcactcgcacgttgggtttggggagatctgggagaggagccccagccttgggattcccaagtgtttcattcagtgatcaggactgaacacagaggactcaccatggagtttgggctgagctggattttcctgctgctattttaaaggtgtccagtgtcgaggtgcagctggtggagtcgtgggggaggcgttagggaagccggtgggggtcctagacttctctgtacagcctcgnggtattctactttagttatgcctggtatcgaccgtcggtaccgcgtacggctaccggaaggggaaacgggcgtaggtaaggtggggttacgtacgttaaagttaaaaggtagaaacgtggagtggggtacggaactaaacgagacctacggcgtcgaccgtacccgtaaggaaacgaccgtaaggtaactttaccgaacttacaacgtaaagacgatacgtaataccgaaaacgaccgtaacgccttactttaacaaactaaagtacgacttaccgaacgtaaccaaacgaaaacgtacggaaaccacgaaccgtaccgtatacgttaaccgtacgtaaacccgaacgtaaacgggtacgaacacggtttaatagttaagtacaaaggttacgttaggttacgtttaacctagtttaaccgg

SEQ ID NO: 324943 - DNA, 708 bp, Homo sapiens
  misc_feature: GZ8MTXP02H59F9.38.55.E11.1.454.CMB.2.raw
  modified_base (187)..(187): a, c, t, g, unknown or other
  misc_feature (187)..(187): n is a, c, g, or t
  modified_base (526)..(526): a, c, t, g, unknown or other
  misc_feature (526)..(526): n is a, c, g, or t
  modified_base (590)..(590): a, c, t, g, unknown or other
  misc_feature (590)..(590): n is a, c, g, or t
  modified_base (665)..(665): a, c, t, g, unknown or other
  misc_feature (665)..(665): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgcttattttaaaaggtntccagtgtgaggtgcagcgtggtggaggtcggtgggggaggtcgttaggggaaacgtccggtggggggttcccttaggaccttcgtcctgtacagcctcgtggtattctacttttagtaatcgtacctggaactcgtaccgtcgggtcccgcgacggcctaccgaaggggaaacggggcctaggggtaaaggttcgggggtttaaggtaccggtttaaaagttaaaaggtaagtaaaaccgtaggtaaggtggggtaaggggaaaccaaacgaacggtaccttaaacggcgtcgacccgtaacccgtaaggaaacggtacaagtacttaccaaccgtancccgtagaaagaggattaggtaacttaacgaaccgaaactcgtacttatttaccaaatacgtanacacgaacgtaaccgaaacggaaacgagaactaacgcgtacgtattaacgtacacgtaacgaaacggaacggaanacgtataagttaagtataagtagttacgtagttacgttactag

SEQ ID NO: 324944 - DNA, 700 bp, Homo sapiens
  misc_feature: GZ8MTXP02J0E8V.38.55.E11.1.454.CMB.2.raw
  modified_base (413)..(413): a, c, t, g, unknown or other
  misc_feature (413)..(413): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtcgtgggggaggcgttaggggaaagccgtggggggtcccttagactctcctgtacagcctctggattctactttagttatgcctggatgaccgtgggtccgccgaggctccgaggaaaggggctaggaagttggggttagggaccgttaagttaaaagtagtaaaactggaagtgggtagggacaaacgagtacctacggntcggaccaacccgggtagaaaacggccgaagtacttaccaacccgtaatcctaccgaaaggagtaacgtagtaacttaccaaacggaaacctacgtaccctttacgtttacctaaaccgtaaaatgtaaaccgttcaaacggtaccctaaacggaaaaacccgagggtaaacccaacgaacgtacccgttaggttaaaactttacgcgttaaacccaaaccggagggaaacgagtaacgtaaggttaatttaagtacgtattacgggtagtttacggtttatttacg

SEQ ID NO: 324945 - DNA, 625 bp, Homo sapiens
  misc_feature: GZ8MTXP02HUZQ3.38.55.E11.1.454.CMB.2.raw
  modified_base (534)..(534): a, c, t, g, unknown or other
  misc_feature (534)..(534): n is a, c, g, or t
  modified_base (602)..(602): a, c, t, g, unknown or other
  misc_feature (602)..(602): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctatttaaaggtgtccagtgtgaggtgcagctggtggagtcgtgggggaggcgttgggaagcgtgggggtcctagactctcctgtacagcctctggtattctactttagttatcgtccgtgatgaccgtcgggtcccgcgaggccgtcgaagggaacgggtcgtaggtaggttggggttacggaccggttaaagttaaaaggtagtaaactggtaagtgggtacgggaacaacgaagactacgcgtcgcacgtagaacgacagactacactatcctagaagacgatacgtactacaaaccgagaccttctaactttccgtaaaactaagttcgacttacgacgtaaccgaaacggaaaaccgngaaccacgacgtacgtatacgttactacgtaaccaggacggaaagtccaagttataagttagaacgtnttaaggtacgttagtttaacttg

SEQ ID NO: 324946 - DNA, 748 bp, Homo sapiens
  misc_feature: GZ8MTXP02G4MFZ.38.55.E11.1.454.CMB.2.raw
  modified_base (510)..(510): a, c, t, g, unknown or other
  misc_feature (510)..(510): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggtattttcctgctgctatttaaaaggtgtccagtgtgaggtgcagctggtggagtcgtgggggagcgttagggaagccgtgggggtcctagactctcctgtacagcctcgtggtattctacgttttagtatgtccgtggatcgaccgtcgggtcccgccgaggccgtaccgaaggggaaaggggtcgtagggtaaggttcggggtttacgggtaccgttaaagttaaaaggtacgaaaacgtggtaaggtacggggtagggaaccaaacgacggtaccgtacggcgtcggacccgtaacccggtaggaaaaccggcaagtaccttaccgaccctagttcccgaacgaaagganagtacgtaacgttaaaccaaaccggaaacctaccgttacctttaaccgtttaccaaaacgtaactacgtactaaccgaacgtaaccccgtaaacggaaaaaccccgaggaaaccccaacgtaccggtaccggtttaattaaaccgttacgtacgtaaacccgaaacggaagggaagtacgtagttaaaggtttaactaaggtacgttaagttaaggtaagtttacggtttaacttacg

SEQ ID NO: 324947 - DNA, 691 bp, Homo sapiens
  misc_feature: GZ8MTXP02JVBHS.38.55.E11.1.454.CMB.2.raw
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgcttatttaaaggtgtccagtgtgagtgcagctggtggagtcgtgggggagtcgttagggaaacgccggttgggggtcccttagaccttctcctgtacagcctcgtggtattctacttttagtatgcctggatgaccgtggtccgcaggctaccgagggaaagggtcgtaggaagtgggttggaccttaaagttaaagagtaaacgtgagtacggggtacggaacaacgtaacggactacgcgtcgaccgtacccggtaagaaacgcgagtacttaccacctaactactacgaaacgagtaacgtagtacttaaccgaaaccgaaccaccgggttacctttacctttaccctaaacgtaaacgtcgtaactacccggtactaaccggtaaaccggaaacccggaacggtaacaaccgacgtaccgtaacgttacgttaccgacggtaacccaaaggtaacgggaagtaaccgtagtaagttaagtaggttagtaagttaggttacgttacggttattaacg

SEQ ID NO: 324948 - DNA, 654 bp, Homo sapiens
  misc_feature: GZ8MTXP02IOJJ6.38.55.E11.1.454.CMB.2.raw
  modified_base (466)..(466): a, c, t, g, unknown or other
  misc_feature (466)..(466): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttcctgctgctattttaaaaggtgtccagtgtgaggtgcagcgtggtggagtcgtgggggaggcgttgggaagcgtgggggtcccttagactctcctgtacagcctctggattctacttttagttatgccgtggactgacccgtgggtcccgccgaggcctccgaaggggaaacggggtcgtagggtaaagtggggtttagggaccgttaaatttaaaaggtagtaaaacgtggtagtggggtaggacgtaaacgagactacggctggcacccggtagaaagcaagtactcaacatctacaaganatagacttacgaaacgtaacacgtacttactttacaaacgtaactagtactacgaactaccgtaaacgaaaaccgacggtaaaccacgagtacccgttagttaaccttacgtacgtaaacctaaagaacgggaaacgagtacttaaagtaagttaagtagtaagttacgtaaggttcgttaagttacg

SEQ ID NO: 324949 - DNA, 638 bp, Homo sapiens
  misc_feature: GZ8MTXP02F0G8O.38.55.E11.1.454.CMB.2.raw
  modified_base (452)..(452): a, c, t, g, unknown or other
  misc_feature (452)..(452): n is a, c, g, or t
  modified_base (472)..(472): a, c, t, g, unknown or other
  misc_feature (472)..(472): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgcttatttttaaaggtgtccagtgtgaggtgcagcgtggtggagtcggtgggggaggcgttagggaaacgccggtggggggtcccttaggacctcgtcctgtacagtcctcgtggtattcgtacttttagtatgcctggactgaccgtcggtcccgacgacggcctaccgaagggaacggggtcgtaggaagttggggttacggtaccgttaagttaaaaggtacgaaacgtgtagtggtacggaacgaacgagacctacggctcgaccaccggtagaacgnagtactcaacatcacgaagntatagattacaacgtacacgtcttacttactaaacatagtactacgacgtaccaacgaaaccgtagacacgacgtaccgtataacgtacgacgttaccgaaacggtaagggacgtagacgttaagttaacgttagtacgttaagtagttaggttacggttattacg

SEQ ID NO: 324950 - DNA, 693 bp, Homo sapiens
  misc_feature: GZ8MTXP02G36D6.38.55.E11.1.454.CMB.2.raw
  modified_base (491)..(491): a, c, t, g, unknown or other
  misc_feature (491)..(491): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctatttaaaaggtgtccagtgtgaggtgcagctggtggagtcgtgggggaggcgttgggaaagccgtgggggtcccttagactctcctgtacagcctctggtattctacttttagtatgcctggatgaccgtgggtcccgccgaggcctaccgaaggggaaacggggtctaggggtaagttggggttacgggaccggtttaagttaaaaacggtacgtaaaactggtagtacggggtagggaactaaacgagacctaccggctcggccgaacccggtaggaaacgcaagtacgttccaaacctagtacctaagaaggtanacgtagtaacttaccgaaaaccgtaaaccacgtacctttacctttacaaaacgtaaacgtttgacttacgaacgtaccctaaaggaaaacccggtggaaccaacgtacggtacgttaggttaaacttacgacgtaaaccgacggaaaggggacacgtacgttaaggttaatagtagtagttaggtagtttacgttacttacg

SEQ ID NO: 324951 - DNA, 667 bp, Homo sapiens
  misc_feature: GZ8MTXP02FLTWM.38.55.E11.1.454.CMB.2.raw
  modified_base (562)..(562): a, c, t, g, unknown or other
  misc_feature (562)..(562): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtcgtgggggagcgttagggaagccgtgggggtcccttagactctcctgtacacgctctggtattctacttttagtatcgcctggatcgaccgtgggtccgccgaggtcctaccggaaggggaaacggggtctagggtaagttggggttacgggtaccgttaaagttaaaaaggtacgaaacgtggagtagggtacgggaacaacgtagactaccgcgtcgaccgacccggtagaaacgcaagtacttacacccgtatacgtacgaaagagtaactagacttaccgaaaacgaacaccgtctttacttacgaaacaaattcgaactacacgtacccgtaaagaaaaccggngacaacggacgtaccgtattaactacgttagaaacccgaaggaaggggtaaacacgtcgttaaagttaagtagtaagtacgttaagtacggtttagttaacttcg

SEQ ID NO: 324952 - DNA, 576 bp, Homo sapiens
  misc_feature: GZ8MTXP02JY7U3.38.55.E11.1.454.CMB.2.raw
  modified_base (306)..(306): a, c, t, g, unknown or other
  misc_feature (306)..(306): n is a, c, g, or t
  modified_base (359)..(359): a, c, t, g, unknown or other
  misc_feature (359)..(359): n is a, c, g, or t
  modified_base (382)..(382): a, c, t, g, unknown or other
  misc_feature (382)..(382): n is a, c, g, or t
  modified_base (406)..(406): a, c, t, g, unknown or other
  misc_feature (406)..(406): n is a, c, g, or t
  modified_base (440)..(440): a, c, t, g, unknown or other
  misc_feature (440)..(440): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctatttaaaaggtgtccagtgtgaggtgcagctggtggagtcgtgggggaggcgttgggaagccgtgggggtcccttagactctcctgtacagcctctggattcactttagtatgcctggatgaccgtgggtccncgaggctccgagggaaaggggctggaagtggggttggaccgtaattaaaaggngaaactggagtggtagggacaanagactacgctgcaccgtagaaagnagatcacatcacaagagatgaactacaaacgacncgacttacttacaacaaatgaatccaagaccctaagaaaacccggaggaacacgacgtccgtataacttagacgtaaccaaggaacgggaacagtactaagttaattagtacgtaattagtaggttacgttaatcg

SEQ ID NO: 324953 - DNA, 631 bp, Homo sapiens
  misc_feature: GZ8MTXP02HVHTH.38.55.E11.1.454.CMB.2.raw
  modified_base (534)..(534): a, c, t, g, unknown or other
  misc_feature (534)..(534): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctatttaaaaggtgtccagtgtgaggtgcagcgtggtggagtcgtgggggaggcgttagggaaagccgtgggggtcccttaggacttctcctgtacagcctctggacttctactttagttatcgcctggatgaccgtggtccgcaggcctccgaggaacgggctggaagtgggtgacgttaattaaagagaaactgacgtggtaggactaacgagactacgctcgaccgaaccgtagaaacggcaaggtacttacccaaacctataccgtacaaaagggtataaactggaaacttaccgaaaacgaaacctacgtcttacctttaacaaactaatagactacaacgtaccgaaggaaaaccgngaaacacgagtccgtattactaacgtcgaaaccgaggaaacggaagacgaacgtaagtttaatagtaaggagttaagtacggttaggttaacttacg

SEQ ID NO: 324954 - DNA, 761 bp, Homo sapiens
  misc_feature: GZ8MTXP02FVC3E.38.55.E11.1.454.CMB.2.raw
  modified_base (270)..(270): a, c, t, g, unknown or other
  misc_feature (270)..(270): n is a, c, g, or t
  modified_base (275)..(275): a, c, t, g, unknown or other
  misc_feature (275)..(275): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtcgtgggggaggcgttagggaagcgtgggggtccttagactctcctgtacacgtcctntggtnttctacttttagtatcgccgtggatcgaccgtcgggtcccgccgaggccgtaccgaaggggaaaggggcgtagggtaagtggggttacggtaccgttaaagttaaaagtagaaactggtagtggtaggaacaacgacgactacgctcgaccgacccggtagaaacgcgaagtacttaccaaacctataccctaacgaaaaggtagaacttacgtaaaccgtttaaccgaaaaacccggtaacctaacccgttacccttttaaccctttttaaaccgaaaacgttaaaaacttcggtaaaaccttaccgaaacggtaaaccccgtaaaacgggaaaaaccccggacgggtaaacacccggtaaggttaccccgtaagttaaaaccttacggtaaccgtaacccgaaaaggtaacggggaaacgtaacgtacgttaaagttaaagttaagtagtaaacggttaggttaacgttaggttactttaacgg

SEQ ID NO: 324955 - DNA, 576 bp, Homo sapiens
  misc_feature: GZ8MTXP02JW5K2.38.55.E11.1.454.CMB.2.raw
  modified_base (370)..(370): a, c, t, g, unknown or other
  misc_feature (370)..(370): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtcgtgggggaggcgttgggaaagccgtgggggtcccttagactctcctgtacagcctctggacttctacttttagtatgcctggatgaccgtgggtccgccgaggctccgagggaaagggctggaagtgggtgacgtataaaagtgaaactgatcggnggacaacagactagctgcaccgtagaagcagattcacatctacaagagatagacttacaaacgaacacgacttactttactaactaaatgaactacgagacctaggaaaacccgaggaacacgacgcccgtagtacttacgtacgtaaccaacggaagggaacgacgtactagttaatagtagaagtagtagttacggttattacg

SEQ ID NO: 324956 - DNA, 617 bp, Homo sapiens
  misc_feature: GZ8MTXP02HRZMD.38.55.E11.1.454.CMB.2.raw
  modified_base (442)..(442): a, c, t, g, unknown or other
  misc_feature (442)..(442): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggtattttcctgctgctattttaaaaggtgtccagtgtgagtgcagctggtggagtcgtgggggaggcgttgggaaagccgtgggggtccttagactctcctgtacagcctctggattcacttttagttatgcctggatgaccgtgggtcccgccgaggccgtaccgaggaaaggggctaggaagttggggttaggaccggttaagtaaaacgtagaaacgtgagtgggtagggaacagacgtactacgtgccaccgtagaaacggcaagatacaccatctacaanagatagattacgaaacgtacaccgtcttacttacactaaatgtactacacgacctaagaaaaccgaggaacacgtacggtacctagtaaacttacctacgtaaacccaaaggaaagggtaaactacggacttaagttaataagttacgagttaagtagtacggttatttacgtag

SEQ ID NO: 324957 - DNA, 633 bp, Homo sapiens
  misc_feature: GZ8MTXP02JBGAI.38.55.E11.1.454.CMB.2.raw
  modified_base (212)..(212): a, c, t, g, unknown or other
  misc_feature (212)..(212): n is a, c, g, or t
  modified_base (272)..(272): a, c, t, g, unknown or other
  misc_feature (272)..(272): n is a, c, g, or t
  modified_base (278)..(278): a, c, t, g, unknown or other
  misc_feature (278)..(278): n is a, c, g, or t
  modified_base (332)..(332): a, c, t, g, unknown or other
  misc_feature (332)..(332): n is a, c, g, or t
tcagtcgatcacgtcacgaccggtgctcgatttagcactcgcacgttgggtttggggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaggcagctccaaacnttggagtattaattttgctcctggtaccagcagcctcccaggacacgccccaaactcctnatttangaccataagtacgcaccctgaggtatcctagaccgattctctggctaccagtcnggcaccgtcacgcccaccgtggcactccaccgcctcagcgtaggacgacgaccgtattattacgagacggaacagtaggaacttaaccgagtacgtgaaacgtggtacgtttggggtagcccgttaggggtagggaacgggaccgaaggtcgtacggaacccgttcgtaacggtcgaaccggaccccgaaagggtcccttacccggacccccgttcggtaacccctacccgtttcccgttcccggttaccccccgtaaccccgttccctaacccggttacgtaaccggaacctttacccgg

SEQ ID NO: 324958 - DNA, 614 bp, Homo sapiens
  misc_feature: GZ8MTXP02GWS0R.38.55.E11.1.454.CMB.2.raw
  modified_base (309)..(309): a, c, t, g, unknown or other
  misc_feature (309)..(309): n is a, c, g, or t
  modified_base (604)..(604): a, c, t, g, unknown or other
  misc_feature (604)..(604): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttcctgctgctattttaaaaggtgtccagtgtgaggtgcaggtgtcggagtcgtgggggagcttggttcgaggcccgggggtcctgagactctcctgtgcagtctcgtggtattaaccttagtagactatgccatgactcgtggtccncgaggctaccgagggacggctggagtggtctcgagtacgtaaagtttaaggtgggtaggggtgtacttcaccgtattactacgacacgtaccgttccggggtacgggggtcccgttaccacccgtatccgaaacccgagtaacgaacaaaccgtcgaaggacgacaacctactaatactactaaacaatcgacacgacgcctaggacgagtacgaaggaccgacgggtcgttagtactttaagtggtagacgagtaacgacgtacccgaacggtcacccgtacgttaggtcgttntttcgttacg

SEQ ID NO: 324959 - DNA, 766 bp, Homo sapiens
  misc_feature: GZ8MTXP02GUT97.38.55.E11.1.454.CMB.2.raw
  modified_base (241)..(241): a, c, t, g, unknown or other
  misc_feature (241)..(241): n is a, c, g, or t
tcagtcgatcacgtcacgaccggtgctcgatttagcactcgcacgttgggtttggggacaatcttcatcatgacctgctcccctctcctcctcacccttctcattcactgcacagggtcctgggcccagtctgtgttgacgcagccgccctcagtgtctgccggcccaggacagaagtcacatctcctgctcgtggaggcagctaccaactagttggatattaattttgtctctggtaccngcagcctaccgaggaaccacgacccccaaactcctacgtatttacgcgaacctaataaacgtacggacccgtacccctaggtaacgggtaactttcccgtacggtacccgtactttccgtaccgttcggacccttacccgtaaaggttccgtacgggtacctaacccgttccgaccgaccccgtaacccggttgggacccttacgtacccgggaccccggtcccttaaccgaacggtaccggggtacgggggaaacctaccggggtacccgttaaagtttacttaccgacgggaaccgaaacgtaggtacgggaaactaaccggaacgtacgtagtaaacgttcggtcgggtttggacggtcgttacgggggtaggaaccgggccgtaggtcgtacggacccgttacgtacggtcccgaaccgaccggtacggtcccgtcccggcccccgtttcggaacccttaccgttcccggttaacccgtccccctaacccttccgtacggtaccgtaacgtcgttacccgg

SEQ ID NO: 324960 - DNA, 574 bp, Homo sapiens
  misc_feature: GZ8MTXP02GUYLH.38.55.E11.1.454.CMB.2.raw
  modified_base (279)..(279): a, c, t, g, unknown or other
  misc_feature (279)..(279): n is a, c, g, or t
  modified_base (467)..(467): a, c, t, g, unknown or other
  misc_feature (467)..(467): n is a, c, g, or t
tcagtcgatcacgtcacgaccggtgctcgatttagcactcgcacgttgggtttggggacaatcttcatcatgacctgctcccctctcctcctcacccttctcattcactgcacagggtcctgggcccagtctgtgttgacgcagccgccctcagtgtctgccggcccaggacagaaggtcaccatctcctgctctggagcagctaccaacattggagtaattaatttttgctcctggtaccagcagctcccaggaacacgcccccaaatcctcatttancgaaccataatacggcacccctgaagggtcttcctgaccgtattctctggcctcgaagtctggcacgtcacgccaccagtcggcacgtccaccggcctaccgagacggtcggggacgacgggaccctaagtttactacgtcggacggaaacagtcgggaactaccgagactagaatgcgtttggggancgtcgggtggaacgggtcaggctcggaccgtacgtggtacacggaccgtaaggcctaccgccccgtacggtcacttcgtccgttccccgcctctcgacgtcgtaccg

SEQ ID NO: 324961 - DNA, 680 bp, Homo sapiens
  misc_feature: GZ8MTXP02I0C0L.38.55.E11.1.454.CMB.2.raw
  modified_base (260)..(260): a, c, t, g, unknown or other
  misc_feature (260)..(260): n is a, c, g, or t
  modified_base (298)..(298): a, c, t, g, unknown or other
  misc_feature (298)..(298): n is a, c, g, or t
  modified_base (552)..(552): a, c, t, g, unknown or other
  misc_feature (552)..(552): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttcctgctgctatttaaaagtgtccagtgtgaggtgcagctggtgagtcgtgggggagcgtgggaagccgtgggggtccttagctctctgtacagcctntggtattcactttagttatgcctggatgacctggtccnccgagctaccgaggaaagggcgtaggaagtgggtttaggtacgttaagttaaaagtagtaaacgtgagttacgggaggaactaacgagtactacgacctgccctacccggaagtaaacgggctaggtacttaccgtaactacttacctccgaaaaggtacgtaaagttagtaacttaaccgaaaccgtaactaaccgctttacttaccctaaataaacgttagacctactaacgtaccgtaacgaaaacccggnggtaaacaaccgtacggtacccgttaggttaaacttaccgttaaacggtaacccgaaaccgggaagggtaaaccgtacggacttaagtttaatagtagtaattaggttaaccgttgtttacgttaacg

SEQ ID NO: 324962 - DNA, 636 bp, Homo sapiens
  misc_feature: GZ8MTXP02GPFWM.38.55.E11.1.454.CMB.2.raw
  modified_base (201)..(201): a, c, t, g, unknown or other
  misc_feature (201)..(201): n is a, c, g, or t
  modified_base (263)..(263): a, c, t, g, unknown or other
  misc_feature (263)..(263): n is a, c, g, or t
  modified_base (480)..(480): a, c, t, g, unknown or other
  misc_feature (480)..(480): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcacatggagtttgggctgagctggattttccttgctgctattttaaaggtgtcagtgtgaggtgcagntggtggagtcggtgggggaggcgttagggaacggccggtgggggtccttagactctctgacngctctggattctacttttagtatcgtcctggatcggtaccgtgggtcccgccgacggcctaccggaacggggaaaggggcgtaggtaacggtggggttacggtacgttaaagttaaaagtagtaaacgtagtagtagggtacggaacgtaaacgacgtaacacgacgtcgaccgaaccggtagaaacgcaagtactacaacctagactaacgaaagnagtacaactacgaaacgactacgctttacttactaacaagtacatacgatacccgaagaaaaccgagaccagacgactataacttacgataaccgaggtaaaggacgtaagcgttaataacgttaatacgaaacgttagtacgtagtttactacgg

SEQ ID NO: 324963 - DNA, 766 bp, Homo sapiens
  misc_feature: GZ8MTXP02G0661.38.55.E11.1.454.CMB.2.raw
  modified_base (272)..(272): a, c, t, g, unknown or other
  misc_feature (272)..(272): n is a, c, g, or t
  modified_base (316)..(316): a, c, t, g, unknown or other
  misc_feature (316)..(316): n is a, c, g, or t
  modified_base (710)..(710): a, c, t, g, unknown or other
  misc_feature (710)..(710): n is a, c, g, or t
tcagtcgatcacgtcacgaccggtgctcgatttagcactcgcacgttgggtttggggacaatcttcatcatgacctgctcccctctcctcctcacccttctcattcactgcacagggtcctgggcccagtctgtgttgacgcagccgccctcagtgtctgccggccccaggacagaaggtcaccatctcctgctctggaggcagctaccaacattggatattaattttgtctcctggtaccagcagctcccaggacacgaccccaaatcctntatttatcgaacctaataagtaggccaccctgagggtacttccncgaccgtattcctacgtcggtacctaccctaaaggttccgtcggggacctaccccggttaccgacggacccccgtaaccccggttggggaccctaacggttcccccgaaccccgggtccccttacccggaagggtaacccggtcggggggaaaccgtacgggtacccggtaatttaacgtttaaccgcggggaacccggaaactaagggtccggggtaaacttaaccccggaaggtaacccgttagggaaacgttcggttaccgggttggggtcgtccgggttcgggggtagggaacggggacccgtaggggtccgtacggaaccggttccgttaaacgggccaacggaccccgaaggggtcccgttacccggacccccgttcgggtaaacccnccgttccgtaacccggttcccccaacccgttcctaccgtacggtctaacggtcccg

SEQ ID NO: 324964 - DNA, 616 bp, Homo sapiens
  misc_feature: GZ8MTXP02FZDUN.38.55.E11.1.454.CMB.2.raw
  modified_base (309)..(309): a, c, t, g, unknown or other
  misc_feature (309)..(309): n is a, c, g, or t
  modified_base (451)..(451): a, c, t, g, unknown or other
  misc_feature (451)..(451): n is a, c, g, or t
  modified_base (520)..(520): a, c, t, g, unknown or other
  misc_feature (520)..(520): n is a, c, g, or t
  modified_base (541)..(541): a, c, t, g, unknown or other
  misc_feature (541)..(541): n is a, c, g, or t
  modified_base (564)..(564): a, c, t, g, unknown or other
  misc_feature (564)..(564): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtcgtgggggaggcgttgggaaagccgtgggggtcccttagactctcctgtacagcctctggattcacttttagtatgcctggatgacctgggtcccnccaggctccgaaggaaaggggctagggaatgggttggccgtaagttaaaagtcgaaactgagtgggtagggaacaaacgagacgtaacgcgtcgaccacccggtagaaacgggcaaggacttaccacctatacctacgaaanagaatagattacaaacgaaccacgctacctttacaacctaaatcgaatcgaaacccgtagaaaacccgnggaacaccgaaatccgggttntaacttacgtaacgtacccgaanaaacgggtagaacgtcgtaagttaatactagagttagtacgtaggttactag

SEQ ID NO: 324965 - DNA, 706 bp, Homo sapiens
  misc_feature: GZ8MTXP02FVNEN.38.55.E11.1.454.CMB.2.raw
  modified_base (310)..(310): a, c, t, g, unknown or other
  misc_feature (310)..(310): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtcgtgggggaggcgttgggaaagtccgtgggggtcccttagactctcctgtacagtcctctggtatctacttttagtatgctgatcgactggtccgcngctaccgagggaacgggcgaggtaggtgggttcggaccgttaagttaaaggtagtaaacgtaggtagtaggggtacggtaacgaaacgacgtaaccgtacgccgtcgaccgacccggtaggaaacggtccaaggtactaccacccgtaataccgtacaaaggagtaatacgtacgtaacaaacggtaaccaaccgtcctttaaccttactaaaccaaagttacgaacgttacgaacgtaaccccgtaaaggaaaacccgaacggaaccaacggtacgtaccgttagtaaaccgttacgtacgtaacccgaaaggtaacgggtaaacgacggtatttaacggttaagtttacgtaacgttaaagttacggttacggtttaaggtttactttaaacgg

SEQ ID NO: 324966 - DNA, 666 bp, Homo sapiens
  misc_feature: GZ8MTXP02JGUSB.38.55.E11.1.454.CMB.2.raw
  modified_base (258)..(258): a, c, t, g, unknown or other
  misc_feature (258)..(258): n is a, c, g, or t
  modified_base (303)..(303): a, c, t, g, unknown or other
  misc_feature (303)..(303): n is a, c, g, or t
  modified_base (371)..(371): a, c, t, g, unknown or other
  misc_feature (371)..(371): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttcctgctgctatttaaaggtgtccagtgtgaggtgcagcgtggtggagtcgtgggggaggcgtgggaagccgtgggggtccctagctctctgtacngcctgtggtattctactttagtatgcctggatcgaccgtggtccncgaggcctcgaaggaagggctggaagtgggtgacgttaataaacgtgaaactgtagtggtaggacaanacgtacgtacgcgtcgacacccggtagaaacgcgagtacttcaacctatcctaagaagacgtagtagtacttaccgaaacgtaccacgtccttactttacgtaaacaaacgttcgaacttacgaaccgtaaccccgaaggaaaacccggcgtaaccgaacgtacggtaccttaggttaacccttaattaccgggaaaccctaaggaacgggggtaaactaaccgggctttaacgggttaaagttaggtttaaacggacgtttaggttacggttttaaaccggtttactttaaccg

SEQ ID NO: 324967 - DNA, 632 bp, Homo sapiens
  misc_feature: GZ8MTXP02JA3MR.38.55.E11.1.454.CMB.2.raw
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttcctgctgctattttaaaaggtgtccagtgtgaggtgcagctggtggagtcgtgggggaggcgttagggaaagccgtgggggtcccttagactctcctgtacagcctctggattctacttttagttatgcctggatcgaccgtgggtcccgcgaggctccgagggaaaggggctggaagtgggtggaccgtaattaaaagtgtaaactgtagtgggtaggacaacagactacgctcgacctacccggtagaaacgctaaggacttaccaacctactactacgaaagagatagacttacgaaacgaacacgtcttactttactaaactaaatcgacttcgaacgaccgtaagaaaaccgacgaaccacgaacgtaccgtagttacgtacgtacgtaaccgtaacgaacgggaagtaacgaccgtaagttaagtaagttacgtaataaggtttagacggttttttactaacg

SEQ ID NO: 324968 - DNA, 683 bp, Homo sapiens
  misc_feature: GZ8MTXP02HM199.38.55.E11.1.454.CMB.2.raw
  modified_base (504)..(504): a, c, t, g, unknown or other
  misc_feature (504)..(504): n is a, c, g, or t
  modified_base (560)..(560): a, c, t, g, unknown or other
  misc_feature (560)..(560): n is a, c, g, or t
  modified_base (568)..(568): a, c, t, g, unknown or other
  misc_feature (568)..(568): n is a, c, g, or t
  modified_base (633)..(633): a, c, t, g, unknown or other
  misc_feature (633)..(633): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctatttaaaaggtgtccagtgtgagtgcagcgtggtggagtcggtgggggaggcgttaggggaaacgccggttcggggggttcccttaaggaccttccgtccgtgtacagcctcgtggtattactacttttagtatgtcctggatcggaccgtcgggtcccgcgacggccgtacccgaaggggtaacggggcgtagggtaaagttggggttacggacccggttaaagttaaaacggtagaaaacgtggtaagtcggggtaggaacaacgacgactacgcgtcgaccgtaacccggtaggaaacgacgaagactacgaacctactacccgtaanaaggagtaactcgtaaactaaccgaaaccgaacctcgtaccttacttacctaaaanaacgtttnacttacgaccgaaccgtaacgaaaacgcgaacgaccgtacgtctacgttaacactcgaaacccgngggaaaggacgactgttaaaatgttagagagtaagtccgttagtagttac

SEQ ID NO: 324969 - DNA, 636 bp, Homo sapiens
  misc_feature: GZ8MTXP02HRNVK.38.55.E11.1.454.CMB.2.raw
  modified_base (445)..(445): a, c, t, g, unknown or other
  misc_feature (445)..(445): n is a, c, g, or t
  modified_base (451)..(451): a, c, t, g, unknown or other
  misc_feature (451)..(451): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctatttaaaggtgtccagtgtgaggtgcagctggtggagtcgtgggggagcgttagggaagccgtgggggtcccttagactctcctgtacagtcctctggatttctacttttagttatcgcctggatcggaccgtgggtcccgccaggcctaccgaaggggaaacggggctagggaagttggggttgacgttaattaaaaggtgaaacgtgagtggtaggacaagagactacgctcgccaaccgtagaaacgtcaagattaccactatacctanaaaganatagtacttacaaacgaacacgtcttactttacaaactaatagatacactaccgtaacgaaaaccgacggaacacgacgtacccgttaagtttaacgttaccgtacgtaaacccgaacggaaacggaacgaacgtactaagtttaagttagttacgtaagttaagtaggtttacggtttataccg

SEQ ID NO: 324970 - DNA, 674 bp, Homo sapiens
  misc_feature: GZ8MTXP02IH9S4.38.55.E11.1.454.CMB.2.raw
  modified_base (266)..(266): a, c, t, g, unknown or other
  misc_feature (266)..(266): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctatttaaaggtgtccagtgtgaggtgcagctggtggagtcgtgggggaggcgttgggaagccgtgggggtccttagactctcctgtacagcctntggattctacttttagttatgcctggatgaccgtggtcccgcgaggctaccgaggaacggggcgtaggaagtgggtcggtaccggttaattaaaaggtgaaactgagtggaggacacgagactacgctgcaccgtagaaacgcagactaccgactatctacaaagagtactagtaacttacaaaccgtaaacaccgtcttaccgtttaaactaactaaaatcggaaacttcgaaccggtaccctaaacggaaaaacccggagggaaacccaacggtaaccgtacccgggttaatttaaccgttacgtaaccggttaaccaaacgggaaacgggtaaagaacggtacttaaaggtttaatttaaggtagttaacgttaaggtttacgtttggggtttaaaactttccgg

SEQ ID NO: 324971 - DNA, 687 bp, Homo sapiens
  misc_feature: GZ8MTXP02GKI8P.38.55.E11.1.454.CMB.2.raw
  modified_base (468)..(468): a, c, t, g, unknown or other
  misc_feature (468)..(468): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggtattttccttgctgcttattttaaaaggtgtccagtgtgaggtgcagctggtggagtcgtgggggaggtcgttagggaaagccggtgggggtcccttagactctcctgtacagcctcgtgtattctacttttagtatcgcctggatgaccgtggtcccgcacgcgtacgaggaaagggcgtaggtagttgggtcggtaccgtaagttaaaagtagtaaaacgtaggtagttgggagggtaaaccaacgtaacgtaaccgtaacgcctggaccgaacccggtaaggaaaacgcgaagacttccaaaccctntactacgaaagataacgttagaacttaacaaaccgaacctacgtacctttacgtttaaaccaaacctaaaagttcaacttacgaacgaaccccgttaaacgaaaaccggtacggtaaaccacggtaacgtacccgggtatttaaaactacgtaaaccgtacgaacggtaaaggacgtagacgttaagtaatttagagttatacgtagttacgtattacg

SEQ ID NO: 324972 - DNA, 701 bp, Homo sapiens
  misc_feature: GZ8MTXP02F2NTA.38.55.E11.1.454.CMB.2.raw
  modified_base (312)..(312): a, c, t, g, unknown or other
  misc_feature (312)..(312): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtcgtgggggaggcgttagggaagccgtgggggtcccttagacctctcctgtacagcctctggtattctacttttagtatgcctggatgaccgtgggcccncgaggctccgaggaacggggctaggaagttggggttacggaccgttaagttaaaaggtgaaaacgtggtagtgggtaggacaaacgagactacgcgtcgccaccggtagaaagcaagtacttaccaaccctattaccctacgaaaggaacgtagtacgtacttaaccgaaaccggtaaactaccgtctttaaccttttacaaaactaaaagttcgaacttaccgaacgtacccgttaaaacgggaaaacccgtacgggtaaaccaacgtaacggtcccgtttaagttaactttaaccgtacgtaaaccgaaacggaaaggggaacgaacgtactaaaggtttaatttaaacgagttaacgttaaggttaggtttacgttaatttaccgg

SEQ ID NO: 324973 - DNA, 609 bp, Homo sapiens
  misc_feature: GZ8MTXP02J0B0P.38.55.E11.1.454.CMB.2.raw
  modified_base (186)..(186): a, c, t, g, unknown or other
  misc_feature (186)..(186): n is a, c, g, or t
  modified_base (515)..(515): a, c, t, g, unknown or other
  misc_feature (515)..(515): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctattttaaaaggtntccagtgtgaggtgcagctggtggagtcgtgggggaggcttgggaaagccgtgggggtcccttaggactctcctgtacagcctctggtattctactttagtatgcctggatgacctgggccgcaggctcgaggaaggctggaagtgggtgacgtagtaaacgtgaaactgagtcggtggacaacagactacgctgccacccggtagaaacgcaagtacttcaaccctaagtaccctacgaaacgagtagtagaacttaacaaaccgaacaccgtccttaccgtttaactactaaaatgaacttaccgaacgtacccaacgaaaacccgnggaaccacgtacgaccgtattaactactacggtaaccaacgagggaacacggtctaagttaatagtacgtaatacgttagttacgtttagtacg

SEQ ID NO: 324974 - DNA, 738 bp, Homo sapiens
  misc_feature: GZ8MTXP02FVXBJ.38.55.E11.1.454.CMB.2.raw
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgactaattttaaaaggtgtccagtgtgaggtgcagcgtggtggagtcggtgggggaggtcgttagggaaacggccggtggggggttcccttagtacctcctcctgtacacgcctcgtggtacttctacttttagtatcgcctggactcgaccgtcggtcccgccgacggccgtaccgaaggggtaaacggggccgtaggggtaacggttggggtttacgggtaccgttaaagtttaaaaaggtacgtaaaagtaggtaacggtggggtacgggaaccaaaacgaacggtaaccgtaacggtcgtaccggtacccgaacccgggtaaggaaaaccgcgaaacgtacgttacccaaccgtaattacaccgaaaagtagtagtagtaacttaacgaaacgtaacgtacccgtactttaccgtttaactaaacctaagtagtaccttacgaacgaccccgtaaagaaaccggtacgaaccgagtacgcggtaattaacgttacgacgtaaccgaacggtaggaaacgagtacgtaagttaagtagtagtaagttacgtgtagttacttaacg

SEQ ID NO: 324975 - DNA, 709 bp, Homo sapiens
  misc_feature: GZ8MTXP02JSDLD.38.55.E11.1.454.CMB.2.raw
  modified_base (294)..(294): a, c, t, g, unknown or other
  misc_feature (294)..(294): n is a, c, g, or t
  modified_base (437)..(437): a, c, t, g, unknown or other
  misc_feature (437)..(437): n is a, c, g, or t
  modified_base (495)..(495): a, c, t, g, unknown or other
  misc_feature (495)..(495): n is a, c, g, or t
  modified_base (660)..(660): a, c, t, g, unknown or other
  misc_feature (660)..(660): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggtattttccttgctgtacttaagttttaaaaggtgtccagtgtggaggtgcgagcgtgggtggagtcggtgggggagtcggttagggaagtccggttcgggggtaccttagtactctcctgtaccacgtcctgtgtnttctactttagttagtgctggatcgaccggtcggtcccgccgaggtccgtaccggaaggggaacgggtcgtagggtaacggttggggtacggttaccgttaaaagttaaaaggtagtaaacggtggtaagtaggggtacgaanaacgtacgacgtaccgctcgaccgtaccggtaagaacggcacgtacttacccaaactnttaccgaagagaagtagtacgtataacaaaccgctaacgttcttaacttaacaaactaaagtctaactaccgacgtaacccgtaaaaggaaacccgacgaaccaccgtaggttaccgtattaacggtacctacggaaccgaaaggaaaggggtaacacggttaanaaaaggttttgtaaaggtactaaggtagtttaccgttaagttacgtacg

SEQ ID NO: 324976 - DNA, 591 bp, Homo sapiens
  misc_feature: GZ8MTXP02FQO46.38.55.E11.1.454.CMB.2.raw
  modified_base (359)..(359): a, c, t, g, unknown or other
  misc_feature (359)..(359): n is a, c, g, or t
  modified_base (427)..(427): a, c, t, g, unknown or other
  misc_feature (427)..(427): n is a, c, g, or t
  modified_base (473)..(473): a, c, t, g, unknown or other
  misc_feature (473)..(473): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttcctgctgctattttaaaaggtgtccagtgtgaggtgcagctgggtggagtcgtgggggaggcgttgggaaagccgtggggggtcccttagactctctgtacagcctctggattcacttttagtatgcctggatgacctggtccgccaggctcgaggaaagggcgtaggaagtgggttaggcgtaagtttaaaaagngaaactgatgggtaggacaaacgagactaacgctgcaccgtagaaacggcaagatcaccatcacaaanaagatagagttacaaacgaaacacactactttactaactaaataanatacacgaccgtaacgaaaacgaacgaacgaacacgacgtagtaacgttactacgtaacgaacgaacggaacgaacgaacgtaagttaagttaataagtagtaagtagtagtagtacg

SEQ ID NO: 324977 - DNA, 862 bp, Homo sapiens
  misc_feature: GZ8MTXP02FU384.38.55.E11.1.454.CMB.2.raw
tcagtcgatcacgtcacgaccggtgctcgatttagcactcgcacgttgggtttggggacaatcttcatcatgacctgctcccctctcctcctcacccttctcattcactgcacagggtcctgggcccagtctgtgttgacgcagccgccctcagtgtctgcggcccaggacagaaggtcaccatcctcctgctcgtggaggcagctaccaacagttaggagtaatttaattttcgtccttccgtcggtaccagcacgcctacccgaacggaaccacccgaccccctaaactcctactaatttacacgaacctaagtaaacgtacggccccgtaacccctcggaacgggttactttacccgacggtacccgtactttccgtacgtcggacctaccgtaacggtctacggggaccaacccgtccaccgacccgtacccggtggaccaacgtcccggacccgtccctaccgaacgggtaccggacgggggaccgtacgggtaccgttaagtttaaccgtttacgacggaccgggtaaaactacgggtacgggtaaccttaaaccggacgtaaaccgtaggtaaaccgttcggttacgggtttacggggtcggtcccgggtttacgggggacgggggtaacccgggtacccgggaacggttcccggttaacgggtacccccgggttaaccgttaacggggtacccgaaacccggggtaaacccccgtaacgggtccccggtaaacccccggtcccccccggttacggggttacccccttaaccggttacccccgttcccggtttacccccccggtaccccctttaccccggtaccgtttaaaccggtccgtaaacggtttccccgg

SEQ ID NO: 324978 - DNA, 748 bp, Homo sapiens
  misc_feature: GZ8MTXP02FFDLM.38.55.E11.1.454.CMB.2.raw
  modified_base (207)..(207): a, c, t, g, unknown or other
  misc_feature (207)..(207): n is a, c, g, or t
  modified_base (272)..(272): a, c, t, g, unknown or other
  misc_feature (272)..(272): n is a, c, g, or t
  modified_base (490)..(490): a, c, t, g, unknown or other
  misc_feature (490)..(490): n is a, c, g, or t
  modified_base (515)..(515): a, c, t, g, unknown or other
  misc_feature (515)..(515): n is a, c, g, or t
  modified_base (717)..(717): a, c, t, g, unknown or other
  misc_feature (717)..(717): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttggctgagctggattttcctgctgctaatttaaaggtgtccagtgtgaggtgcagtctgggnggagtcggttagggggaggtcgttagggaaacgtccggtagggggtccttagactctcctgtacncgtcctcgtggtattctagttttagtatcgccgtaggactcggaccgttcgggcccaccgaggtccgtaccggaaggggaacggggtcgtagggtaaggtcgggttacggaacgttaaagttaaaacggtcgaaacgtggtaagtcggggtacggaacaacgacgtacgacgctcgacccgtaaccggtagaaaccgtgtaactaccttcaaaccgtnttaccgagaaacgtagtaacgttanaaaccgtttaacgaaaaccggtaccctaaacgtttccctttaaaccgttaacccaaaacggtagttacaaacgttacccgaacgtaaaccccgttaaagggaaaacccgaggaaccctacggaacgttcccgtaaagtttaacctacgtaacgtaaacccgaggaaagggtaccgtagtacggtttaataagtacggttaanacggtttacgttaaggtcggtttaacttcgg

SEQ ID NO: 324979 - DNA, 679 bp, Homo sapiens
  misc_feature: GZ8MTXP02FLE1C.38.55.E11.1.454.CMB.2.raw
  modified_base (258)..(258): a, c, t, g, unknown or other
  misc_feature (258)..(258): n is a, c, g, or t
  modified_base (289)..(289): a, c, t, g, unknown or other
  misc_feature (289)..(289): n is a, c, g, or t
  modified_base (371)..(371): a, c, t, g, unknown or other
  misc_feature (371)..(371): n is a, c, g, or t
  modified_base (412)..(412): a, c, t, g, unknown or other
  misc_feature (412)..(412): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcacatggagtttggctgagctggattttcctgctgctatttaaaggtgtccagtgtgaggtgcagctggtggagtcggtgggggagcgttaggggaaagccggtgggggtcccttagactctccngtacagctcgtgtatctatttagatgctgangaccgtggtccgcaggctccgaaggaagggctaggtagtggttaggaccgtaattaaaagagaaactggagtaggtacgganaaagacggtactacgcgtcgaccaaccggtaagaaaaccgngtaacgtactaccaactatactaacgaagtaagtaagtacgaacgttaaacgaaaccgtaaaccgtaaccgtacctttaacgttaaactaaaactaaagtacgtaactaccgaaacgtaaccgaaacgaaaaccggaacgtaaacgaacgtaacgtacgtaacgttaacgtaaccgtaacgtaaaccgaaaacggaaacggaaacgtacgtaacgttaaagttaagtaaacgtaagtaacgttaggttaaggttacgttaacgtacg

SEQ ID NO: 324980 - DNA, 703 bp, Homo sapiens
  misc_feature: GZ8MTXP02JYWXF.38.55.E11.1.454.CMB.2.raw
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtcgtgggggaggcgttagggaagccgtgggggtcccttagactctcctgtacagcctctggtattctactttagtatgcctggatgaccgtcgggtccgccgaggcctaccgaaggaacggggtctagggaagttggggttaggaccgttaagttaaaagtagaaactgagtgggtaggacaactagactacgctcgaccaccggtagaaagcaagacttacacccgtatcctacgaaacgagtaatcgtaacttacgaaacgaacaccgtaccttactttacgtaaaccaaaagttcgaacgtacccgtaaccgtaccctaaacgggaaaacccgtacgggaaacccaacgtaacggtacccggtttaagttaaccgtttaaccgtaccgtaaaccccggtaaaggtaagggggtaaaacgacgtaaccgttaaggttaagttaacgtaaggttaacgttagtaaacgggtttacggtttatttaaccgg

SEQ ID NO: 324981 - DNA, 444 bp, Homo sapiens
  misc_feature: GZ8MTXP02FQ0EG.38.55.E11.1.454.CMB.2.raw
  modified_base (214)..(214): a, c, t, g, unknown or other
  misc_feature (214)..(214): n is a, c, g, or t
  modified_base (326)..(326): a, c, t, g, unknown or other
  misc_feature (326)..(326): n is a, c, g, or t
  modified_base (416)..(416): a, c, t, g, unknown or other
  misc_feature (416)..(416): n is a, c, g, or t
  modified_base (431)..(444): a, c, t, g, unknown or other
  misc_feature (431)..(444): n is a, c, g, or t
tcagtcgatcacgtcacgaccggtgctcgatttagcactcgcacgttgggttggccgtattaaaagtgaaactgatggtgggacaacagactacgctgcacccgtgaaaggcagattcaccatctcaagagatgattcaacgaacacgctctttctacaaatgatcagcctgaaaaccgaggacacagccgtgtattactgtaccacagggaanagcagttattatgatagtagtgttatctgtactactacggtatggacgtctggggccaagggaccacggtcattgtctcccccagcctccacaggcccatcgtcttcccccngcaccctcctccaagacgcacctcgtgggggcacagcggccctgggctgcctggtcaaggactacttccacgtgatcgactgagcgggcnggcaaggcgcatgannnnnnnnnnnnnn

SEQ ID NO: 324982 - DNA, 739 bp, Homo sapiens
  misc_feature: GZ8MTXP02I3WKQ.38.55.E11.1.454.CMB.2.raw
  modified_base (220)..(220): a, c, t, g, unknown or other
  misc_feature (220)..(220): n is a, c, g, or t
  modified_base (261)..(261): a, c, t, g, unknown or other
  misc_feature (261)..(261): n is a, c, g, or t
  modified_base (303)..(303): a, c, t, g, unknown or other
  misc_feature (303)..(303): n is a, c, g, or t
  modified_base (553)..(553): a, c, t, g, unknown or other
  misc_feature (553)..(553): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactcaccatggagtttgggctgagctggattttcctgctgctattttaaaagtgtccagtgtgaggtgcagctggtggagtcgtgggggnggcgttgggaagccgtgggggtcccttagactctctgtacngctctggattctactttagtatgcctggatgacctgggtccncgagctaccgaggaaacgggctaggaagttcggggtttacgggaccgtttaaattaaaacggtcgaaaacgtcggtagtaggggtaggaacctaaacgaacgtacttaccggacttggaccccgacccggttaaaggaaacgggcctaagggtacttaccgaaccctaattcccgtacaaagaggtaattacggaacttaacgaaacgaaccacgtccttaacgtttacctaacgtaattacggacttanaacccgttaccgaaaggaaaacccgaggttaacccaagtacggtaaccccgtaggtttaaaaccttaccggtaaccgttaacccgaaaacggttaggggaaacgtaacccgacgtttaaaagtttgttaaaacgtaacggtttaacgtaacggtttaaaacggtttggtttaaacgttttacccgg

SEQ ID NO: 324983 - DNA, 605 bp, Homo sapiens
  misc_feature: GZ8MTXP02HYDWT.38.55.E11.1.454.CMB.2.raw
  modified_base (134)..(134): a, c, t, g, unknown or other
  misc_feature (134)..(134): n is a, c, g, or t
  modified_base (221)..(221): a, c, t, g, unknown or other
  misc_feature (221)..(221): n is a, c, g, or t
  modified_base (403)..(403): a, c, t, g, unknown or other
  misc_feature (403)..(403): n is a, c, g, or t
  modified_base (564)..(564): a, c, t, g, unknown or other
  misc_feature (564)..(564): n is a, c, g, or t
tcagtcgatcacgtcacgaccggtgctcgatttagcactcgcacgttgggtttggggagatctgggagaggagccccagccttgggattcccaagtgttttcattcagtgatcaggactgaacacagaggactnaccatggagtttgggctgagctggatttccttgctgctatttaaaggtgtcagtgtgaggtgcagctggtggagtcgtgggggaggnttgggaaagccgtgggggtcccttagacttcgtcctgtacacgcctactggattcacttttagttaactgcctgatgacctggtccgcaggcgtacgaggaagggctggagttggtgcgtaataaagtgaaactgatggtacggactaacgagactacgcgtcgactacccgtagaaacgtnacgattacacccgtatactcgaaagacgtataggactttaccaaacgtaaaccgtacgtacttaccgttttacaaacctaaaagtttacgacttacgaagtacccgtagaaaacccgtaggacaacagtccgtagtaactagtacaacgtacgaacggtanaacggtatagttaatttagagttagacgtggttgtaacttg

SEQ ID NO: 324984 - DNA, 529 bp, Homo sapiens
  misc_feature: GZ8MTXP01B9DA8.4.7.A07.1.454.CMB.2.raw
  modified_base (426)..(426): a, c, t, g, unknown or other
  misc_feature (426)..(426): n is a, c, g, or t
  modified_base (434)..(435): a, c, t, g, unknown or other
  misc_feature (434)..(435): n is a, c, g, or t
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagcgtggcgttttctaggtggctattttaaaggtgtccagtgtgaggtgcagctggtggagtctgggggaggcttggtacagcctggggggtccctgagactctcctgtgcagcctctggattcatctttagcagctatgccatgagctgggtccgccaggctccgagggggaaggggctggaatgggtctcatcctattagtgctactaactgggtggcacatacttcgcagactccgtgaagggccgttctccatctccagagacaattccaagaacaccggtntgtatctnnatagtacacgtacacgacgagaacgacggacgacgacgtacgtattacgttgttgtaagtaagtaaggtaggtaggttacgtaacgaacgtcgg

SEQ ID NO: 324985 - DNA, 500 bp, Homo sapiens
  misc_feature: GZ8MTXP01A3EL2.4.7.A07.1.454.CMB.2.raw
  modified_base (257)..(257): a, c, t, g, unknown or other
  misc_feature (257)..(257): n is a, c, g, or t
  modified_base (293)..(293): a, c, t, g, unknown or other
  misc_feature (293)..(293): n is a, c, g, or t
  modified_base (384)..(384): a, c, t, g, unknown or other
  misc_feature (384)..(384): n is a, c, g, or t
  modified_base (388)..(388): a, c, t, g, unknown or other
  misc_feature (388)..(388): n is a, c, g, or t
  modified_base (391)..(391): a, c, t, g, unknown or other
  misc_feature (391)..(391): n is a, c, g, or t
  modified_base (412)..(412): a, c, t, g, unknown or other
  misc_feature (412)..(412): n is a, c, g, or t
  modified_base (420)..(420): a, c, t, g, unknown or other
  misc_feature (420)..(420): n is a, c, g, or t
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagcgtgtcgttttctaggtggctaattttaaaaggtgtcagtgtgaggtgcagctggtggagtctgggggaggcttggtacagccgtgggggtccctgagctctcctgtgcagcctntggattcatcttagcagctatgccatgagctggccnccaggctcgagggaagggctggaatgggtctcatcctatagtgctactaactgtggcacatacttcgcagactccgtgaaggcggtctccnctcncanacacactacaacaacacgctntatactanactatagacacgtcgagacgagaacgacgacgacgcgtatattgttgttgaagagtaagtaggtagacgtaacgcgtcgg

SEQ ID NO: 324986 - DNA, 608 bp, Homo sapiens
  misc_feature: GZ8MTXP01AYTZA.4.7.A07.1.454.CMB.2.raw
  modified_base (258)..(258): a, c, t, g, unknown or other
  misc_feature (258)..(258): n is a, c, g, or t
  modified_base (260)..(261): a, c, t, g, unknown or other
  misc_feature (260)..(261): n is a, c, g, or t
  modified_base (263)..(263): a, c, t, g, unknown or other
  misc_feature (263)..(263): n is a, c, g, or t
  modified_base (266)..(267): a, c, t, g, unknown or other
  misc_feature (266)..(267): n is a, c, g, or t
  modified_base (269)..(269): a, c, t, g, unknown or other
  misc_feature (269)..(269): n is a, c, g, or t
  modified_base (272)..(272): a, c, t, g, unknown or other
  misc_feature (272)..(272): n is a, c, g, or t
  modified_base (279)..(279): a, c, t, g, unknown or other
  misc_feature (279)..(279): n is a, c, g, or t
  modified_base (307)..(307): a, c, t, g, unknown or other
  misc_feature (307)..(307): n is a, c, g, or t
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagcgtgcgtttctaggtggctattttaaaaggtgtccagtgtgaggtgcagctggtggagtctgggggagcttggtacagcctggggggtccctgagctctcctgtgcagctctggtntnntnttnnanctntgcatgngcgtcggtccgcgagcgcgagggagggngtggagtggtctcatctatagtgtctactaacgtggtgcactactactcgtacacgtacgtccgtacggtacgggtccggttctcctactacctaccgacgaacgaactaactaaccaaacgaaacgacggtacgtacgtactacgtacgtactaacgttacgaacgacgtacgtacgacggacggaaccggacggaaccggaaccggttaccgttaacgttaacgttacgttacggttacggtaacggtaaaggtaacggttaagggtaaggttacggtaaccggttaacggtaacgggg

SEQ ID NO: 324987 - DNA, 505 bp, Homo sapiens
  misc_feature: GZ8MTXP01DLLW1.4.7.A07.1.454.CMB.2.raw
  modified_base (298)..(298): a, c, t, g, unknown or other
  misc_feature (298)..(298): n is a, c, g, or t
  modified_base (362)..(362): a, c, t, g, unknown or other
  misc_feature (362)..(362): n is a, c, g, or t
  modified_base (391)..(391): a, c, t, g, unknown or other
  misc_feature (391)..(391): n is a, c, g, or t
  modified_base (401)..(401): a, c, t, g, unknown or other
  misc_feature (401)..(401): n is a, c, g, or t
  modified_base (437)..(437): a, c, t, g, unknown or other
  misc_feature (437)..(437): n is a, c, g, or t
  modified_base (445)..(445): a, c, t, g, unknown or other
  misc_feature (445)..(445): n is a, c, g, or t
  modified_base (469)..(469): a, c, t, g, unknown or other
  misc_feature (469)..(469): n is a, c, g, or t
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagctgactttttcttgtggctattttaaaaggtgtccagtgtgaggtgcagctggtggagtcgtgggggaggcttggtacaggccgtggggggtccctgagactctcctgtgcagcctctggattcatcttagcagctatgccatgagctcgggtccnccgaggctccgaggggaagggctggatgggtctcgatcctattagtgctactaactggtgcaanatactcgcagactcgtgaacggccgttcncatctcaganacaatccaaagacacggctgtatctgcaattgaacngcctgagngccgaggacacggcgtatattacngttgaacgaagtgttggggattgaaccaagtcgggg

SEQ ID NO: 324988 - DNA, 625 bp, Homo sapiens
  misc_feature: GZ8MTXP01EE5CY.4.7.A07.1.454.CMB.2.raw
  modified_base (224)..(224): a, c, t, g, unknown or other
  misc_feature (224)..(224): n is a, c, g, or t
  modified_base (253)..(253): a, c, t, g, unknown or other
  misc_feature (253)..(253): n is a, c, g, or t
  modified_base (264)..(264): a, c, t, g, unknown or other
  misc_feature (264)..(264): n is a, c, g, or t
  modified_base (276)..(276): a, c, t, g, unknown or other
  misc_feature (276)..(276): n is a, c, g, or t
  modified_base (282)..(282): a, c, t, g, unknown or other
  misc_feature (282)..(282): n is a, c, g, or t
  modified_base (288)..(288): a, c, t, g, unknown or other
  misc_feature (288)..(288): n is a, c, g, or t
  modified_base (321)..(321): a, c, t, g, unknown or other
  misc_feature (321)..(321): n is a, c, g, or t
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagcgtgtcgttttctaggtggctaattttaaaaggtgtcagtgtgaggtgcagcgtggtggagtcgtgggggagcttggtacgngtcggtcgggtcctgatctctcgtgcgcngtctgtgtatntatctagcagtntatgtntagtgngtcgtcggtccgcgacgcgtacggagggagggngtaggtagtcgtctactatacgttagttagtcgtactacgtaacgtcggtcgtactactactacgtcgtacgacgtacgtacgtacggtacggtccgtcctacctactaccgtacgaacgtaacgaactaactaaccgaaacgtaaccgtacggtacgttacgtacttacgtacgtaacgtaacgtaacgtaacgtacgtacgtacgacgacggaacggacggacgtacgttacgtacgttacgttacgttgttacgtaagtaaggtaaggtaggtacggttacgtaaccggaacggtaacggg

SEQ ID NO: 324989 - DNA, 567 bp, Homo sapiens
  misc_feature: GZ8MTXP01C9GB6.4.7.A07.1.454.CMB.2.raw
  modified_base (407)..(407): a, c, t, g, unknown or other
  misc_feature (407)..(407): n is a, c, g, or t
  modified_base (458)..(458): a, c, t, g, unknown or other
  misc_feature (458)..(458): n is a, c, g, or t
  modified_base (471)..(471): a, c, t, g, unknown or other
  misc_feature (471)..(471): n is a, c, g, or t
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagcgtggtctttttcttggtggcttaattttaaaaggtgtccagtgtgaggtgcagctggtggagtcgtgggggagcttggtacaggccgtggggggtccctggagactctcctgtgcagcctctggattcatcttagcagctatgccatgagctgggtccgccaggctccgagggggaacgggggctagggaatgggtctcattcctattagtgctactaacgtggtgacacattactcgcagactccgtagaacgggtccgttcnccatctaccagacgactaaacttccaaagaaccacggcttgtaactcgtanactaatacgaacncgtctagacgacggaaccgaggaccgacggttacgttaatattacgttggttagaagtaaaggtggttagggacttacggtaacgaacgggtcggg

SEQ ID NO: 324990 - DNA, 526 bp, Homo sapiens
  misc_feature: GZ8MTXP01BS126.4.7.A07.1.454.CMB.2.raw
  modified_base (376)..(376): a, c, t, g, unknown or other
  misc_feature (376)..(376): n is a, c, g, or t
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagcgtggcttttctaggtggctaattttaaaaggtgtccagtgtgaggtgcagctggtggagtcgtgggggaggcttggtacaggccgtggggggtccctgagactctcctgtgcagcctctggattcatctttagcagctatgccatgagcgtgggtccgccaggctccgagggggaaggggctgggaatgggtctcgatcctattagtgctactaacgtggtgcacatactcgnagtactccgtgagggtccgtctccatctccagagacaatcaaagaacacggctgtatctagcctaatgaacagcctgagagccgaaggacacggcgtatattacgttgcgaagaaagtgtttgggggaattcggaaccaacggtcggggg

SEQ ID NO: 324991 - DNA, 634 bp, Homo sapiens
  misc_feature: GZ8MTXP01AKODZ.4.7.A07.1.454.CMB.2.raw
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagctggtctttttctgtggcttaattttaaaggtgtccagtgtgaggtgcagctggtggagtcgtgggggagcttggtacaggccgtgggggtccctgagactctcctgtgcagcctctggattcatcttagcagctatgccatgagcgtgggtcccgcgaggctaccggagggggaacgggctagggagtgggtctcatccttattgtgtactacgtaacgtggtggctactattacctcgacacgtccgtccggtaggaaccgggtccgttcctccattcctaccgaagacgaacctaactaccaaagtaccacggtcttaacgtactaccgtagacctaagttacgaaaccacgtcccgtaggaacgaccggaaccggaacggaccgtaccgggttaccgttaaattacgttaccgttgggttacgtaaacgggtaaaggttaagggtttaacgggggaacttaccgggtaaccgaacgggtaaccggggg

SEQ ID NO: 324992 - DNA, 601 bp, Homo sapiens
  misc_feature: GZ8MTXP01AU800.4.7.A07.1.454.CMB.2.raw
  modified_base (218)..(218): a, c, t, g, unknown or other
  misc_feature (218)..(218): n is a, c, g, or t
  modified_base (249)..(249): a, c, t, g, unknown or other
  misc_feature (249)..(249): n is a, c, g, or t
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagcgtgtcgtttctaggtggctatttaaaaggtgtcagtgtgaggtgcagctggtggagtgtgggggagcttggtacngccgtgggggtccctgagactctcctgtgcncgctgtgtattctatcttagcagtctatcgctatgtacgtcgtcggtccgccgacggacgtacggaggggacggggtacggtaggtaggtcggtcgtactactacttagttagtcgtctacgtaacgtggtcgactactactactacgtacgacgtacgtcgtacggtacggtccgtctacctactactacgacgaacgaactaactaacgaaacgaacgacggtacgtacgtactactacgtactaacgtacgaacgacgtcgtagacgacgaacgacgacgacgttacgtaacgtacttacgttgttagtaagtaagtaaggtaggtagttacgtaacgaacggtaacgg

SEQ ID NO: 324993 - DNA, 557 bp, Homo sapiens
  misc_feature: GZ8MTXP01A062I.4.7.A07.1.454.CMB.2.raw
  modified_base (407)..(407): a, c, t, g, unknown or other
  misc_feature (407)..(407): n is a, c, g, or t
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagctggtctttttcttgtggctattttaaaaggtgtccagtgtgaggtgcagctggtggagtcgtgggggaggcttggtacagccgtggggggtccctgagactctcctgtgcagcctctggattcatctttagcagctatgccagtgagctcgggtccgccaggctccggaggggaacgggggctagggagttgggtctcagttccttagttagtgactacgtaacgtggtgcacattactcgcagactcgtgacgggtccgttcnccatctcagacacaatccaagaacacgctagtatcgtagactaattacgaaactcgccgtagacgacggccggaaggaccgacggttaccgtagtaacttacgttgttacgaagaagtaagttcggggattcgaacgttcggtaacgggg

SEQ ID NO: 324994 - DNA, 558 bp, Homo sapiens
  misc_feature: GZ8MTXP01BVUOK.4.7.A07.1.454.CMB.2.raw
  modified_base (256)..(256): a, c, t, g, unknown or other
  misc_feature (256)..(256): n is a, c, g, or t
  modified_base (363)..(363): a, c, t, g, unknown or other
  misc_feature (363)..(363): n is a, c, g, or t
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagcgtgtcttttctagtggctattttaaaaggtgtcagtgtgaggtgcagctggtggagtcgtgggggaggcttggtacagccgtggggggtcctgagactctcctgtgcagcctntggattcatcttagcagctatgccatgagctgggtccgccgaggctccgaggggaaggggctaggagtgggtactcatcctattagtgtctactaacgtggtgcaantacttcgcagaccgttccgtaggacgggtcccggtttctccctatcctaccaaggacaactaaactaccgaaagacaccggtattgtaatcgtatatatagacacgtcgagagacgaacggacgacgacgttacgtactattacgttgttagtaagtaagtaaggttaggtagttacgtaacgaacggtaacggg

SEQ ID NO: 324995 - DNA, 563 bp, Homo sapiens
  misc_feature: GZ8MTXP01CJKU2.4.7.A07.1.454.CMB.2.raw
  modified_base (397)..(397): a, c, t, g, unknown or other
  misc_feature (397)..(397): n is a, c, g, or t
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagcgtggcttttctagtggctattttaaaaggtgtccagtgtgaggtgcagctggtggagtcgtgggggaggcttggtacaggccgtggggggtccctgagactctcctgtgcagcctctggattcatcttagcagctatgccatgagcgtgggtccgccgaggcctccgagggggaagggggctagggatgggtctcgattcctattagtgctactaacgtggtgcacatactcgcagactccgtgacggccgtcncatctccagacacaacttccaagaaccacgggcttaggtactcgtgactagttcgaaactgccctagaggacgcccggaaggaccgaccgggccgttaatctttaccgttgttacggaacgtaaaggtggtttaggggaattcggaacccgttcgggtaaccgggg

SEQ ID NO: 324996 - DNA, 631 bp, Homo sapiens
  misc_feature: GZ8MTXP01B7SK7.4.7.A07.1.454.CMB.2.raw
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagctggcttttcttgtggctattttaaaggtgtccagtgtgaggtgcagctggtggagtcgtgggggaggcttggtacagccgtggggggtccctgagactctcctgtacagcctctggattcatcttagcagctatgccatgagcgtggggtcccgccgaggcctccgagggggaaggggctggaagtgggtctcatcttaattaggtgctactacgtggtcgcactatacttcgcacgactccgtggaacgggtcccggttctccatcctaccgaagacgaaccaacttacccaaaggaaccaccggtacttaggtaactcgtagaacctaaagtttcggaaactacggcctgggaacggaacggcccggaaagggaccgaaccgggtcccggttaaattaaacgtttaccgttagggttacgacgggtaaaaggttaggttttaagggggaaacttcgggaacccgtaacggttcgggggaaccccgg

SEQ ID NO: 324997 - DNA, 537 bp, Homo sapiens
  misc_feature: GZ8MTXP01E04UG.4.7.A07.1.454.CMB.2.raw
  modified_base (398)..(398): a, c, t, g, unknown or other
  misc_feature (398)..(398): n is a, c, g, or t
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagctggtctttttcttgtggctattttaaaaggtgtccagtgtgaggtgcagctggtggagtcgtgggggaggcttggtacagccgtggggggtccctgagactctcctgtgcagcctctggattcatctttagcagctatgccatgagctgggtccgcaggctccgaggggaagggggctgggaatgggtctcgatcctattagtgctactaacgtgggtggcacatacttcggcagactccgtgaagggccgttcnccatctccagagacaattccaaagaccacggtctgtactctgacaattgaacagcctagacgagccgaaggacacggccgtaatattaacgttgttgaacgaaagtgtttagggggaattcgaaccgaacgtccggggg

SEQ ID NO: 324998 - DNA, 674 bp, Homo sapiens
  misc_feature: GZ8MTXP01DCNTZ.4.7.A07.1.454.CMB.2.raw
tcagagcactgtagcacgaccggtgctcgatttagcacgtgtcgcaggggctgagagaggagcccagccctgggattttcaggttgttttcatttggtgatcaggactgaacagagagaactcaccatggagtctgggctgagctggtctttttcttgtggtcttaattttaaaaggtgtccagtgtgaggtgcagctgggtggagtcggtgggggagtcgttggtacaggccgtgggggtccctgagctctcctgtgcagcctctggtattcatcttagcagctatgccatgagcgtcgggtcccgccgaggtcctaccggaagggggaacgggggtccgtagggtaaagttcgggggtacctacgtacgtttacccgttaagtttaggtcgtaccttaacgttaaccgttgggtcggacctaaactacgttaccgttcgacgtacgtacccgtccgttaggaaccggggtccgttctcctagtcctaccgagacgaaactaacttaaccaaacgtaacacggtcttagtactctagtactaaagttcgaaactcgacctagaacgaccggaacgaacggaccgtaacggaccgttaagtaacttacgttggacggtaacgtaaagttaacggtttaaggggaacttacggaaccgttaacgggtaaccgggg

SEQ ID NO: 324999 - DNA, 709 bp, Homo sapiens
  misc_feature: GZ8MTXP01AK1O6.4.7.A07.1.454.CMB.2.raw
  modified_base (255)..(255): a, c, t, g, unknown or other
  misc_feature (255)..(255): n is a, c, g, or t
  modified_base (583)..(583): a, c, t, g, unknown or other
  misc_feature (583)..(583): n is a, c, g, or t
tcagagcactgtagcacgaccggtgctcgatttagcacgtgtcgcaggggctgagagaggagcccagccctgggattttcaggttgttttcatttggtgatcaggactgaacagagagaactcaccatggagtctgggctgagctggtctttttcttgtggcttaattttaaaaggtgtccagtgtgaggtgcagcgtggtggagtcgtgggggagcttggtacagccggtgggggtccctgagactctcctgtncagcctctggattcatcttagcagctatcgccatgagcgtcgggtcccgccgaggccgtaccggaagggggaacggggtcgtagggtaaagttcgggggtctacgtattcccgttaagtttaggtcgtaccttaacgtaaaccgttggggtcggtaccaaacctagttacccttccggacaacggtacccgttcccgggtagggtaaccggggttcccggtttacctacccgtattaccccgtacccgaaggtaaacgaaccttaaacgttacccgaaagaacccgtacgggtaccttaggtactacgtagacctaaagttcgaaacncgtaccaggaacgaccggaaccggaacggaccgtacggttaccgttaattaacgttaccgttggttacggtaacggtaaaggttcggtttaaggggacttaccggtaacccgcgggtaaccggggg

SEQ ID NO: 325000 - DNA, 692 bp, Homo sapiens
  misc_feature: GZ8MTXP01AF0HD.4.7.A07.1.454.CMB.2.raw
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagcttgtctttttcttgtggcttattttaaaaggtgtccagtgtgaggtgcagctggtggagtcgtgggggagcttggtacagccgtgggggtccctgagactctcctgtgcagcctctggattcatcttagcagctatgccatgacgcgtcgggtcccgccgaggctccggagggggaacgggggctaggggaaagttcggggtctacgtattcccttaagtttaggtcgtaccttaaccgttaaacggttcggggttcggcctaaacctaagtttacccgtttccgacgtaacggtacccgttacccgggttagggtaaccgggggtccccggtttctaccctagttaccctacccgtaaggacgaactaaacgttaccgaaagtaaccacgggtctaggtactccgtagctaagttacgaacaggtccctaggacgcggaaccggaaggaccgaaccgggttccgtaaattaagttaccgttgggttacggtaacgggtaaaagtcgggtttaagggggacttaccgggaaccgaacggtaaccggggg

SEQ ID NO: 325001 - DNA, 813 bp, Homo sapiens
  misc_feature: GZ8MTXP01CQORG.4.7.A07.1.454.CMB.2.raw
  modified_base (175)..(175): a, c, t, g, unknown or other
  misc_feature (175)..(175): n is a, c, g, or t
  modified_base (301)..(301): a, c, t, g, unknown or other
  misc_feature (301)..(301): n is a, c, g, or t
  modified_base (337)..(337): a, c, t, g, unknown or other
  misc_feature (337)..(337): n is a, c, g, or t
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagctggtctttttcttgtggctattttaaaaggtntccagtgtgagtgcagctggtggagtcgtgggggagcttggtacaggccgtggggggtccctgagactctcctgtgcacgcctctggtattcatctttagcagctatgccatgagcgtcggtcccncgaggctaccgaggggagggctgggaagtgggtctntattcccttattagtgtactacgtaaacgttcgggtggaccaactacttacgttcgaccgtaacggtaccccgttaccgggttagggtaaaccgggggttccccggtttacctacccgtaacgttacccgttaaaccccgaaggggttaaaccgaaaaccttaaaaccgtttaaccccgaaaaacggggtaaacccctaaaccggggttcgtttaacgggttaactacccggtttaacgggaacttaaaacgtttacggaaaaaaccttcgggaccccgttaaggggaaacggtaaccggtaaaccccggggaacggggttaaaccccgtaaacccgggggttaccccggttttaaaattaaacggttttaacccggttgggttaacgggtaaaccgggttaaaaaaggtggggtttttaaacgggggaaacgtttaccgggaaccccgttaaccgggggtttaaaccccgggggg

SEQ ID NO: 325002 - DNA, 720 bp, Homo sapiens
  misc_feature: GZ8MTXP01AU1H3.4.7.A07.1.454.CMB.2.raw
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagctggtctttttcttgtggtcttaattttaaaaggtgtccagtgtgaggtgcagctggtggagtcgtgggggaggcttgggtacacgtccggtggggggtcccctggagactctcctgtcgcacgcctcgtggtattctatctttagcagctatcgccatgagcgtcgggtcccgccgaggcctaccggagggggaaggggcgtagggaagttgggtctctattccttagttagtcgtacctacgtaacgttgggtcggacctaacgtacttaccgttcgactaacggtacccgttcccggtagggtaaaccgggggtccccgttaccttacccgagttccccgttaacccgaaagggtaaccgaaaccttaaacgtttaaccccgaaaacgtaaaccctacccggggtacgttacggttaacttccgttacgaaacccgtaagtttacgaaaccgtcgtacccgtagacggacggaaccgaagggaccgaccggttacgttaatacttacgttgacggtaaacggtaaagttgggtttaaggggaacttacgggaacccgttaacgggtaacccgggg

SEQ ID NO: 325003 - DNA, 668 bp, Homo sapiens
  misc_feature: GZ8MTXP01EVBN4.4.7.A07.1.454.CMB.2.raw
  modified_base (218)..(218): a, c, t, g, unknown or other
  misc_feature (218)..(218): n is a, c, g, or t
  modified_base (299)..(299): a, c, t, g, unknown or other
  misc_feature (299)..(299): n is a, c, g, or t
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagctggtcttttcttgtggctattttaaaaggtgtccagtgtgaggtgcagctggtggagctgggggagcttggtacngccgtgggggtccctgagactctcctgtgcagcctctggattcatcttagcagtctatgccatgagcgtgggtcccgaccngccgtaccggagggggaacgggtcgtagggaatcgggtctcgattaccgtatttaggtcgtcctaacgtaacgttgggtcggacatacttacccgtgactacgaaacctccggtacggtaacggggtccgggttccttccctacgttacccaccgacgtaacgaacaaacttaaccaaacgaacgaacgggctcggtaactcctagacgtaacttaacgtaacacgaccgtacgacggaacggaaccggaacggaccggtaacgggacccgttaaacggtttaacgttaacgttacggttaacgggtaacgggtaaacggttaacgggttaacggggttaacgggtaaccggttaacccggtaaccggg

SEQ ID NO: 325004 - DNA, 562 bp, Homo sapiens
  misc_feature: GZ8MTXP01D5T9O.4.7.A07.1.454.CMB.2.raw
  modified_base (175)..(175): a, c, t, g, unknown or other
  misc_feature (175)..(175): n is a, c, g, or t
  modified_base (255)..(255): a, c, t, g, unknown or other
  misc_feature (255)..(255): n is a, c, g, or t
  modified_base (268)..(270): a, c, t, g, unknown or other
  misc_feature (268)..(270): n is a, c, g, or t
  modified_base (272)..(273): a, c, t, g, unknown or other
  misc_feature (272)..(273): n is a, c, g, or t
  modified_base (275)..(276): a, c, t, g, unknown or other
  misc_feature (275)..(276): n is a, c, g, or t
  modified_base (278)..(278): a, c, t, g, unknown or other
  misc_feature (278)..(278): n is a, c, g, or t
  modified_base (304)..(304): a, c, t, g, unknown or other
  misc_feature (304)..(304): n is a, c, g, or t
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagcgtggtcgttttctagtgctaattttaaaaggngtcagtgtgagtgcagctggtggagtcgtgggggagcttggtacagccgtgggggtccctgagctctcctgtgcagcctnggatcatcttagnnntnncnngngcgtcgcgcgacgcgtacgaggaggngtagagtcgtctctatactatagtagtactactaacgtgtgactactactactacgacgacgtacgtacgtacggtacggtccgttactctactactacgaacgacgaactaactaacaaacgaacgacgtacgtagtactacgtacgtactaagtaacgaacgacgtacgagacgacgaacgaacggacgtacgacgtagttaattacgttgttacgaagtaagtaaggtaggtagttacgtaacgaacggtaacgg

SEQ ID NO: 325005 - DNA, 665 bp, Homo sapiens
  misc_feature: GZ8MTXP01EOVQ3.4.7.A07.1.454.CMB.2.raw
tcagagcactgtagcacgaccggtgctcgatttagcacgtgtcgcaggggctgagagaggagcccagccctgggattttcaggttgttttcatttggtgatcaggactgaacagagagaactcaccatggagtctgggctgagcttggtctttttcttgtggtcttaattttaaaaggtgtccagtgtgaggtgcagctggtggagtcgtgggggagcgttggtacaggccgtgggggtccctgagactctcctgtgcagcctcgtggtattcatctttagcagctatgccatgagcgtcggtccgccgaggctccggaagggggacgggcgtagggaagttcgggtctactattaccttagttagtcgtacttacgtaacgtgggtcgactactattacgttcgcagtacctcccgggtaggaaccgggtccgttctccattccctacgaagacgtaactaacgttaaccaaagtaacctacgggtacttaggtaactcgttacgaacctaaagtttacggaaaacctcgtacccgtaggaacggacggaaccgggaggaacccgaccggttaccgttaattaacgtttacgttggttacggtaacgtaaaggttaaggtttagggggaacttacgggtaacccgttaacggggtaacccgggg

SEQ ID NO: 325006 - DNA, 758 bp, Homo sapiens
  misc_feature: GZ8MTXP01DHY1W.4.7.A07.1.454.CMB.2.raw
tcagagcactgtagcacgaccggtgctcgatttagcacgtgtcgcaggggctgagagaggagcccagccctgggattttcaggtgttttcatttggtgatcaggactgaacagagagactcaccatggagtctgggctgagctggtctttttcttgtggcttattttaaaaggtgtccagtgtgaggtgcagctggtggagtcgtgggggaggtcgttggtacacggccgtggggggtccctgagactctcctgtgcagcctctggtattcatcttagcagtctatgccatgagcgtcgggtccgccgaggcctaccggagggggaacgggggtcgtaggggtaagttcggggtctcgactttccctaagttaggtcgtaccttacgtaacggttgggtcggacctaactaacgtttaccgttccgacgtaacggtacccgttcccggttagggtaaaccgggggtccccggtttaccgtccctaacttaccgtaccccgaaggtaaccggaaccttaaaacttaccccgaaaaagtaaacccgaccgggttccgttaggttaaaccttcgtacggtaacccttaaagtttacgaaaccgtacgtacccgtagggaacggaccgggaacccggtaacgggaccggtaacccgggttacctttaagttacgtttaaccgttgggttaacggtaacggtaaaaaggttcggggttttaagggggaacgttaccgggaaccgttcggggtaacccgggggg

SEQ ID NO: 325007 - DNA, 687 bp, Homo sapiens
  misc_feature: GZ8MTXP01BLGZQ.4.7.A07.1.454.CMB.2.raw
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagctggtctttttcttgtggctattttaaaaggtgtccagtgtgaggtgcagctggtggagtcgtgggggagcttggtacaggccgtggggggtccctgagactctcctgtgcagcctctggattcatctttagcagctatcgccatgagcgtcgggtcccgccgacggcctaccggagggggaacgggcgtagggaagttggggtcctacgtattcccgttatttagtcggtaccttacgttaaccggttggggtcggaccctaactacttacccgtttcggactacggtacctccgggtaggaacgggtcccggttctaccatccgtaccagggaacacaaacttacccaaaggaaccctacgggtcttagtaacctcgtacactaaagttacgaaactcgtacctagggaacgacccgggaacccggaaacgggaccgtacccggggttacccttaaaggttactttaaccggttgttaaggaaccggtaaaagttcgggtttagggggaacttcgggaacccgttaacgggtaacccgggggg

SEQ ID NO: 325008 - DNA, 718 bp, Homo sapiens
  misc_feature: GZ8MTXP01DK5YC.4.7.A07.1.454.CMB.2.raw
  modified_base (193)..(193): a, c, t, g, unknown or other
  misc_feature (193)..(193): n is a, c, g, or t
  modified_base (220)..(220): a, c, t, g, unknown or other
  misc_feature (220)..(220): n is a, c, g, or t
  modified_base (252)..(252): a, c, t, g, unknown or other
  misc_feature (252)..(252): n is a, c, g, or t
  modified_base (269)..(269): a, c, t, g, unknown or other
  misc_feature (269)..(269): n is a, c, g, or t
  modified_base (299)..(299): a, c, t, g, unknown or other
  misc_feature (299)..(299): n is a, c, g, or t
  modified_base (312)..(312): a, c, t, g, unknown or other
  misc_feature (312)..(312): n is a, c, g, or t
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagcgtgtcgttttctaggtggctaattttaaaaggtgtcagtgtgagtgcagntggtggagtgtgggggagcttggtacngcgtgggggtcctgagctctctgtgcagcctntggatctatcttagcanctatgccatgagcgtcggtccgccacggcncccgagggagggngtaggaagtgggtctcataccctattagtggtctactaaaccgtggttgggacactataactttcgacgacgtaccgtaccgtacggtaaacggggtacccggggttaccgtcccgtaaaccgttcccgtttacccctaacgggtaaaaacgtaaaccgtaaaccgttaaacccgtaaaccgtaaaccgtaaccggtacgttacgttaacgttacgtaccgtaacgtaacgttaacgtaaaccgtaaccgtaccgtacggaacggaacggaaccgggtaaaccgggaaccggtaaccggttaaccggttaacgttaacgttaacgttacggttaacggtaaacggtaaacggttaaacgggttaacgggtaacggttaccggtaaccggttaaccgggtaaccggg

SEQ ID NO: 325009 - DNA, 688 bp, Homo sapiens
  misc_feature: GZ8MTXP01BHPFR.4.7.A07.1.454.CMB.2.raw
  modified_base (380)..(380): a, c, t, g, unknown or other
  misc_feature (380)..(380): n is a, c, g, or t
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagctggtctttttcttgtggctattttaaaaggtgtccagtgtgaggtgcagctggtggagtcgtgggggaggcttggtacagccgtggggggtccctgagactctcctgtgcagcctctggattcatcttagcagctatgccatgagcgtcgggtccgccgaggctaccgaggggaagggcgtggaagtgggtctcagtcctattagtgctactaacgtggtggcactacttacttcgnaccccccccgtagtcccgtaggtaacgggtcccggttctcccgtaacttccctacccgaagaacgaacctaaacttaacccgaaacgaaacccgaaccggggtacctttaggttaaacttcccgttaggaacccgtaaatttacgaaaccgtaacgcccgtaggacggaacggaacccggaacgggaaccgaaccgggttacccggttaaattaacgtttaaccgttggttacgggtaacggtaaaaggttaacgggttttaacgggggaaagtttacgggaacccggttaaccgggtaaccgggggg

SEQ ID NO: 325010 - DNA, 646 bp, Homo sapiens
  misc_feature: GZ8MTXP01DX0BQ.4.7.A07.1.454.CMB.2.raw
  modified_base (548)..(548): a, c, t, g, unknown or other
  misc_feature (548)..(548): n is a, c, g, or t
  modified_base (598)..(598): a, c, t, g, unknown or other
  misc_feature (598)..(598): n is a, c, g, or t
tcagagcactgtagcacgaccggtgctcgatttagcacgtgtcgcaggggctgagagaggagcccagccctgggatttttcaggtgttttcatttggtgatcaggactgaacagagagaactcaccatggagtctgggctgagctggtctttttcttgtggtcttattttaaaaggtgtccagtgtgaggtgcagctggtggagtcgtgggggagtcgttggtacagccgtgggggtccctgagactctcctgtgcagcctcgtggattcatcttagcagctatgccatgagcgtcgggtccgccgaggcctaccggaagggggaacggggtctagggaagttcggggtctctacttccttagttaggtgtaccttaacgttaacgtgggttcgggactaactaacgttaccgttcgacgtaacgtaccgtccggtagggtaacggggtcccggttctacctattaccgtacccgaagacgaactaaacttaccgaaacgaaccgacgggtcttacgtaacttcctgtacctaaacgttgaaaaccgngtaccctaggaacggcgaaccgaaggaccgaccggacgtattacgttagngttagaacggtaaagtgttaggggacttcgaaccgttcggaaccgggg

SEQ ID NO: 325011 - DNA, 725 bp, Homo sapiens
  misc_feature: GZ8MTXP01AJSKQ.4.7.A07.1.454.CMB.2.raw
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagctggtctttttcttgtggtcttaattttaaaaggtgtccagtgtgaggtgcagcgtggtggagtcgtgggggagtcttggtacaggccggtgggggtccctgagactctcctgtgcacgcctcgtggtattctatcttagctagtctagtcgccagtgacgtcgtcgggtcccgccgaggccgtacgggagggggacggggcgtagggagttcgggtctacgtattaccttagttagtcgtaccttacgtaacgtgggtcgacctactacttaccgtcgactacggtacccgttacccgggtagggtaacccggggttcccgttacctacccgtacttcccgtacccgaaggtaaaccgaaaccttaaaccttaacccgaaaaggtaaacccctacgggggttcttaggttaacctaccgtaggaccttaaagttaccgaaaacgtcggtacccgtaaggaacggaccgggaacccggaaagggaacccgtaccgggttaccttaaattacgttacgttggttaacggaacgtaaaggtaaggtttaggggaacttcggaaccggttcgggtaaccccggggg

SEQ ID NO: 325012 - DNA, 738 bp, Homo sapiens
  misc_feature: GZ8MTXP01A75A6.4.7.A07.1.454.CMB.2.raw
  modified_base (686)..(686): a, c, t, g, unknown or other
  misc_feature (686)..(686): n is a, c, g, or t
  modified_base (716)..(716): a, c, t, g, unknown or other
  misc_feature (716)..(716): n is a, c, g, or t
tcagagcactgtagcacgaccggtgctcgatttagcacgtgtcgcaggggctgagagaggagcccagccctaggattttcaggtgttttcatttggtgatcaggactgaacagagagaactcaccatggagtctgggctgagctggtctttttcttgtggtcttaattttaaaaggtgtccagtgtgaggtgcagctggtggagtcgtgggggagcgttggtacaggccgtcggggggtccctgagtacttctccgtgtagccacgtcctcgtggtattcaatctttagcagcttatcgaccatggacgtcggtcgggtacccgaccgaggccgtaccggaaggggggtaacgggggtcgttaggggtaaacggttcgggggttacctacgtacgtttaccccttaagtttaggttccggtaccttaacgtttaaacggtcgggttcggacctaaacgtacttaccgtttacgacctaacgggtaacccgttcccgggtagggtaaaccgggggttccccgtttacttacccgacttaccccgtacgtaaacgacgtaaacaaactttacccggaaaagtacccgacggtctagttaactcgttacgacctaattagaaaccgtcgtacgacggacgacgggaacccgaaggaacccgaccggggttacttaaaggtaatttccgnggttaggtaagaaagttcgggttagggacncgggaacgttcgggtaacgggg

SEQ ID NO: 325013 - DNA, 744 bp, Homo sapiens
  misc_feature: GZ8MTXP01BO0BL.4.7.A07.1.454.CMB.2.raw
  modified_base (588)..(588): a, c, t, g, unknown or other
  misc_feature (588)..(588): n is a, c, g, or t
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagctggtctttttcttgtggtctaattttaaaaggtgtccagtgtgaggtgcagctgggtggagtcgtgggggaggtcgttggtacgacggtccggtcggggggttcccctggacgtacttcgtcctgtcgccacgcctcgtggtattctatctttagcagtctatcgccagtgacggcgtcgggtcccgccgaggccgtaccggagggggaacgggggtcgtagggtaagttcgggtcctactacgttacctttagttaggtcgtaccttaacgttaaacggtgggttcggacctaaactacgttaccttcgacgtacggtaaccttccgggtaggaaccgggttcccgtccttccatttccaccgaaggtaacgaaaccaaacgttacccaaaaggtaaccacgggtccgttagtactctaacggtaactaacgttacgaaaccgngtcccgaagggtaacggacccgggaacgggaaaccgggttaccgtaaacccggttacccggttaaatttaacgttaccgttgggttaccgtaaggtaaacggtaaggttttaacgggggacttaccgggtaaccgttaaccgggggtaacccgggg

SEQ ID NO: 325014 - DNA, 659 bp, Homo sapiens
  misc_feature: GZ8MTXP01EHV25.4.7.A07.1.454.CMB.2.raw
  modified_base (261)..(261): a, c, t, g, unknown or other
  misc_feature (261)..(261): n is a, c, g, or t
  modified_base (300)..(300): a, c, t, g, unknown or other
  misc_feature (300)..(300): n is a, c, g, or t
  modified_base (303)..(303): a, c, t, g, unknown or other
  misc_feature (303)..(303): n is a, c, g, or t
  modified_base (356)..(356): a, c, t, g, unknown or other
  misc_feature (356)..(356): n is a, c, g, or t
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagctggtctttttcttgtggcttaattttaaaaggtgtccagtgtgaggtgcagctggtggagtcgtgggggaggcttggtacaggccgtggggggtccctgagctctcctgtgcagcctntggattcatcttagcagctatgccatggagcgtggtccnccnggcctaccggagggggaagggctagggagttgggtctcgattccttagttagngtaccttactaacgtgggtgacctacgtattacccttcgactaacggtacccgttccgggtagggtaaaccggggttcccggttacctacccgtacttacccgtacccgaaaggaaccgtaaacctaaaacgttaccccaaaaacgggtaaacccaccggggtcctttaaggttacttaccgttaggaacctaaagtttacgaaaccgtacgtcccgtaggacgacgaaccggaacggaccgacgttaccgtattacttacgttgacgaagtaaagtgttagggattcgaacgaacggtcggg

SEQ ID NO: 325015 - DNA, 554 bp, Homo sapiens
  misc_feature: GZ8MTXP01CEA36.4.7.A07.1.454.CMB.2.raw
  modified_base (295)..(295): a, c, t, g, unknown or other
  misc_feature (295)..(295): n is a, c, g, or t
  modified_base (391)..(391): a, c, t, g, unknown or other
  misc_feature (391)..(391): n is a, c, g, or t
  modified_base (440)..(440): a, c, t, g, unknown or other
  misc_feature (440)..(440): n is a, c, g, or t
  modified_base (451)..(451): a, c, t, g, unknown or other
  misc_feature (451)..(451): n is a, c, g, or t
  modified_base (499)..(499): a, c, t, g, unknown or other
  misc_feature (499)..(499): n is a, c, g, or t
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagcgtggcttttctagtggctattttaaaggtgtcagtgtgaggtgcagctggtggagtcgtgggggaggcttgggtacagccgtggggggtccctgagactctcctgtgcagcctctggattcatcttagcagctatgccatgagcgtggtccncctaggctccgaggggaagggctgggatgggtactcgatcctattgtgctactaacgtggtgctacgattactcgcagctccgagaggcccgttancgattccacgagacaactataccaagaccacgggtctagtactccgtanactatacgacncgcgtagacgacgaacggaggaccgtacggttacgttaatcgttacgnggttacgaagtaaagttcggttacgggattaccggtaaccgttcgggtaaccggg

SEQ ID NO: 325016 - DNA, 711 bp, Homo sapiens
  misc_feature: GZ8MTXP01D5XH8.4.7.A07.1.454.CMB.2.raw
  modified_base (296)..(296): a, c, t, g, unknown or other
  misc_feature (296)..(296): n is a, c, g, or t
  modified_base (469)..(469): a, c, t, g, unknown or other
  misc_feature (469)..(469): n is a, c, g, or t
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagctggctttttcttgtggctattttaaaaggtgtccagtgtgaggtgcagctggtggagtcgtgggggaggcttggtacagccgtggggggtccctgagactctcctgtgcagcctctggattcatcttagcagctatgccatgagctgggtccnccgaggctccgagggggaaggggctgggaatgggtctcattcctattagtgacttacgtaacgtgggtcggcaacgtatacttcgactaggacctcccggtagaacggggtcccggttacctccgaattcccgtaccgaagacgaacctaaacgttaccgaaacgtaaaaccnccggggtacttaggttaaactccgttaacgaacctaaagtttaggaaaacccctgggtaccccttaagggaacggacccgggaaccccgggtaaagggttacccgacccgggggttaaccgtttaattaaaccgtttaaccgggttgggttaacgggttaaaccggtaaaaaaggtttcggggtttttagggggggaaaacttaccgggttaaccccggaaacggggtttccccgggggggg

SEQ ID NO: 325017 - DNA, 750 bp, Homo sapiens
  misc_feature: GZ8MTXP01BZ243.4.7.A07.1.454.CMB.2.raw
  modified_base (258)..(258): a, c, t, g, unknown or other
  misc_feature (258)..(258): n is a, c, g, or t
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagctggtcttttcttgtggctaattttaaaaggtgtccagtgtgaggtgcagctggtggagtcgtggggggaggcttgggtacaggtccgtggggggtccctgacgctctcctgtgcngcctctggattcatcttagcctagctatgccagtgagcgtcggggcccgaccgacggctaccgggaagggggaacggggccgttaggggaagttggggtctctattaccgtatttagtcgtactacgttaacgtgggtgaccacgtattaccgttcgccgagtaacccgtccgggtaggaacggggttcccgttcgtaccctactaccgtacccgaggaaccgtaactaaacgtttaccccgaaagtaaacccgtccgggggtacctttagttaaaccgttccctagggtaaaccctttaaacgtttacggaaaacccgaacggttcccgtaaggtaaacgggacccgggaacccgaaacggggaaacccgtaccggggttaccccgttaaatttaacgtttaacccggttggttaacgggaaaccggtaagggttaaccggttttaagggggaacttaaccgggaacccgttaacgggttaacccgggggg

SEQ ID NO: 325018 - DNA, 586 bp, Homo sapiens
  misc_feature: GZ8MTXP01CZF1Y.4.7.A07.1.454.CMB.2.raw
  modified_base (148)..(148): a, c, t, g, unknown or other
  misc_feature (148)..(148): n is a, c, g, or t
  modified_base (174)..(174): a, c, t, g, unknown or other
  misc_feature (174)..(174): n is a, c, g, or t
  modified_base (201)..(201): a, c, t, g, unknown or other
  misc_feature (201)..(201): n is a, c, g, or t
  modified_base (242)..(242): a, c, t, g, unknown or other
  misc_feature (242)..(242): n is a, c, g, or t
  modified_base (247)..(247): a, c, t, g, unknown or other
  misc_feature (247)..(247): n is a, c, g, or t
  modified_base (251)..(251): a, c, t, g, unknown or other
  misc_feature (251)..(251): n is a, c, g, or t
  modified_base (255)..(255): a, c, t, g, unknown or other
  misc_feature (255)..(255): n is a, c, g, or t
  modified_base (257)..(257): a, c, t, g, unknown or other
  misc_feature (257)..(257): n is a, c, g, or t
  modified_base (260)..(260): a, c, t, g, unknown or other
  misc_feature (260)..(260): n is a, c, g, or t
  modified_base (264)..(266): a, c, t, g, unknown or other
  misc_feature (264)..(266): n is a, c, g, or t
  modified_base (268)..(269): a, c, t, g, unknown or other
  misc_feature (268)..(269): n is a, c, g, or t
  modified_base (271)..(272): a, c, t, g, unknown or other
  misc_feature (271)..(272): n is a, c, g, or t
  modified_base (274)..(274): a, c, t, g, unknown or other
  misc_feature (274)..(274): n is a, c, g, or t
  modified_base (298)..(298): a, c, t, g, unknown or other
  misc_feature (298)..(298): n is a, c, g, or t
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagcggtgngtttctaggtggctattttaaaaggntcagtgtgaggtgcagctggtggagtntgggggagcttggacagcctggggggtccctgagctctccngtgcngctntgtntnatntagnnntnncnngngcgtcggcgcgcgcgcgaggaggngtgtagtgtctctatactatagtcgtactacgtaacgtcgtcgcgtacgtactacgtcgtacgtacgtacgtacgtacggtacgggtccggttcgtaccgtacgtacgtacgtacgtaacgaacttaacgtaaccgaaacgtaacgtacggtacgtacgtacgtacgtacgtacgtacgtacgtacgtacgtacgtacgacgacgaacggacggacgtacggttacgtacgttacgttacgttcgacgtaagtaagtaaggtaggtacgttacgtaacgaacggtcgg

SEQ ID NO: 325019 - DNA, 554 bp, Homo sapiens
  misc_feature: GZ8MTXP02IX0WU.4.7.A07.1.454.CMB.2.raw
  modified_base (284)..(284): a, c, t, g, unknown or other
  misc_feature (284)..(284): n is a, c, g, or t
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagcgtgcgtttctaggtggctattttaaaaggtgtccagtgtgaggtgcagctggtggagtctgggggaggcttggtacagcctggggggtccctgagactctcctgtgcagctctggatcatctttagcagctatgccatggngcgtcggtccgccgacggcgtccgacggggaaggggcggtaggtagtcggtcgtctatacttattagtgtactactacgtggtggcgactactacttcgtcgacgacgtccgtacggtacgggtccggtcgtcctactctaccacgagaacaactacaacgaacacgactagtactctagtactatagaacgacgcgtagagacgacgacggacgacgacgtacgtacttacgtagtagaagaagtagttaggtagtacgacgacgtcgg

SEQ ID NO: 325020 - DNA, 507 bp, Homo sapiens
  misc_feature: GZ8MTXP02JVN55.4.7.A07.1.454.CMB.2.raw
  modified_base (402)..(402): a, c, t, g, unknown or other
  misc_feature (402)..(402): n is a, c, g, or t
  modified_base (420)..(420): a, c, t, g, unknown or other
  misc_feature (420)..(420): n is a, c, g, or t
  modified_base (426)..(426): a, c, t, g, unknown or other
  misc_feature (426)..(426): n is a, c, g, or t
  modified_base (428)..(428): a, c, t, g, unknown or other
  misc_feature (428)..(428): n is a, c, g, or t
  modified_base (434)..(434): a, c, t, g, unknown or other
  misc_feature (434)..(434): n is a, c, g, or t
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagcgtgtcgtttctaggtggctattttaaaggtgtccagtgtgaggtgcagctggtggagtctgggggaggcttgggtacagcctggggggtccctgagactctcctgtgcagcctctggattcatctttagcagctatgccatgagctgggtccgccaggctccgaggggaaggggctgggaatggggtctcgatcctattagtgctactactggtggcacatactcgcagactccgtgaaggccgtctccatctccaganacattccaaagaacacgntgtatntnacatanacacgcagagagacgacgacgacgacgtactactacgtagtagaagaagtagtaggtagtacgacgacgtcgg

SEQ ID NO: 325021 - DNA, 502 bp, Homo sapiens
  misc_feature: GZ8MTXP02I2PKC.4.7.A07.1.454.CMB.2.raw
  modified_base (396)..(396): a, c, t, g, unknown or other
  misc_feature (396)..(396): n is a, c, g, or t
  modified_base (422)..(422): a, c, t, g, unknown or other
  misc_feature (422)..(422): n is a, c, g, or t
  modified_base (427)..(427): a, c, t, g, unknown or other
  misc_feature (427)..(427): n is a, c, g, or t
  modified_base (429)..(429): a, c, t, g, unknown or other
  misc_feature (429)..(429): n is a, c, g, or t
  modified_base (434)..(434): a, c, t, g, unknown or other
  misc_feature (434)..(434): n is a, c, g, or t
tcagagcactgtagcacgaccggtgctcgatttagcacgtgtcgcagggctgagagaggagcccagccctgggatttcaggtgtttcatttggtgatcaggactgaacagagagaactcaccatggagtctgggctgagcgtggcttttctgtggctattttaaaggtgtccagtgtgaggtgcagctggtggagtctgggggaggcttggtacagcctgggggtccctgagactctcctgtgcagcctctggattcatctttagcagctatgccatgagctgggtccgccaggctccgaggggaaggggctggaatggggtctcatcctattagtgctactactggtggcacatacttcgcagactccgtgaaggccggttctccatctccaganacattccaaagaacacgctgtatctncatananacgcngagacgacgacgacgacggacgtactactactagtagaacgaagtagtaggtagtacgacgacgtcgg

SEQ ID NO: 325022 - DNA, 508 bp, Homo sapiens
  misc_feature: GZ8MTXP02GQSB1.4.7.A07.1.454.CMB.2.raw
  modified_base (296)..(296): a, c, t, g, unknown or other
  misc_feature (296)..(296): n is a, c, g, or t
  modified_base (342)..(342): a, c, t, g, unknown or other
  misc_feature (342)..(342): n is a, c, g, or t
  modified_base (388)..(388): a, c, t, g, unknown or other
  misc_feature (388)..(388): n is a, c, g, or t
  modified_base (393)..(393): a, c, t, g, unknown or other
  misc_feature (393)..(393): n is a, c, g, or t
  modified_base (418)..(418): a, c, t, g, unknown or other
  misc_feature (418)..(418): n is a, c, g, or t
  modified_base (425)..(425): a, c, t, g, unknown or other
  misc_feature (425)..(425): n is a, c, g, or t
tcagagcactgtagcacgaccggtgctcgatttagcacgtgtcgcaggggctgagagaggagcccagccctgggattttcaggtgtttcatttggtgatcaggactgaacagagagaactcaccatggagtctgggctgagcgtggtcgttttctgtggctattttaaaaggtgtccagtgtgaggtgcagctggtggagtctgggggaggcttggtacagccgtggggggtccctggagactctcctgtgcagcctctggattcatcttagcagctatgccatgagctgggtccnccaggctccgaggggaagggctggaatgggtctcgatcctatagtnctactactggtggcacatactcgcagactccgtgaacggccgttcncatcncagacacactacaaagacacgtctntatctanactatagacacgacgagagacgacgacgacgacgacgtactactactagagaagaagtagtaggtagtacgacgacggtacgg

SEQ ID NO: 325023 - DNA, 605 bp, Homo sapiens
  misc_feature: GZ8MTXP02I8UFR.4.7.A07.1.454.CMB.2.raw
  modified_base (248)..(248): a, c, t, g, unknown or other
  misc_feature (248)..(248): n is a, c, g, or t
  modified_base (255)..(255): a, c, t, g, unknown or other
  misc_feature (255)..(255): n is a, c, g, or t
  modified_base (257)..(258): a, c, t, g, unknown or other
  misc_feature (257)..(258): n is a, c, g, or t
  modified_base (263)..(263): a, c, t, g, unknown or other
  misc_feature (263)..(263): n is a, c, g, or t
  modified_base (265)..(266): a, c, t, g, unknown or other
  misc_feature (265)..(266): n is a, c, g, or t
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagcgtgcgtttctaggtggctatttaaaggtgtcagtgtgaggtgcagctggtggagtctgggggaggcttggtacagcctggggggtccctgagactctcctgtgcngctctgntnntcttncnnctatgcatgagcgtcggtccgcgacgcgtcgagggagggcgtggagtggtcgtctatctattagtgtactactacgtggtcgtctactactactcgtcgacgtacgtccgtacggtacgggtccggttccgtcctactactaccacgaacgaactaactaaccaaacgaaacaacgtactacgtactactacgtacgtaacgtacgtaacgacgacgtacgacgacggaccggaacggaccggaaccggtaccgttaacgttaacgttacgttacggtacggtaacggtaaacggtaacggttaacgggtaacggtacggtaaccggtaacggtacggg

SEQ ID NO: 325024 - DNA, 590 bp, Homo sapiens
  misc_feature: GZ8MTXP02I92M3.4.7.A07.1.454.CMB.2.raw
  modified_base (264)..(265): a, c, t, g, unknown or other
  misc_feature (264)..(265): n is a, c, g, or t
  modified_base (267)..(267): a, c, t, g, unknown or other
  misc_feature (267)..(267): n is a, c, g, or t
  modified_base (270)..(273): a, c, t, g, unknown or other
  misc_feature (270)..(273): n is a, c, g, or t
  modified_base (277)..(277): a, c, t, g, unknown or other
  misc_feature (277)..(277): n is a, c, g, or t
  modified_base (280)..(280): a, c, t, g, unknown or other
  misc_feature (280)..(280): n is a, c, g, or t
  modified_base (282)..(282): a, c, t, g, unknown or other
  misc_feature (282)..(282): n is a, c, g, or t
  modified_base (309)..(309): a, c, t, g, unknown or other
  misc_feature (309)..(309): n is a, c, g, or t
  modified_base (311)..(311): a, c, t, g, unknown or other
  misc_feature (311)..(311): n is a, c, g, or t
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagcgtgcgttttctaggtggctattttaaaaggtgtccagtgtgaggtgcagctggtggagtctgggggaggcttggtacagcctggggggtccctgagactctcctgtgcagcctctggattnntnttnnnntatncangngcgtcggtcgcgcgcgcgagggagggngnggagtggtcgtctatactattagtgtactactacgtggtggacactactactacgacgacgtacgtccgtacggtacgggtccggttccgtcctactctaccacgaacgaactaactaaccaaacgaaacacgacgtacgtactacgtacgtacgtaagtaacgaacgacgtacgtacgacgacggaccggacggacgaccggtaccgtaacgttacgttacgtagtagtaacggtaaaggtaacggttacgggtaagtacgtaaccgtacggtacggg

SEQ ID NO: 325025 - DNA, 529 bp, Homo sapiens
  misc_feature: GZ8MTXP02HB8GF.4.7.A07.1.454.CMB.2.raw
  modified_base (392)..(392): a, c, t, g, unknown or other
  misc_feature (392)..(392): n is a, c, g, or t
  modified_base (403)..(403): a, c, t, g, unknown or other
  misc_feature (403)..(403): n is a, c, g, or t
  modified_base (444)..(444): a, c, t, g, unknown or other
  misc_feature (444)..(444): n is a, c, g, or t
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagctggcttttcttgtggctattttaaaaggtgtccagtgtgaggtgcagctggtggagtcgtgggggaggcttggtacagccgtggggggtccctgagactctcctgtgcagcctctggattcatctttagcagctatgccatgagctgggtccgccaggctccgaggggaaggggctggaatgggtctcgatccctattagtgctactactggtgcacatacttcgcagacctccgtgaacgggccgtcncatctccaganacaattccaaagacacgctagtatctgactaattgaaaccncgctagacgacgacgagaccgacggtactatacgtacgtgagaacgtaaaggtacgttacgggatacggaccggtacggtacggg

SEQ ID NO: 325026 - DNA, 531 bp, Homo sapiens
  misc_feature: GZ8MTXP02IAZOB.4.7.A07.1.454.CMB.2.raw
  modified_base (351)..(351): a, c, t, g, unknown or other
  misc_feature (351)..(351): n is a, c, g, or t
  modified_base (370)..(370): a, c, t, g, unknown or other
  misc_feature (370)..(370): n is a, c, g, or t
  modified_base (396)..(396): a, c, t, g, unknown or other
  misc_feature (396)..(396): n is a, c, g, or t
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagctggcttttctgtggctattttaaaaggtgtccagtgtgaggtgcagctggtggagtctgggggaggcttggtacaggccgtggggggtccctgagactctcctgtgcagcctctggattcatcttagcagctatgccatgagcgtgggtccgccaggctccgaggggaaggggctggaatggggtctcatcctattagtgctactacnggtgcacagtacttcgcanactccgtgacggcgtctcatctcagngacatcaagacacgctagtatctgactaatgaacacgtcctagacgacgaccgaacggaccgacggtaccgtagttactaacctgtacgaacggaaaagtagtttagggggaaatcggaaccgtacggtcggggg

SEQ ID NO: 325027 - DNA, 569 bp, Homo sapiens
  misc_feature: GZ8MTXP02IPOD8.4.7.A07.1.454.CMB.2.raw
  modified_base (170)..(170): a, c, t, g, unknown or other
  misc_feature (170)..(170): n is a, c, g, or t
  modified_base (193)..(193): a, c, t, g, unknown or other
  misc_feature (193)..(193): n is a, c, g, or t
  modified_base (200)..(200): a, c, t, g, unknown or other
  misc_feature (200)..(200): n is a, c, g, or t
  modified_base (202)..(202): a, c, t, g, unknown or other
  misc_feature (202)..(202): n is a, c, g, or t
  modified_base (209)..(209): a, c, t, g, unknown or other
  misc_feature (209)..(209): n is a, c, g, or t
  modified_base (236)..(236): a, c, t, g, unknown or other
  misc_feature (236)..(236): n is a, c, g, or t
  modified_base (247)..(247): a, c, t, g, unknown or other
  misc_feature (247)..(247): n is a, c, g, or t
  modified_base (273)..(273): a, c, t, g, unknown or other
  misc_feature (273)..(273): n is a, c, g, or t
tcagagcactgtagcacgaccggtgctcgatttagcacgtgtcgcagggctgagagaggagcccagccctggattttcaggtgttttcatttggtgatcaggactgaacagagagaactcaccatggagtctgggctgagcggtgtgttctaggtcggctatttaaaggngtcagtgtgagtgcagctgtggngtgtggngngtgtagngcgtcgggtcgtgagactctctgtgcncgtctcgtgtntctatcttagcagtctatcgcagtgngcgtcggtccgccgacgcgtacggaggagggcgtaggtagtgtcgtcgtatactagttagtgtctacgtacgtgtcgcgtactacgtacgtcgtacgacgtacgtacgtacggtacggtccgtcgtacctactactacgacgacgaactaactacgaaacgaaacgacgtacgtagtactacgtacgtacgtagtacgtaacgtacgtacgtacgacgacgacgacgacgacgtacgtacgttacgttacgtagtacgtaagtaagtacggtaggtacgtacgtacgacggtacgg

SEQ ID NO: 325028 - DNA, 527 bp, Homo sapiens
  misc_feature: GZ8MTXP02GCSXB.4.7.A07.1.454.CMB.2.raw
  modified_base (249)..(249): a, c, t, g, unknown or other
  misc_feature (249)..(249): n is a, c, g, or t
  modified_base (295)..(295): a, c, t, g, unknown or other
  misc_feature (295)..(295): n is a, c, g, or t
  modified_base (403)..(403): a, c, t, g, unknown or other
  misc_feature (403)..(403): n is a, c, g, or t
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagcgtggtcgttttcttagtggctaattttaaaaggtgtccagtgtgaggtgcagctggtggagtctgggggagcttggtacagccgtgggggtccctgagactctccngtgcagcctctggatcatcttagcagctatgcatgagctgggtccncaggctccgaggggaagggctgggaatggggtctcgatcctaattagtgcttactactgggtggcaacatacttcgacagtactccgtgaacggtccgttctccatcnccagagacaactaccaaagaacacgactgtatcgtagacaattagaacagccagagagaccgagacacggcctatacttactgtacgaagaaagtagttacggggaatacgaccgagtacgggg

SEQ ID NO: 325029 - DNA, 541 bp, Homo sapiens
  misc_feature: GZ8MTXP02F30CR.4.7.A07.1.454.CMB.2.raw
  modified_base (420)..(420): a, c, t, g, unknown or other
  misc_feature (420)..(420): n is a, c, g, or t
  modified_base (427)..(427): a, c, t, g, unknown or other
  misc_feature (427)..(427): n is a, c, g, or t
  modified_base (468)..(468): a, c, t, g, unknown or other
  misc_feature (468)..(468): n is a, c, g, or t
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagcgtggcttttctgtggctattttaaaaggtgtccagtgtgaggtgcagctggtggagtctgggggaggcttggtacagccgtggggggtccctgagactctcctgtgcagccctcgtggattcattctttagcagctatgccatgagcgtgggtcccgcgaggcctccggaggggaacggggctaggggaagttcggggtctactatcccttattagtgacttacgtacgtgggtcggcacattaccttcgacagacctcgtagaacgggtccgttcnccatccncagacacaactccaaagaccagtctatatctagacattaanacacgacgagagacgacgacgacgacgacgtactactacgtgtagaagaagtagtaggagacgacgacggcgg

SEQ ID NO: 325030 - DNA, 519 bp, Homo sapiens
  misc_feature: GZ8MTXP02G966L.4.7.A07.1.454.CMB.2.raw
  modified_base (396)..(396): a, c, t, g, unknown or other
  misc_feature (396)..(396): n is a, c, g, or t
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagctggctttttcttgtggctattttaaaaggtgtccagtgtgaggtgcagctggtggagtctgggggaggcttggtacagccgtgggggtccctgagactctcctgtgcagcctctggattcatcttagcagctatgccatgagcgtcgggtccgccaggcctccggaggggaaggggctgggaatggggtctcgatcctattagtgctactacgtggtggcacatacttcgcagactccgtgaacggccgttcnccatctccagagacatccaaagacacgctagtatctgacattgaactgcctagagacgccgaggacacgggactatacgttacgtgtagaacgaagtacgttagggaatcgaccacgtcgggg

SEQ ID NO: 325031 - DNA, 587 bp, Homo sapiens
  misc_feature: GZ8MTXP02JEERC.4.7.A07.1.454.CMB.2.raw
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagcgtggcttttctgtggctattttaaaaggtgtccagtgtgaggtgcagctggtggagtcgtgggggaggcttggtacagccgtggggggtccctgagactctcctgtgcagcctctggattcatctttagcagctatgccatgagcgtgggtccgccaggcctccgaggggaacggggctaggaagtggggtctcatcctattagtgcttactacgtggtggcacgtattaccgttcgcagaccttccgtaggaaacggggtcccggttctacccagtcctacccgagacgactaacttaccaaagaaccaccggtctagtatccgtagactaattgaactacgacctaaagacgaccggaggaccgacggtaccggtaatacgttacgtcggtagacgtaaagtagtttagggggaactacggaccgacggtacggggaacccg

SEQ ID NO: 325032 - DNA, 655 bp, Homo sapiens
  misc_feature: GZ8MTXP02J07NN.4.7.A07.1.454.CMB.2.raw
  modified_base (289)..(289): a, c, t, g, unknown or other
  misc_feature (289)..(289): n is a, c, g, or t
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagcgtggtcttttctgtggctaattttaaaaggtgtccagtgtgaggtgcagctggtggagtcgtgggggaggcttggtacaggccgtggggggtccctggagactctctgtgcagcctctggattcatcttagcagctatgccatgancgtgggtccgccaggcctaccgaggggaaggggctagggaatgggtactcgatcctattagtgcttactacttgggtcggcacatacttcgcagacctccggtaggaaacggggtcccggtttctcccaattcccgacccgaaggtaacgaacctaaaactttacccgaaaaggtaaaacccctacggtacttagttactccgtagaacttaaacgttacgaaaccgtacgaccgtaggaacggacggacccgggaacggaacccgtaaccgggtaccttaaagttacgttacggtaggtaacggtaacggtaaaaggttacgggtttaacggggaaactccggaaacccggtacgggtccggggg

SEQ ID NO: 325033 - DNA, 630 bp, Homo sapiens
  misc_feature: GZ8MTXP02GP9BT.4.7.A07.1.454.CMB.2.raw
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagcgtggtctttttcttgtggcttaattttaaaaggtgtccagtgtgaggtgcagctggtggagtcgtgggggagcttggtacagccgtgggggtccctgagactctcctgtgcagcctcgtggattcattcttagcagctatgccatgagcgtcgggtcccgcgaggcctccggaaggggaaggggctagggaagtgggtctcatcctattagtgacttactacgtgggtcggcaactacttacgttcgactagaccgttccggaggaaacggggtcccgtttcctacctaacttcctaccgaaggaacgaaacctaacttacccgaaaaggaaccaacggtcttagtaacttccgtaacgtaactaagtacgaacgtacgtcgtaggacgacggaccggaacggtaccgaccggtacttaattacgtacgtggtaacgaaacgtaaaggttacggttacgggaactacggaaccgtacgggtaccggg

SEQ ID NO: 325034 - DNA, 567 bp, Homo sapiens
  misc_feature: GZ8MTXP02GXNX7.4.7.A07.1.454.CMB.2.raw
  modified_base (360)..(360): a, c, t, g, unknown or other
  misc_feature (360)..(360): n is a, c, g, or t
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagctggctttttcttgtggctattttaaaaggtgtccagtgtgaggtgcagctggtggagtcgtgggggaggcttggtacaggccgtggggggtccctgagactctcctgtgcagcctctggattcatcttagcagctatgccatgagcgtgggtccgcaggctccgaggggaaggggctgggaatggggtctctatcctattagtgactactactgggnggcacatactcgcagactcgtgaacggtccgtctccatctccagtacgactaactcaaacgacacgcctagtactctagactaattacggaacacgcctagaacgacgaccggaggaaccaccgggaccgttaattacgttacgtggtacggaacggtaaaagtacggttttaggggaaaacttcggaacccgtacggtaccggggg

SEQ ID NO: 325035 - DNA, 534 bp, Homo sapiens
  misc_feature: GZ8MTXP02JBL65.4.7.A07.1.454.CMB.2.raw
  modified_base (295)..(295): a, c, t, g, unknown or other
  misc_feature (295)..(295): n is a, c, g, or t
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagctggcttttctgtggctattttaaaggtgtccagtgtgaggtgcagctggtggagtctgggggaggcttggtacaggccgtggggggtccctgagactctcctgtgcagcctctggattcatctttagcagctatgccatgagctgggtcccnccaggctccgaggggaaggggctggaactggggtctcatctattagtgcttactactggtggcacataccttcgacagacctccgtgaacgggtcccggttctccgatcctccagacgacaatccaaagacacgctgtactctagcaattgaactagcctaggacgacgaccgaggacacggtaccgtatacttacgtgtacgaagaaagtagttacggggatcgacctaggtaccggg

SEQ ID NO: 325036 - DNA, 668 bp, Homo sapiens
  misc_feature: GZ8MTXP02I7M6Z.4.7.A07.1.454.CMB.2.raw
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagctggctttttctgtggctattttaaaaggtgtccagtgtgaggtgcagctggtggagtcgtgggggaggcttggtacagccgtggggggtccctgagactctcctgtgcagcctctggattcattctttagcagctatgccatgagcgtgggtccgccgaggcctccgaggggaacggggctgggaagtggggtctcatcctatagtgtctactacgtggtggcacattacctcgcagacctccgtggaacgggtccgttctccgatcctccgagacgaactaacttaccaaagaaccacgtcttagttaactcgttagaccttaaagttcggaaacctacggtacccctaggaacggaaccgggacccgggaaaggggaaccccgtaacccgggggttaaccccgttaaatttaacgtttaacccggttaggttaaccgggtaaccgggttaaaaaaggttacgggtttttaaggggggaaaactttaccgggaaaacccggtaaccggggtttaacccgggggg

SEQ ID NO: 325037 - DNA, 682 bp, Homo sapiens
  misc_feature: GZ8MTXP02IOJYQ.4.7.A07.1.454.CMB.2.raw
  modified_base (423)..(423): a, c, t, g, unknown or other
  misc_feature (423)..(423): n is a, c, g, or t
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagctggtctttttcttgtggctattttaaaaggtgtccagtgtgaggtgcagctggtggagtcgtgggggagcttggtacaggccgtgggggtacctgagactctcctgtgcagcctctggattcatcttagcagctatcgccatgagcgtcgggtcccgccgaggcctccgaggggaacggggctaggagtgggtctcgatcctattagtgtacctactacgtgggtgctaactacttacttcgacacgtaccgtcccggtaggaaccggggtcccgttacncccgtaacttcctcccaaaggtaaccaacctaaacttacccgaaaaggaacccacggtacctttagtacttcccgtagtaacctaaagtttacggaaaccacggtaccctaagggaaacggaacggaccccggggaaaaggtaccccgaacgggggtacccttaaagttacgtttaaccgtgggttaagaaccggtaaaaaggttacggtttaacgggggaaattaccgggaaacccccgttaaggggtacccgggggg

SEQ ID NO: 325038 - DNA, 844 bp, Homo sapiens
  misc_feature: GZ8MTXP02J4Y5R.4.7.A07.1.454.CMB.2.raw
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagctggcttttctgtggctattttaaaaggtgtccagtgtgaggtgcagctggtggagtctggggtaggcttggtacagccgtggggtccggtcagactctctcgtgcacgcgtcctggtattactactactttacgttacgacgctacttgccgactagtggcgtcgggttccggaccccgacggcgtaccgtacgggaaagggggtaccgggtcggtaaaggtagggttcggtcctacttacccgttactttaagttcgacgttaccttaacccgttgggtgggggtcaacctactaacctttaccgtccacggaaaccgtacccggttcgggtaaacgggggtacccggggtttcccggtttcccctaaccttacgtttaccccctaacgaaaacgggtaaaccgaaaaacgttttaaacccctaaaccgggtaaaaaacctaaaaccccgggactttcccgggtttaaagtacccgttttacgtaacgtaaactttaacggtaaaccgaaacggtaccgtaacgggtaacgggaacgggacccgggaaccggggaaaccggttaaacccggggtaaacccggttaaccgtttaaacgtttaacgtttacggttacgggttaacgggtaaaacgggttaaaacgggtttacggggtttaaaacggggtaccgtttaaccggggaaacccggttaccggggg

SEQ ID NO: 325039 - DNA, 524 bp, Homo sapiens
  misc_feature: GZ8MTXP02JR8RU.4.7.A07.1.454.CMB.2.raw
  modified_base (442)..(442): a, c, t, g, unknown or other
  misc_feature (442)..(442): n is a, c, g, or t
  modified_base (449)..(449): a, c, t, g, unknown or other
  misc_feature (449)..(449): n is a, c, g, or t
  modified_base (451)..(451): a, c, t, g, unknown or other
  misc_feature (451)..(451): n is a, c, g, or t
  modified_base (458)..(458): a, c, t, g, unknown or other
  misc_feature (458)..(458): n is a, c, g, or t
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagcgtggtcttttctgtggctattttaaaaggtgtccagtgtgaggtgcagctggtggagtcgtgggggaggcttggtacagccgtggggggtccctgagactctcctgtgcagcctctggattcatcttagcagctatgccatgagctgggtccgccaggctccgaggggaaggggctgggaatggggtctcgatccgtattagtgacttacgtactggtggcaacattacttcgcagacctccgtagaaggggtcccgttctcccatcctccaagacgaacacttaccaaagacacgctntatctananatgaacngcagagacgacgagacacgactatactacgtgagaacgaagtaggttaggatacggacgacggcgg

SEQ ID NO: 325040 - DNA, 531 bp, Homo sapiens
  misc_feature: GZ8MTXP02F7T7C.4.7.A07.1.454.CMB.2.raw
  modified_base (396)..(396): a, c, t, g, unknown or other
  misc_feature (396)..(396): n is a, c, g, or t
  modified_base (401)..(401): a, c, t, g, unknown or other
  misc_feature (401)..(401): n is a, c, g, or t
  modified_base (406)..(406): a, c, t, g, unknown or other
  misc_feature (406)..(406): n is a, c, g, or t
  modified_base (483)..(483): a, c, t, g, unknown or other
  misc_feature (483)..(483): n is a, c, g, or t
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagctggtcttttctgtggctattttaaaaggtgtccagtgtgaggtgcagctggtggagtcgtgggggaggcttggtacaggccgtggggggtccctgagactctcctgtgcagcctctggattcatcttagcagctatgccatgagctgggtcccgccgaggcctccgaggggaaggggctagggaatggggtctcatcctattagtgcctatactgggtgcacataccttcgcagctccgtgacgggtccgtcncatcncaganacatccaaagacagctgtatctgactaatgaacagcctagacgagacccgaggactaccggaccgttatacttacgngtagaacgtaaagtaggtttaggggaatcggaccgtacggtacggggg

SEQ ID NO: 325041 - DNA, 738 bp, Homo sapiens
  misc_feature: GZ8MTXP02FK6IS.4.7.A07.1.454.CMB.2.raw
  modified_base (259)..(259): a, c, t, g, unknown or other
  misc_feature (259)..(259): n is a, c, g, or t
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagcgtgtcgttttctaggtggctatttaaaaggtgtccagtgtgaggtgcagctggtggagtcgtgggggaggcttggtacaggccgtggggggtccctgagctctcctgtgcagcctntggattcattcttagcagctatgccatgagcgtgggtccgccaggctccggaggggaaggggcgtagggaagttggggtctcgtatcccttagtttagtcgtcttaaccgttacgtggggttgggacaactacttacctttccgcgtaaacggtacccgttcccggttagggaaaacccgggggttcccgggtttacccttcccgaacgtttcccctacccgaagggtaaaccgaaacctaaaacgtttaccccaaaaacggtaaacccaaccggtccgttagttaacgttcccgttaacgtaacgtaaacgttaacgtaacgtacgtaccgtacggaacggaacggaaccggaacggaccggtaaccgggtaccggttaacgttaacgtttacgttacggttaacggtaaacggtaaaacggttaaacgggtttaacggggtaaacggtaaccggtaaccggtaaccgggtaccgggg

SEQ ID NO: 325042 - DNA, 554 bp, Homo sapiens
  misc_feature: GZ8MTXP02HON02.4.7.A07.1.454.CMB.2.raw
  modified_base (398)..(398): a, c, t, g, unknown or other
  misc_feature (398)..(398): n is a, c, g, or t
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagctgactttttcttgtggctattttaaaaggtgtccagtgtgaggtgcagctggtggagtcgtgggggaggcttggtacagccgtgggggtccctgagactctcctgtgcagcctctggattcatcttagcagctatgccatgagctgggtccgccaggcctccgaggggaagggctggaagtggggtctcgattcctattagtgactactacgtgggtgcactataccttcgcagactccgtgaacggtccgttcnccatctaccagagactaactccaaagaaccacgcttgtactctgacctaagttacgaaactcgccctggaagacggccgaacgggacgaccggtaccgtattacgttaactgtacgaagtaaagtagtttaggggaattcgaccgtaagccggggg

SEQ ID NO: 325043 - DNA, 508 bp, Homo sapiens
  misc_feature: GZ8MTXP02JO0YT.4.7.A07.1.454.CMB.2.raw
  modified_base (445)..(445): a, c, t, g, unknown or other
  misc_feature (445)..(445): n is a, c, g, or t
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagcgtggcttttctggtggctattttaaaaggtgtccagtgtgaggtgcagctggtggagtctgggggaggcttggtacagccgtggggggtccctgagactctcctgtgcagcctctggattcatcttagcagctatgccatgagctgggtccgccaggctccgaggggaaggggctggaatggggtctcgatcctattagtgcttactactgggtgcacattactcgcagctccgtagaagggtccgttctccatctccagacgacattccaaagacacgctagtatctagcatagacagccngagagacgagacgacgacgtactatactgtagaagaagtagtaggtagtacgacgacgacggg

SEQ ID NO: 325044 - DNA, 553 bp, Homo sapiens
  misc_feature: GZ8MTXP02HLGN7.4.7.A07.1.454.CMB.2.raw
  modified_base (449)..(449): a, c, t, g, unknown or other
  misc_feature (449)..(449): n is a, c, g, or t
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagctggctttttcttgtggctattttaaaaggtgtccagtgtgaggtgcagctggtggagtcgtgggggaggcttggtacagccgtggggggtccctgagactctcctgtgcagcctctggattcatctttagcagctatgccatgagcgtgggtcccgccaggctccgaggggaggggctggaatggggtctcatcctatagtgcttactactgggtgcacatacttcgcagtactccgtgaacggtccgtctcatctccagacgacaattccaaagaccacgcttgtactctagactaattgaaacngacctgaagacggaccgaaggaccgaccggtccgtaattacgttacctggtacgaacggaaaaggtaggtttacggggaaatcggaaccgtacggtaccggggg

SEQ ID NO: 325045 - DNA, 824 bp, Homo sapiens
  misc_feature: GZ8MTXP02F4N94.4.7.A07.1.454.CMB.2.raw
  modified_base (252)..(252): a, c, t, g, unknown or other
  misc_feature (252)..(252): n is a, c, g, or t
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagctggcttttcttgtggctattttaaaaggtgtccagtgtgaggtgcagctggtggagtcgtgggggaggcttggtacagccgtggggggtccctgagactctcctgtgcngcctcgtgattcatcttagcagctatcgccatgagcgtcgggtcccgcgacggccgtaccggaaggggaacggggtcgtagggtaaaggttggggtcctacgtacgttacccgttaaagtttacggtacgtaccgtttaaccgttaaccggttggggttcgggacctaaaccgtaaactttacccgtttaccgaccgaacggtacccgttcccgggggtaggggtaaacccggggggttcccccgtttacctaaccctacgtttaccccgtaacccggtaaaggaaaccgtaaaccttaaaaccgttaccccgaaaaaacgggaaaccctaacccgggtacctttagttaaccttcggtacgtaaacccttaaagtttacggaaaacccacggtacccgtaagggaacgggaaccggaccccgggaaaacgggacccgaacccgggggttaaccgtttaaactttaacgtttaaccggtggtttaacgggaaaaccgggttaaaaaggtttagggggttttaaaccgggggaaatttacccggaaaaccccgtacgggggtaaccccggggg

SEQ ID NO: 325046 - DNA, 563 bp, Homo sapiens
  misc_feature: GZ8MTXP02JPDBA.4.7.A07.1.454.CMB.2.raw
  modified_base (296)..(296): a, c, t, g, unknown or other
  misc_feature (296)..(296): n is a, c, g, or t
  modified_base (343)..(343): a, c, t, g, unknown or other
  misc_feature (343)..(343): n is a, c, g, or t
  modified_base (513)..(513): a, c, t, g, unknown or other
  misc_feature (513)..(513): n is a, c, g, or t
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagctggctttttcttgtggctattttaaaaggtgtccagtgtgaggtgcagctggtggagtcgtgggggaggcttggtacagccgtggggggtccctgagactctcctgtgcagcctctggattcatcttagcagctatgccatgagctgggtccncaggctccgaggggaaggggctggatggggtctcgatcctattagcnctactacgtggtggcacattaccttcgcagacctccgtgaacggggtcccggttctcctagtcctccgagacgacacttaccaaagaaccacgactagtactcgtagacaagttacgaacacgccctagaagacggaccggaggaccacggggaccttaagtacttacgngtacggaagaaagtaggtttagggggaatacggaaccgaggtaccggggg

SEQ ID NO: 325047 - DNA, 521 bp, Homo sapiens
  misc_feature: GZ8MTXP02H8NFS.4.7.A07.1.454.CMB.2.raw
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagctggctttttctgtggctattttaaaaggtgtccagtgtgaggtgcagctggtggagtctgggggaggcttggtacagccgtggggggtccctgagactctcctgtgcagcctctggattcatcttagcagctatgccatgagctgggtccgccaggctccgaggggaaggggctggaatggggtctcgatcctattagtgctactacgtggtggcacatacttcgcagactccgtgaacgggccgtctcccatctccagagacaattccaaagaacacgctgtatctgcaattgaacagcctgacgagccgaggaccacggaccgtatacttactgtagaacgaaagtgtttaggggaatcggtaaccacgtcggggg

SEQ ID NO: 325048 - DNA, 543 bp, Homo sapiens
  misc_feature: GZ8MTXP02HJFHO.4.7.A07.1.454.CMB.2.raw
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagctggctttttcttgtggctattttaaaaggtgtccagtgtgaggtgcagctggtggagtcgtgggggaggcttggtacaggccgtggggggtccctgagactctcctgtgcagcctctggattcattcttagcagctatgccatgagcgtgggtccgccgaggctccgaggggaaggggctgggaagtggggtctcatcctattagtgctactacgtggtggcacatacttcgcagcctccgtgaacgggtccgttctccatctaccagacgacaatccaaagacacgctagtatcgtagactaattagaacagcctagagacgacgaggacgacggaccgtatacttacgtgtacgaacgtaaaggtagtttagggggaatacggaccgacggtacgggg

SEQ ID NO: 325049 - DNA, 590 bp, Homo sapiens
  misc_feature: GZ8MTXP02G2X0I.4.7.A07.1.454.CMB.2.raw
  modified_base (346)..(346): a, c, t, g, unknown or other
  misc_feature (346)..(346): n is a, c, g, or t
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagctggcttttctgtggctaattttaaaaggtgtccagtgtgaggtgcagctggtggagtcgtgggggaggcttggtacagccgtgggggtccctgagactctcctgtgcagcctctggattcatcttagcagctatgccatgagcgtgggtccgccaggctaccgaggggaaggggctggaagtgggtctcgtatcctattagtnctactacgtgggtgcactatacttcgcagacctcgtggaacgggtcccgttactccagtcctaccgagagaactaattaccaaagaaccacggacttagtacttcgtacgtacctaaagttacggaaacacgtcctaggaacggacgacccggaacggaccgaccggtaccgttaattaacgtacgtaggtacggaagtaaaggtacggtttaggggaactcggtaacccgacggtaccggggg

SEQ ID NO: 325050 - DNA, 636 bp, Homo sapiens
  misc_feature: GZ8MTXP02JAC2T.4.7.A07.1.454.CMB.2.raw
  modified_base (586)..(586): a, c, t, g, unknown or other
  misc_feature (586)..(586): n is a, c, g, or t
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagctggtctttttcttgtggcttattttaaaaggtgtccagtgtgaggtgcagctggtggagtcgtgggggaggcttggtacagccgtggggggtccctgagactctcctgtgcagcctctggattcattcttagcagctatgccatgagcgtcgggtccgccgaggcctccggaggggaaggggctagggaagtggggtctcgattcctagttagtgtacttacgttacgtgggtcggctaactacttaccgttcgacacgtacccgttcccggtaggtaaacggggtcccggtttacctaccctaacttcccgtacccgaaaggaacgtaaacctaaaacgttacccaaaacggaaccaaccgtcgttagtaactctacgactaaattacgaactacgcctagacgacgaccggaaggaccacgggtaccttaacgtattacgngtacgaaggtaaagttcggttacggggaatacggaccgtacggtacgggg

SEQ ID NO: 325051 - DNA, 602 bp, Homo sapiens
  misc_feature: GZ8MTXP02GEJ0Z.4.7.A07.1.454.CMB.2.raw
  modified_base (377)..(377): a, c, t, g, unknown or other
  misc_feature (377)..(377): n is a, c, g, or t
  modified_base (398)..(398): a, c, t, g, unknown or other
  misc_feature (398)..(398): n is a, c, g, or t
  modified_base (403)..(403): a, c, t, g, unknown or other
  misc_feature (403)..(403): n is a, c, g, or t
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagctggtcttttcttgtggctattttaaaaggtgtccagtgtgaggtgcagctggtggagtcgtgggggaggcttggtacagccgtggggggtccctgagactctcctgtgcagcctctggattcatcttagcagctatgccatgagctgggtccgccaggcctccgaaggggaaggggctagggaaatggggtctacgatcctattagtgactactacgtggtgcatatactcganagactccgtgaaggtccgtcncatcnccagacacaaactccaaaagacaccgactgtaactctacgactaaagtttcggaaacacgacccgtaggaacgacgggtacccgaaagggtaaacccgaccgggtacccgttaaattaacgtttaaccgtcgttaggaaccggtaaaaaggtaggttttaacgggggaattacggaaccccgagggtttaacccggggg

SEQ ID NO: 325052 - DNA, 525 bp, Homo sapiens
  misc_feature: GZ8MTXP02GPZNC.4.7.A07.1.454.CMB.2.raw
  modified_base (397)..(397): a, c, t, g, unknown or other
  misc_feature (397)..(397): n is a, c, g, or t
  modified_base (403)..(403): a, c, t, g, unknown or other
  misc_feature (403)..(403): n is a, c, g, or t
  modified_base (433)..(434): a, c, t, g, unknown or other
  misc_feature (433)..(434): n is a, c, g, or t
  modified_base (444)..(444): a, c, t, g, unknown or other
  misc_feature (444)..(444): n is a, c, g, or t
  modified_base (446)..(446): a, c, t, g, unknown or other
  misc_feature (446)..(446): n is a, c, g, or t
  modified_base (485)..(485): a, c, t, g, unknown or other
  misc_feature (485)..(485): n is a, c, g, or t
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagctggctttttcttgtggctattttaaaaggtgtccagtgtgaggtgcagctggtggagtcgtgggggaggcttggtacaggccgtggggggtccctgagactctcctgtgcagcctctggattcatctttagcagctatgccatgagcgtgggcccgccaggctccggaggggaaggggctgggaatggggtctcatcctattagtgctactactgggtggcacatacttcgcagactccgtgaaggggccgtcnccatcnccagagacaataccaaagaacagctagatnnacaaatgaanancctagagagacggacggacacgggacctaatacttaacngtgaagaaagagttagggggaaatcgaccacgtacggggg

SEQ ID NO: 325053 - DNA, 591 bp, Homo sapiens
  misc_feature: GZ8MTXP02HVLRN.4.7.A07.1.454.CMB.2.raw
  modified_base (298)..(298): a, c, t, g, unknown or other
  misc_feature (298)..(298): n is a, c, g, or t
  modified_base (369)..(369): a, c, t, g, unknown or other
  misc_feature (369)..(369): n is a, c, g, or t
  modified_base (406)..(406): a, c, t, g, unknown or other
  misc_feature (406)..(406): n is a, c, g, or t
  modified_base (477)..(477): a, c, t, g, unknown or other
  misc_feature (477)..(477): n is a, c, g, or t
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagcgtggtcttttctgtggctattttaaaaggtgtccagtgtgaggtgcagctggtggagtcgtgggggaggcttggtacagccgtggggggtccctgagactctcctgtgcagcctctggattcattcttagcagctatgccatgagcgtgggtccnccgaggctccgaggggaaggggctggaagtgggtctcgatcctattagtgacttactacgtgggtggctanattaccttcgcagtacctccgtgaacgggtccgttcncccattcctccgaagacgaactaacttcccaaaagaccacgcttagtaactcgtagactaagttacgaacncgacctagagacgcccggaaggtaccgacgggtccgttaaatacgttaccgtagttacggaacgtaaaaggtacgttttacgggggaaaattcggaaccgtaacggtccggggg

SEQ ID NO: 325054 - DNA, 570 bp, Homo sapiens
  misc_feature: GZ8MTXP02IBE8Y.4.7.A07.1.454.CMB.2.raw
tcagagcactgtagcacgaccggtgctcgatttagcacgtgtcgcaggggctgagagaggagcccagccctgagattttcaggtgttttcatttggtgatcaggactgaacagagagaactcaccatggagtctgggctgagctggtcttttcttgtggctattttaaaaggtgtccagtgtgaggtgcagctggtggagtcgtgggggaggcttggtacagccgtggggggtccctgagactctcctgtgcagcctctggattcatcttagcagctatgccatgagctggtccgccgaggctccgaggggaggggctggaagtggggtctcatctattagtgtctactactgggtcggcactataccttcgcagacctcgaggaacggggtcccggttctcccgtatcctaccgagtaacgactaaacttaccaaagaaccacgtcttagtatcctgacctaattcgaacagcctagacgacgacccgaggaccacgggaccgtatacgttacgtgtaacggaacgaaaaggttacggtttagggggaacttacggaacccgaacgggg

SEQ ID NO: 325055 - DNA, 528 bp, Homo sapiens
  misc_feature: GZ8MTXP02I4H2K.4.7.A07.1.454.CMB.2.raw
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagctggctttttcttgtggctattttaaaaggtgtccagtgtgaggtgcagctgggtggagtcgtgggggaggcttggtacagccgtggggggtccctgagactctcctgtgcagcctctggattcatctttagcagctatgccatgagctgggtccgccaggctccgaggggaagggctggaatgggtctcatcctattagtgctactactggtgcacatacttcgcagactccgtgaacgggccgttactccatctccagacgacattccaaagaaccacgctgtactctagcaagttgaacagcctagagacgaccgaggacgacggaccgtactattactgtagaacgaaagtagtttaggggaatcggaccgtacgtacgggg

SEQ ID NO: 325056 - DNA, 565 bp, Homo sapiens
  misc_feature: GZ8MTXP02F5XMK.4.7.A07.1.454.CMB.2.raw
  modified_base (397)..(397): a, c, t, g, unknown or other
  misc_feature (397)..(397): n is a, c, g, or t
  modified_base (443)..(443): a, c, t, g, unknown or other
  misc_feature (443)..(443): n is a, c, g, or t
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagctggtctttttcttgtggctattttaaaaggtgtccagtgtgaggtgcagctggtggagtcgtgggggagcttggtacagccgtgggggtccctgagactctcctgtgcagcctctggatcatcttagcagctatgccatgagcgtggtcccgcgaggcctccgaggggaaggggctgggaatgggtctcgatcctattagtgcttactacttgggtgcactatactcgcagactccgtagaacgggtccgttcnccatcctaccagacgaactacttacccaaagtaaaccacgtacttntaatccgttagacctaagttcgaaacacgcctagggaacgacggcccggaaggaccgacggtaccgtatacttacgagtacgaagtaaaagtgtttacgggaatcggaacgtcgaaccgggg

SEQ ID NO: 325057 - DNA, 519 bp, Homo sapiens
  misc_feature: GZ8MTXP02I6HL9.4.7.A07.1.454.CMB.2.raw
  modified_base (448)..(448): a, c, t, g, unknown or other
  misc_feature (448)..(448): n is a, c, g, or t
  modified_base (467)..(467): a, c, t, g, unknown or other
  misc_feature (467)..(467): n is a, c, g, or t
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagctggctttttcttgtggctattttaaaggtgtccagtgtgaggtgcagctggtggagtcgtgggggaggcttggtacagccgtggggggtccctgagactctcctgtgcagcctctggattcatcttagcagctatgccatgagcgtgggtccgccaggctccgaggggaaggggctggaatggggtctcatcctattagtgctactacgtggtgcacatacttcgcagacctccgtgaacgggccgttctccatcctccagacgacaattaccaaagaaccacgctgtatctagcaaattgaacngcctagagagccgaggacnccggcgtatactctgtgaacgaagtagtttcggggaatcgacgacgtcgggg

SEQ ID NO: 325058 - DNA, 556 bp, Homo sapiens
  misc_feature: GZ8MTXP02G4LL3.4.7.A07.1.454.CMB.2.raw
  modified_base (354)..(354): a, c, t, g, unknown or other
  misc_feature (354)..(354): n is a, c, g, or t
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagctggcttttcttgtggctattttaaaaggtgtccagtgtgaggtgcagctggtggagtctgggggaggcttggtacagccgtgggggtccctgagactctcctgtgcagcctctggatcatcttagcagctatgccatgagcgtgggtccgcaggctccgaggggaagggctggatgggtctcatcctattagtgctactactgggtggcanatactcgacagactccggtagaacgggtccgttctccagtcctccgagagaacaattccaaaagtacacgctagtaactcctagaccaaattcgaaacacgtcctagagacgaccgaaggaccgacggtaccgtattacgttaccgtggtacgtaacgaaaagtacggtttaggggaacttcggaaccgacggtaccggggg

SEQ ID NO: 325059 - DNA, 571 bp, Homo sapiens
  misc_feature: GZ8MTXP02JYBAJ.4.7.A07.1.454.CMB.2.raw
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagctggcttttcttgtggctattttaaaaggtgtccagtgtgaggtgcagctggtggagtctgggggaggcttggtacagccgtggggggtccctgagactctcctgtgcagcctctggattcatctttagcagctatgccatgagctgggtcccgccaggcctccgaggggaaggggctggaatgggtctcgatccctattagtgctacgtactgggtggcactatacttcgcagtacctccgtaggaacgggtcccggttctccatctcccgagtacgaactaacttaccaaagtaaccaacgtctagtacttcgtagactaatttacgaacacgcctagagacgccggaggaccgacggaccgtatacttaacgtggtacgaacgtaaaaggtacgtttagggggaactacggaaccacggtacgggg

SEQ ID NO: 325060 - DNA, 520 bp, Homo sapiens
  misc_feature: GZ8MTXP02JDP3S.4.7.A07.1.454.CMB.2.raw
  modified_base (295)..(295): a, c, t, g, unknown or other
  misc_feature (295)..(295): n is a, c, g, or t
  modified_base (456)..(456): a, c, t, g, unknown or other
  misc_feature (456)..(456): n is a, c, g, or t
  modified_base (482)..(482): a, c, t, g, unknown or other
  misc_feature (482)..(482): n is a, c, g, or t
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagctggctttttcttgtggctattttaaaaggtgtccagtgtgaggtgcagctggtggagtctgggggaggcttggtacagccgtgggggtccctgagactctcctgtgcagcctctggattcatctttagcagctatgccatgagctgggtccnccaggctccgaggggaaggggctgggaatggggtctcgatcctattagtgctactacgtggtcggcacatacttcgcagactccgtgaacggccggttactccatctccagtagacaagttccaaagacacgctgtatctagcaattgaacagcctgacgngccgaggacacggccgtatacttacngtagaacgaaagtagttggggaatcggacctagtcggg

SEQ ID NO: 325061 - DNA, 583 bp, Homo sapiens
  misc_feature: GZ8MTXP02H8AV4.4.7.A07.1.454.CMB.2.raw
  modified_base (426)..(426): a, c, t, g, unknown or other
  misc_feature (426)..(426): n is a, c, g, or t
tcagagcactgtagcacgaccggtgctcgatttagcacgtgtcgcaggggctgagagaggagcccagccctgggattttcaggtgttttcatttggtgatcaggactgaacagagagaactcaccatggagtatgggctgagctggctttttcttgtggctattttaaaaggtgtccagtgtgaggtgcagctggtggagtcgtgggggaggcttggtacagccgtgggggtccctgagactctcctgtgcagcctctggattcattctttagcagctatgccatgagcgtcgggtcccgccgaggcctaccggaaggggaacgggggcgtaggggaaagttcggggtctacattcctattagtgacttactacgttgggtcggcaactataccttcgcagacctccgtgacgggtccgttctccntctaccagacgactaatccaaagaccacgactgtatctgactaagttgaacacgtcctagacgacgaccggaaggaccgacggtacccgtattacgttaacgtggtacgaacggtaaaagtacgtttacgggggaatcggaccgacggtaccggggg

SEQ ID NO: 325062 - DNA, 632 bp, Homo sapiens
  misc_feature: GZ8MTXP02IA3KC.4.7.A07.1.454.CMB.2.raw
  modified_base (252)..(252): a, c, t, g, unknown or other
  misc_feature (252)..(252): n is a, c, g, or t
  modified_base (256)..(256): a, c, t, g, unknown or other
  misc_feature (256)..(256): n is a, c, g, or t
  modified_base (259)..(259): a, c, t, g, unknown or other
  misc_feature (259)..(259): n is a, c, g, or t
  modified_base (266)..(268): a, c, t, g, unknown or other
  misc_feature (266)..(268): n is a, c, g, or t
  modified_base (271)..(271): a, c, t, g, unknown or other
  misc_feature (271)..(271): n is a, c, g, or t
  modified_base (277)..(277): a, c, t, g, unknown or other
  misc_feature (277)..(277): n is a, c, g, or t
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagcgtggcgttttctagtggctattttaaaaggtgtcagtgtgaggtgcagctggtggagtctgggggaggcttggtacagccgtggggggtccctgagactctcctgtgcngctntgntcatctnnnctngcatgngcgtcggccgcgaggcgtcggaggggagggcgtaggagtcggtctctatccttagttagtcgtacttacgtacgttgggtcgacctaactacttaccgtcgactaacgtacccgttccggtaggaccgggtcccgttctccctacttccgtaccgaagaacgaacctaaacgtaccaaacgaacctacgtacttagtactcgtacgactaagttagaaaccgcgtcgtaaggaacggacggaccggaacggaacccgtaccgggtaccttaaagttacgttacgtaggtaacggaaacggtaaaaggttacggtttaacggggaaacgtaccggaaccggtaacgggtaccgggg

SEQ ID NO: 325063 - DNA, 612 bp, Homo sapiens
  misc_feature: GZ8MTXP02GAH5U.4.7.A07.1.454.CMB.2.raw
  modified_base (349)..(349): a, c, t, g, unknown or other
  misc_feature (349)..(349): n is a, c, g, or t
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagctggtctttttcttgtggctattttaaaaggtgtccagtgtgaggtgcagctggtggagtcgtgggggaggcttgggtacagccgtggggggtccctgagactctcctgtgcagcctctggattcatcttagcagctatgccatgagcgtgggtccgcaggctccgaggggaggggctggaagtgggtctcgattcccgtattagtnacttactacgttgggtgcacattaccttcgacagacctccgtaggaacggggtcccggttactcccgattccgtacccaaggaacgacctaaacttcccgaaaagaaccacgtcttagtatacctgaccaaatttacgaactacgaccgtaggacgacggacccggagggaaccaccgggtccgttaaatacgtttaaccgtcggttaggaaccgtaaaagtaggtttacgggggaaattacggaacctacggtaaccggggg

SEQ ID NO: 325064 - DNA, 542 bp, Homo sapiens
  misc_feature: GZ8MTXP02H3E8K.4.7.A07.1.454.CMB.2.raw
  modified_base (262)..(262): a, c, t, g, unknown or other
  misc_feature (262)..(262): n is a, c, g, or t
  modified_base (407)..(407): a, c, t, g, unknown or other
  misc_feature (407)..(407): n is a, c, g, or t
  modified_base (453)..(453): a, c, t, g, unknown or other
  misc_feature (453)..(453): n is a, c, g, or t
  modified_base (504)..(504): a, c, t, g, unknown or other
  misc_feature (504)..(504): n is a, c, g, or t
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagcgtggtcgttttctaggtggctaattttaaaaggtgtccagtgtgaggtgcagctggtggagtcgtgggggagcttggtacagccgtggggggtccctgagactctcctgtgcagcctcnggattcattcttagcagctatgccatgagcgtggtccgccaggcctccggaaggggaagggctaggaatggggtctcgatcctattagtgctactacgtggtcggcacacttactcgacataccgtcgaggaacggtccgttacnccattcacagacgaacataccaaagaaccacgcttagtactcgtanactaagttgaaaccagccagacgacgcggaaggacacggtcgtaatctacngtagaagtaagtagttacggatacgacgtaacgcgggg

SEQ ID NO: 325065 - DNA, 578 bp, Homo sapiens
  misc_feature: GZ8MTXP02GFYKP.4.7.A07.1.454.CMB.2.raw
  modified_base (298)..(298): a, c, t, g, unknown or other
  misc_feature (298)..(298): n is a, c, g, or t
  modified_base (388)..(388): a, c, t, g, unknown or other
  misc_feature (388)..(388): n is a, c, g, or t
  modified_base (404)..(404): a, c, t, g, unknown or other
  misc_feature (404)..(404): n is a, c, g, or t
  modified_base (412)..(412): a, c, t, g, unknown or other
  misc_feature (412)..(412): n is a, c, g, or t
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagctgtactttttcttgtggctattttaaaaggtgtccagtgtgaggtgcagctggtggagtcgtgggggaggcttggtacagccgtggggggtccctgagactctcctgtgcagcctctggattcatcttagcagctatgccatgagcgtgggtccncaggcctccggaggggaaggggctagggaagtgggtctcatcctattagtgacttactacgtggtggcactatacttcgacagactccgngaacgggtcccgttcnccattccnccaagacgaactaaacttccaaaagaccacgtctgtactcgtagacctaagttacgaaactacgccctagacgaacggacccggaagaaccgacgggtaccttaattacttaacgtgtacgaacgtaaaagtggttaggggaattcggaacccgaggtaccggggg

SEQ ID NO: 325066 - DNA, 524 bp, Homo sapiens
  misc_feature: GZ8MTXP02FJWFF.4.7.A07.1.454.CMB.2.raw
  modified_base (347)..(347): a, c, t, g, unknown or other
  misc_feature (347)..(347): n is a, c, g, or t
  modified_base (364)..(364): a, c, t, g, unknown or other
  misc_feature (364)..(364): n is a, c, g, or t
  modified_base (381)..(381): a, c, t, g, unknown or other
  misc_feature (381)..(381): n is a, c, g, or t
  modified_base (408)..(408): a, c, t, g, unknown or other
  misc_feature (408)..(408): n is a, c, g, or t
  modified_base (428)..(428): a, c, t, g, unknown or other
  misc_feature (428)..(428): n is a, c, g, or t
  modified_base (441)..(441): a, c, t, g, unknown or other
  misc_feature (441)..(441): n is a, c, g, or t
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagcgtgtcgttttctaggtggctaattttaaaaggtgtccagtgtgaggtgcagctggtggagtcgtgggggaggcttggtacaggccgtggggggtccctgagactctcctgtgcagcctctggattcatctttagcagctatgccatgagcgtgggtccgcaggctccgaggggaaggggctggaatgggtctcatcctattagngctaactcgtggtgcanataccttgcagctccgngaacgggtccgttctccatctccaganacaattcccaaagaaacccncgtctatatctanactaatacacacgcgagagacgacgacgacgacgacgtactactacgtgtagaagtaagtagttaggagtacgacgacgtcgg

SEQ ID NO: 325067 - DNA, 663 bp, Homo sapiens
  misc_feature: GZ8MTXP02IHWAQ.4.7.A07.1.454.CMB.2.raw
  modified_base (359)..(359): a, c, t, g, unknown or other
  misc_feature (359)..(359): n is a, c, g, or t
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagcgtggtcgttttctaggtggctattttaaaaggtgtccagtgtgaggtgcagctggtggagtcgtgggggaggcttggtacagccgtgggggtccctgagactctcctgtgcagcctctggattcatcttagcagctatcgccatgagcgtgggtcccgccgtaggccgtaccgaggggaagggcgtagggaagtggggtctcgattccgtattagngtactacgtacgtgggtggactaacacttaccgttcgctacgtaccgtaccggttggaaaccgggtcccggtttcctacccgacgttcctaccgaagtaacgtaactaaacgttaccgaaaacggaaccacggtaccttaagttactaccgtagtaccgtaaatttacggaaaacctcggaccctaggaacgaacggcccggaaaagggaccgaaccggttaccggtaaattacgttacgtaggtacggaagtaaaagtacggtttagggggaaaacttcggaacccggtaacggtcccggggg

SEQ ID NO: 325068 - DNA, 682 bp, Homo sapiens
  misc_feature: GZ8MTXP02J0IPW.4.7.A07.1.454.CMB.2.raw
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagcgtggtctttttcttggtggcttaattttaaaaggtgtccagtgtgaggtgcagcgtggtggagtcgtgggggaggtcgttggtacaggccgtgggggtccctgagactctctgtgcagcctcgtggattcattcttagcagctatcgccatggagcgtcgggtcccgcgaggcctaccggaggggaagggcgtaggaagtcggggtcctcgtattccctagtttagtcgtacttacgtacggttgggtcggactaacgtattaccgttcgacgtacgtacccgttacccgggtaggggaaaccggggtccccggtttaccacccgtatccgtaccgaagaacgaaactaacttaccgaaaggaaccacggtacttaggtactaccgtagtactaaacgttacggaaactcgaccgtagggaaacgaccggacccgggtaaggaacccggaccgggtaccgttaaactagttaccgtaggtaaggaaccggtaaaaaggttcggtttacgggggaattccggaaccgacggtaccggggg

SEQ ID NO: 325069 - DNA, 503 bp, Homo sapiens
  misc_feature: GZ8MTXP02HB46C.4.7.A07.1.454.CMB.2.raw
  modified_base (386)..(386): a, c, t, g, unknown or other
  misc_feature (386)..(386): n is a, c, g, or t
  modified_base (399)..(399): a, c, t, g, unknown or other
  misc_feature (399)..(399): n is a, c, g, or t
  modified_base (408)..(408): a, c, t, g, unknown or other
  misc_feature (408)..(408): n is a, c, g, or t
  modified_base (414)..(414): a, c, t, g, unknown or other
  misc_feature (414)..(414): n is a, c, g, or t
  modified_base (417)..(417): a, c, t, g, unknown or other
  misc_feature (417)..(417): n is a, c, g, or t
  modified_base (421)..(421): a, c, t, g, unknown or other
  misc_feature (421)..(421): n is a, c, g, or t
  modified_base (423)..(423): a, c, t, g, unknown or other
  misc_feature (423)..(423): n is a, c, g, or t
  modified_base (429)..(429): a, c, t, g, unknown or other
  misc_feature (429)..(429): n is a, c, g, or t
  modified_base (434)..(434): a, c, t, g, unknown or other
  misc_feature (434)..(434): n is a, c, g, or t
  modified_base (436)..(436): a, c, t, g, unknown or other
  misc_feature (436)..(436): n is a, c, g, or t
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagctggctttttcttgtggctattttaaaaggtgtccagtgtgaggtgcagctggtggagtctgggggaggcttggtacagcctggggggtccctgagactctcctgtgcagcctctggattcatctttagcagctatgccatgagctgggtccgccaggctccaggggaaaggggctggaatggggtctcatcctattagtgctactactggtggcacatacttgcagactccgtgaaggccgtntccatctccaganacatacaanaacacnctntatntnacatanacacncngagagacgacgacgacgacgtactactactagtagaacgaaagtaagtaggtaagacgacgacgcgg

SEQ ID NO: 325070 - DNA, 611 bp, Homo sapiens
  misc_feature: GZ8MTXP02JJHVD.4.7.A07.1.454.CMB.2.raw
  modified_base (352)..(352): a, c, t, g, unknown or other
  misc_feature (352)..(352): n is a, c, g, or t
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagctggctttttcttgtggctattttaaaaggtgtccagtgtgaggtgcagctggtggagtcgtgggggaggcttggtacagccgtggggggtccctggagactctcctgtgcagccctctggattcatctttagcagctatgccatgagctcgggtccgcaggcctccggaggggaacggggcgtaggagtgggtctcatccctattagtntcttactacgttgggtgcaactattacctcgactacgaccgtccgtggaacgggtcccggttactcccatcctaccaagacgaactaacttacccgaaagaaacccacggaccttagtaactcgtagtaacctaaagttacgaaacgacgcccgtaggacgacgaccggacggaccgaccgggtaccgttattacttaacgtgtaggaacgtaaaagttacggtttaggggaaactcggaacccgtacggtaccggggg

SEQ ID NO: 325071 - DNA, 598 bp, Homo sapiens
  misc_feature: GZ8MTXP02IS3A2.4.7.A07.1.454.CMB.2.raw
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagctgactttttcttgtggctattttaaaaggtgtccagtgtgaggtgcagctggtggagtcgtgggggaggcgttggtacaggccgtggggggtccctgagactctcctgtgcagcctctggattcattctttagcagctatgccatgagcgtcgggtcccgccaggcctccgaggggaacggggctggaagtggggtctcgatcctattagtcgcttactacgttgggtggcacgtacttaccttcgacacgaccttcccggtggaacggggtcccgttcgtccctaagtcctacccgaagacgaacaattacccaaagaacctacgctgtactctgactaattcgaacagcctagagacgaccggagaaccgacggtaccgttaattacgttaacgtggtacgaacggtaaaaggttcggtttaagggggaatacggtaccgaacggtccggggg

SEQ ID NO: 325072 - DNA, 559 bp, Homo sapiens
  misc_feature: GZ8MTXP02GUO5J.4.7.A07.1.454.CMB.2.raw
  modified_base (287)..(287): a, c, t, g, unknown or other
  misc_feature (287)..(287): n is a, c, g, or t
  modified_base (316)..(316): a, c, t, g, unknown or other
  misc_feature (316)..(316): n is a, c, g, or t
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagcgtgtcgttttctaggtggctaattttaaaaggtgtcagtgtgaggtgcagctggtggagtgtgggggagcttggtacaggccgtggggggtccctgagactctcctgtgcagctctggatcatctttagcagctatgccatggngcgtcggtccgcgagcgcggagggagggngtggtagtggtcgtctatactatagtgtactactacgtggtgacactactactcgacgacgtacgtacgtacggtacggtccgttcgtcctactctacgagaacgaactaactaacaaacgaacgaacgtactagtactactacgtacgtaacgtacgaacgacgtacgtacgacgacgacgacgacgacgacgtactactacgtagtagtaagaagtagtacggtagtacgacgacggtcgg

SEQ ID NO: 325073 - DNA, 518 bp, Homo sapiens
  misc_feature: GZ8MTXP02GAKX9.4.7.A07.1.454.CMB.2.raw
  modified_base (334)..(334): a, c, t, g, unknown or other
  misc_feature (334)..(334): n is a, c, g, or t
  modified_base (396)..(396): a, c, t, g, unknown or other
  misc_feature (396)..(396): n is a, c, g, or t
  modified_base (493)..(493): a, c, t, g, unknown or other
  misc_feature (493)..(493): n is a, c, g, or t
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagctggctttttcttgtggctattttaaaaggtgtccagtgtgaggtgcagctggtggagtcgtgggggaggcttggtacaggccgtggggggtccctggagactctcctgtgcagcctctggattcatcttagcagctatgccatgagctgggtccgcaggctccgaggggaaggggctgggaatggggtctnagtcctattacgtgctactacgtggtgcacatacttcgcagactccgtagacggccgttacnccatctccagacgacaactcaaagaccacgctagatctgactaattgacagtcagagacgcgagacgacggccgtatactacgtgtgaacgtaaagngtttacgggatcgaccagtacgggg

SEQ ID NO: 325074 - DNA, 545 bp, Homo sapiens
  misc_feature: GZ8MTXP02IJRMW.4.7.A07.1.454.CMB.2.raw
  modified_base (360)..(360): a, c, t, g, unknown or other
  misc_feature (360)..(360): n is a, c, g, or t
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagctggctttttcttgtggctattttaaaaggtgtccagtgtgaggtgcagctggtggagtcgtgggggaggcttggtacagccgtgggggtccctgagactctcctgtgcagcctctggattcatcttagcagctatgccatgagcgtcgggtccgccaggctccgaggggagggctggatgggtctcgatcctattagtgtactactactggtggcanacttactcgcagtactcgtgaacgggtccgtctcatctccagacgactaactcaaagaccacgcttagtactcgtacgactaagttagaactacgcctagacgacgccgaggaccacgggtacctatacttaaccgtgtacgaagtaaagtaggtttacggggaatcggaaccacggtaccgggg

SEQ ID NO: 325075 - DNA, 535 bp, Homo sapiens
  misc_feature: GZ8MTXP02HR8E0.4.7.A07.1.454.CMB.2.raw
  modified_base (511)..(511): a, c, t, g, unknown or other
  misc_feature (511)..(511): n is a, c, g, or t
  modified_base (526)..(526): a, c, t, g, unknown or other
  misc_feature (526)..(526): n is a, c, g, or t
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagctggctttttcttgtggctattttaaaaggtgtccagtgtgaggtgcagctggtggagtcgtgggggaggcttgggtacaggccgtggggggtccctgagactctcctgtgcagcctctggattcattcttagcagctatgccatgagcgtgggtccgccaggcctccgaggggaaggggctggaatggggtctcatcctattagtgctactacgtggtgcactatacttcgcagtacctccgtaggaacgggtcccggttctccattcctccagacgactaacttaccaaagaaccacgcttagtactctagcaaattgaaacagcctagagacgcgaggacacgcgttatactctgtgaacgaaagngttagggatcggacncggtacggg

SEQ ID NO: 325076 - DNA, 590 bp, Homo sapiens
  misc_feature: GZ8MTXP02JBIAI.4.7.A07.1.454.CMB.2.raw
  modified_base (409)..(409): a, c, t, g, unknown or other
  misc_feature (409)..(409): n is a, c, g, or t
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagctggctttttcttgtggctattttaaaaggtgtccagtgtgaggtgcagctggtggagtcgtgggggaggcttggtacaggccgtggggggtccctggagactctcctgtgcagcctctggattcatcttagcagctatgccatgagcgtgggtccgcgaggctccgaggggaaggggctaggaagtggggtctcatccttattagtgcttactacgtgggtgcactacttacttcgcagacctccggtaggaacgggtcccgttcnccgatcctaccagacacattaccaaagaaccacggcttagtactctagacctaagttcgaaacgtgcccgtagacgacggacccgaaggaccgaccgggtaccgttaattacgttacgtaggtacgaaccgtaaaaggtacggtttagggggaactacggaacccgtacggtacccggggg

SEQ ID NO: 325077 - DNA, 626 bp, Homo sapiens
  misc_feature: GZ8MTXP02H93CB.4.7.A07.1.454.CMB.2.raw
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagctggctttttctgtggctattttaaaggtgtccagtgtgaggtgcagcgtggtggagtcgtggggggaggcttgggtacaggccgtggggggtcccctgagactctcctgtgcagcctctggatcattcttagcagctatcgccatgagcgtgggtccgccaggcctaccggaggggaaggggctagggaagtggggtactcgatcctagtttagtcgcttactacgttcgggtcgacaactacgttaccttcgacagtaccctcccggttaggaaccgggggtcccgtttcacccgtagttcctacgagaacgacctaacgttaccgaaaagacctaacggcttagtacttaccgtagtacctaaagttacgaaacgtcgacccgtaggaacggacggaccggtaacgggaccgacggtaccggtaattacgtacgtgtagaacgtaaagtacggtttagggaactcgaccgtaggaccgggg

SEQ ID NO: 325078 - DNA, 544 bp, Homo sapiens
  misc_feature: GZ8MTXP02GJOBO.4.7.A07.1.454.CMB.2.raw
  modified_base (297)..(297): a, c, t, g, unknown or other
  misc_feature (297)..(297): n is a, c, g, or t
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagctggctttttcttgtggctattttaaaaggtgtccagtgtgaggtgcagctggtggagtcgtgggggaggcttggtacagccgtggggggtccctgagactctcctgtgcagcctctggattcatcttagcagctatgccatgagcgtgggtccncaggctccgaggggagggctgggaatggggtctcgattcctattagtgcttactacgtgggtcggcacattaccttcgcagacctcccgtggaacgggtcccgttctccatctccagacgacaactaccaaagaacacgctagtatctagactaattagaacagcctagagacgaccggaggaccacggaccgtatacttacgtgtagaacgaaagtacgttaggggaatcggaccgacgtacgggg

SEQ ID NO: 325079 - DNA, 739 bp, Homo sapiens
  misc_feature: GZ8MTXP02HFATD.4.7.A07.1.454.CMB.2.raw
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagctggtctttttcttgtggcttaattttaaaaggtgtccagtgtggaggtgcagcgtggtggaggtcggtgggggaggtcgttggtacgacggtccggtcggggggtccctggacgacttccgtccgtgtcgcacgtccctcgtggtattctattcttagcagctatcgaccagtggacgcgtcgggtcccgccgaggcctaccgggaaggggaacggggtcgtagggaagtcggggtcctacgtattccttaagttgtacgtcttactacggttgggtcggacctaacgtacttaccgttaccgactaacgggtacccgttacccggggtagggtaaaccgggggttccccgtttacctacccgtaacgttcccgtaacccgaaaggtaacccgtaaaaccttaaaccttacccgaaaaacgtaaacccgtaaccggtactttagtaccttacgtacgtaactaaagttacgaaacgacgtacccgaggaaacgaccggaccggaacggaccgtaacccggtaccgttaaattaacgttacgtgttaacggaacggtaaagtacggtttagggaatacggaccgtaacggtccgggg

SEQ ID NO: 325080 - DNA, 760 bp, Homo sapiens
  misc_feature: GZ8MTXP02HK1UV.4.7.A07.1.454.CMB.2.raw
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagctggtctttttctgtggcttaattttaaaaggtgtccagtgtgaggtgcagctggtggagtcgtgggggagtcgttggtacaggccgtggggggtccctggacgacttctcctgtgcacgccctgtggattcattcttagcagctatcgcagtgagtcgtggaccgcgaggtctaccggaaggggaacggggcgtagggaaagtcggggttacctactattaccgttaagttagtcgtaccgtttacgttaacggtggggtttcggacctaaacgtaacctttaacccgttccgaacgtaacgtaccccgttccggtaacgggaaacccgggggttcccgtttccgacccgaactttcccgaacccgaaagggaaacgtaaaaccttaaaccttaaacccgaaaaaggttaaaccccgtacgttacgtttaacgtacttacgtaacgtaacgtaaacgttaacgaaaccgtacgtaccgtacgggaaacggaccgggaacccggtaacggaacccggtaaccggtaacgttaaacttacgtacggttaggtaacggtaaaacgtaaaaggttacggttaacggggaaactacccggaaaccggtacgggtacccgggg

SEQ ID NO: 325081 - DNA, 539 bp, Homo sapiens
  misc_feature: GZ8MTXP02GJUVO.4.7.A07.1.454.CMB.2.raw
  modified_base (396)..(396): a, c, t, g, unknown or other
  misc_feature (396)..(396): n is a, c, g, or t
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagctggctttttctgtggctattttaaaaggtgtccagtgtgaggtgcagctggtggagtcgtgggggaggcttggtacaggccgtggggggtccctgagactctcctgtgcagcctctggattcatcttagcagctatgccatgagcgtgggtccgcaggctccgaggggaaggggctgggaatggggtctcatcctattagtgctactacgtgggtggcacatactcgcagcctccgtgaacgggtcccgttcncccatcctaccagacgacacttcaaagaacacgctgtactctagactaattagaacacgcctaggacgacgaccggaggaccaccgggacgtatacttacgtgtagaacgtaagtagttaggggaatcgaccgacggtcgggg

SEQ ID NO: 325082 - DNA, 615 bp, Homo sapiens
  misc_feature: GZ8MTXP02H91SN.4.7.A07.1.454.CMB.2.raw
  modified_base (260)..(260): a, c, t, g, unknown or other
  misc_feature (260)..(260): n is a, c, g, or t
  modified_base (300)..(300): a, c, t, g, unknown or other
  misc_feature (300)..(300): n is a, c, g, or t
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagcgtggtcttttcttgtggctattttaaaaggtgtccagtgtgaggtgcagctggtggagtcgtgggggaggcttggtacaggccgtggggggtccctgagactctcctgtgcagcctntggattcattcttagcagctatgccatgagcgtgggtccnccaggctcgaggggaaggggctgggaatggggtctcgatcctattagtgacttactactgggtgctacattactcgcagacctccgtggaagggtcccgttcacccatcctaccagaacacaacttccaaaagaactacgacttgtaactccgtagactaaagttcgaacaacgccgtacgagaacggaccggaacgggaaccggaacggtacccgggttaacgttaatttaaccgttacggttacggtaacggtaaaacggtaaaggtttacgggggtaaaggttaacggtaaccggtaaccggtaaccggggg

SEQ ID NO: 325083 - DNA, 661 bp, Homo sapiens
  misc_feature: GZ8MTXP02GU4D0.4.7.A07.1.454.CMB.2.raw
  modified_base (253)..(253): a, c, t, g, unknown or other
  misc_feature (253)..(253): n is a, c, g, or t
  modified_base (257)..(257): a, c, t, g, unknown or other
  misc_feature (257)..(257): n is a, c, g, or t
  modified_base (261)..(261): a, c, t, g, unknown or other
  misc_feature (261)..(261): n is a, c, g, or t
  modified_base (267)..(267): a, c, t, g, unknown or other
  misc_feature (267)..(267): n is a, c, g, or t
  modified_base (270)..(270): a, c, t, g, unknown or other
  misc_feature (270)..(270): n is a, c, g, or t
  modified_base (273)..(273): a, c, t, g, unknown or other
  misc_feature (273)..(273): n is a, c, g, or t
  modified_base (285)..(285): a, c, t, g, unknown or other
  misc_feature (285)..(285): n is a, c, g, or t
  modified_base (314)..(314): a, c, t, g, unknown or other
  misc_feature (314)..(314): n is a, c, g, or t
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagcgtgtcgttttctaggtggctaattttaaaaggtgtcagtgtgaggtgcagctggtggagtgtgggggaggcttggtacaggccgtgggggtccctgagctctcctgtgcngctntgtntctatnttncanctatcgcagtgngcgtcggtccgcgcgcgcggagggagggngtggagtggtctctatctagttagtcgtctacgtacgtggtcgtacactactacgtacgtacgacgtaccgtaccgtacggtacgggtccgttccgtacctacctaccgtaccgacgaacgaactaactaaccgaaacgaaaccgtaaccgtacgttacgttacttacgtacgtaacgtaacgttaacgtaacgacgtacgtacggaacggaaccggaccggaaccgggtaaccggtaaccggtaaccggttaacgttaacgttaacgttacggtaacggtaaacggtaaacggttaacgggttaacgggtaacggtaacggtaaccggtaaccggggtaaccgggg

SEQ ID NO: 325084 - DNA, 551 bp, Homo sapiens
  misc_feature: GZ8MTXP02HLWGT.4.7.A07.1.454.CMB.2.raw
  modified_base (477)..(477): a, c, t, g, unknown or other
  misc_feature (477)..(477): n is a, c, g, or t
  modified_base (503)..(503): a, c, t, g, unknown or other
  misc_feature (503)..(503): n is a, c, g, or t
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagctggtctttttcttgtggctattttaaaaggtgtccagtgtgaggtgcagctggtggagtcgtgggggaggcttggtacagccgtggggggtccctgagactctcctgtgcagcctctggattcatctttagcagctatgccatgagctgggtccgccaggctccgaggggaaggggctagggaatggggtctcgatccctattagtgcttaactacgtggtggcaactatacgttcgcacggtacctccgtaggaaacggggtcccgttctcccatctacccagacgaacaaattaccaaagaaaccacgcttgtaatccgtgacaattgaacngcctgagacgcgaagcgacggcctanactcgtgtagaacgaaagtagttaggggaatcgacgacggtaccgggg

SEQ ID NO: 325085 - DNA, 591 bp, Homo sapiens
  misc_feature: GZ8MTXP02F22RC.4.7.A07.1.454.CMB.2.raw
  modified_base (175)..(175): a, c, t, g, unknown or other
  misc_feature (175)..(175): n is a, c, g, or t
  modified_base (212)..(212): a, c, t, g, unknown or other
  misc_feature (212)..(212): n is a, c, g, or t
  modified_base (258)..(258): a, c, t, g, unknown or other
  misc_feature (258)..(258): n is a, c, g, or t
  modified_base (266)..(266): a, c, t, g, unknown or other
  misc_feature (266)..(266): n is a, c, g, or t
  modified_base (268)..(268): a, c, t, g, unknown or other
  misc_feature (268)..(268): n is a, c, g, or t
  modified_base (270)..(270): a, c, t, g, unknown or other
  misc_feature (270)..(270): n is a, c, g, or t
  modified_base (272)..(272): a, c, t, g, unknown or other
  misc_feature (272)..(272): n is a, c, g, or t
  modified_base (274)..(275): a, c, t, g, unknown or other
  misc_feature (274)..(275): n is a, c, g, or t
  modified_base (277)..(277): a, c, t, g, unknown or other
  misc_feature (277)..(277): n is a, c, g, or t
  modified_base (281)..(281): a, c, t, g, unknown or other
  misc_feature (281)..(281): n is a, c, g, or t
  modified_base (284)..(284): a, c, t, g, unknown or other
  misc_feature (284)..(284): n is a, c, g, or t
  modified_base (286)..(286): a, c, t, g, unknown or other
  misc_feature (286)..(286): n is a, c, g, or t
  modified_base (312)..(312): a, c, t, g, unknown or other
  misc_feature (312)..(312): n is a, c, g, or t
  modified_base (323)..(323): a, c, t, g, unknown or other
  misc_feature (323)..(323): n is a, c, g, or t
  modified_base (325)..(325): a, c, t, g, unknown or other
  misc_feature (325)..(325): n is a, c, g, or t
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagcgtgtcgtttctaggtggctaattttaaaaggngtcagtgtgaggtgcagcgtggtggaggtgtgggggnggtgttggtacgaggccggtcgggggtccgtgagactctctgtgcngctgtgtntntntntnnantatncangngcgtcggcgcgcgcgcgagggagggngaggtagtgtntntatctatagtgtctactacgtgtcgcactacgtacgtcgacgacgtacgtacgtacggtacggtccgtcgtcctactctaccgacgaacaactaaactaacgaaacgaaacgtaacgtacgtacgtactacgtacgtaactaagtaacgtaacgtacgtacgtacgacgacgacggaacggaacgtaacggtacgtaacgttaacgttacgtagtacgtaacggtaaaggtaacggttaacggtaacgtacgtacgtacggtacgg

SEQ ID NO: 325086 - DNA, 756 bp, Homo sapiens
  misc_feature: GZ8MTXP02JPRCS.4.7.A07.1.454.CMB.2.raw
  modified_base (220)..(220): a, c, t, g, unknown or other
  misc_feature (220)..(220): n is a, c, g, or t
  modified_base (274)..(274): a, c, t, g, unknown or other
  misc_feature (274)..(274): n is a, c, g, or t
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagctggcttttcttgtggcttattttaaaaggtgtccagtgtgaggtgcagctggtggagtcgtgggggagcgttggacngccgtggggggtccctgagactctcctgtgcagcctctggattcattcttagcngctatcgccatgagcgtcgggtcccgcgacggctaccggaggggagggcgtaggaagtggggtctacgtagtacccttagttacgtcgtacgttaactccggttgggtcgggtacctaacggtaactttaccgttcggaccgaacgggttacccgttaccggggtaaggggtaaacccgggggttccccgggtttcctacccggtaacttacccgttaaccggtaaacgggaaccgtaaaccttaaaccgtttaaccgaaaaaccggggaaaccctaaccggtcccggtttagttaccttaccggttaacgtaaacgttaaacgttacgaaccgtacggtaccgaagggaaccgtaccgggaacccgacgggtaccgtaaccggttaacgtttaacgttacgttacggtaacggtacggtaaacgggttaaaacggttaacggtacgggtacgtaccggtaaccggtaccgggggtacgggg

SEQ ID NO: 325087 - DNA, 505 bp, Homo sapiens
  misc_feature: GZ8MTXP02GD3ZF.4.7.A07.1.454.CMB.2.raw
  modified_base (387)..(387): a, c, t, g, unknown or other
  misc_feature (387)..(387): n is a, c, g, or t
  modified_base (393)..(393): a, c, t, g, unknown or other
  misc_feature (393)..(393): n is a, c, g, or t
  modified_base (474)..(474): a, c, t, g, unknown or other
  misc_feature (474)..(474): n is a, c, g, or t
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagctggcttttcttgtggctattttaaaaggtgtccagtgtgaggtgcagctggtggagtcgtgggggaggcttggtacagcccgtggggggtccctgagactctcctgtgcagcctctggattcatctttagcagctatgccatgagctgggtccgccaggctccgaggggaaggggctggaatgggtctcgatcctattagtgctactactggtgcacatactcgcagactccgtgacggcgtcnccatcncagagacaatcaaagaacacgctgtatctagcaattgaacagcctagagacgacgaggacacggccgtatactactgtagngaaagagttagggatacgaccacgtacgggg

SEQ ID NO: 325088 - DNA, 664 bp, Homo sapiens
  misc_feature: GZ8MTXP02IKSH4.4.7.A07.1.454.CMB.2.raw
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagctggctttttcttgtggctattttaaaaggtgtccagtgtgaggtgcagctggtggagtcgtgggggaggctttggtacaggccgtggggggtccctgagactctctgtgcagcctctggtattcattcttagcagctatcgccatgagcgtcgggtcccgccgaggcctccggaagggggaaacggggtccgtagggaagtcggggtacctcgattcccgtaagtttagtcggtaccttacgtacgttgggtcgggactaaactagttaccgttccgacaacggtacccgtcccgggttaggaaaccgggggttccccgtttccgttacccaacgtttcccgtaccgaaaggacgtaaaccttaacttacccgaaaagaaacccaccggtcgttagtaacttcgtagacctaaaattcgaaaactcggaccctgaacggacggaccggaaggtacgaccggtaccgtattacgttacgtgtacgaagaagtacggttaggaatcgaccgtacgtaccgggg

SEQ ID NO: 325089 - DNA, 704 bp, Homo sapiens
  misc_feature: GZ8MTXP02GBDPJ.4.7.A07.1.454.CMB.2.raw
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagctggctttttcttgtggctattttaaaaggtgtccagtgtgaggtgcagctggtggagtcgtgggggaggcttggtacagccgtgggggtccctgagctctcctgtgcagcctctggattcattctttagcagctatgccatgagcgtcgggtccgccgaggcctaccggaggggaaggggctagggaagtggggtctcatccgttatagtgcttactacttgggcgcacattaccgttcgacacgacttcccggtaggaaacgggtcccggttctcccgtatcctaccagaacgtaaccaaactttacccaaaaggaaaccctacggtacccttaggttaacttcccgttaggaaccttaaatttacggaaaacgtaaacggtcccgtaagggaacggaacgggtaccccggggaaaacgggaacccgtaaaccgggggtacccggtttaaaactttaacggtttaaaccgtttcgggttaacggaacgggttaaaaagggtacggtttttagggggaaaacgtttacggaaaccccggtttacggggtaaacccgggggg

SEQ ID NO: 325090 - DNA, 653 bp, Homo sapiens
  misc_feature: GZ8MTXP02FI46X.4.7.A07.1.454.CMB.2.raw
  modified_base (597)..(597): a, c, t, g, unknown or other
  misc_feature (597)..(597): n is a, c, g, or t
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagctggtctttttcttgtggctattttaaaaggtgtccagtgtgaggtgcagctggtggagtcgtgggggaggcttggtacagccgtgggggtccctgagactctcctgtgcagcctctggattcatcttagcagctatgccatgagcgtgggtcccgccgaggccgtccggaaggggaacggggcgtagggtaagtcggggtctacgtattccgttagttagtcgtacttacgtacgttggggtcgcaactacttaccgttcgacgaacgtaccgttccgggtaggtaaccggggttcccgtttcctacccgtattcccgaccgaaagaacgtaacctaaacttacccgaaaagtacccacgtccgtagtactacgtagaactaagttacgaaccgtacgccgtaggaacgacggaccggaacggaccgtaccgggtaccttaagttacgttacgngttacggaacgtaaagttaggttacggggaactacggaaccgacgggtaaccgggg

SEQ ID NO: 325091 - DNA, 530 bp, Homo sapiens
  misc_feature: GZ8MTXP02J0OAA.4.7.A07.1.454.CMB.2.raw
  modified_base (301)..(301): a, c, t, g, unknown or other
  misc_feature (301)..(301): n is a, c, g, or t
  modified_base (335)..(335): a, c, t, g, unknown or other
  misc_feature (335)..(335): n is a, c, g, or t
  modified_base (435)..(435): a, c, t, g, unknown or other
  misc_feature (435)..(435): n is a, c, g, or t
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagcgtgtcgttttctagtggctattttaaaggtgtccagtgtgaggtgcagctggtggagtcgtgggggagcttggtacaggccgtggggggtccctggagactctcctgtgcagtctctggattcatctttagcagctatcgccatgacgcgtgggtccncgaggctaccgaggggaagggctggaatgggtcncgatcctattagtgctatacgtggtgcacgatactcgcaagtctccggtgaaggtccgtctcccatctccaagacgactatccaaagacacgtctgtaancctagacatacacgacgccagagacgacgacgacgacggaccgtactataccgtagtgaacgtaagtagttacggtagtacgacgacgtacgggg

SEQ ID NO: 325092 - DNA, 577 bp, Homo sapiens
  misc_feature: GZ8MTXP02JC4E4.4.7.A07.1.454.CMB.2.raw
  modified_base (412)..(412): a, c, t, g, unknown or other
  misc_feature (412)..(412): n is a, c, g, or t
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagctggctttttcttgtggctattttaaaaggtgtccagtgtgaggtgcagctggtggagtcgtgggggaggcgttggtacaggccgtgggggtccctgagactctcctgtgcacgcctctggattcattctttagcagctatcgccatgagcgtcgggtccgccgacggcctccggaggggaaggggcgtaggaagtgggtctcgtatcctattagtgactactacgtggtgcactatactcgacacgacttcggagacgggtcccgttcncctagtcctccaagacgacaacttacaaagaaccagtcttagtacttctacgactaatgaacagcctaggacgacgaccggaacggaccaccgggtaccttaatacgttacgtggtacgaaggtaaaagttggttacggggatccggaaccgtacggaccggggg

SEQ ID NO: 325093 - DNA, 652 bp, Homo sapiens
  misc_feature: GZ8MTXP02IFBEG.4.7.A07.1.454.CMB.2.raw
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagctggtctttttcttgtggctattttaaaaggtgtccagtgtgaggtgcagcgtggtggagtcgtgggggaggcgttggtacaggccgtgggggtcctgagactctcctgtgcacgcctcgtggattcattcttagcagctatcgaccatgagcgtgggtcccgccgaggccgtaccggaggggaacggggtcgtagggtaagtcggggtctcgtatccttagttagtctacttacgtacgttgggtcggctaactacttaccgttcgactacgtacctcccggtaggaaccggggtcccgttactcccgtaacttccgtacccgaagaacgtaaacctaaacgttcccgaaaagaaacccacgtacgttacgtacttcgacgtacgtaaagttacgaaacgcgtacctaggacgacggaccggaaggaccgacggtaccgttagttacgtaacgtgacggtaagtaaaaggtacggtttacgggaagtcggaaccgtacgggtaccgggg

SEQ ID NO: 325094 - DNA, 634 bp, Homo sapiens
  misc_feature: GZ8MTXP02H6UKA.4.7.A07.1.454.CMB.2.raw
  modified_base (263)..(263): a, c, t, g, unknown or other
  misc_feature (263)..(263): n is a, c, g, or t
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagctggtctttttcttgtggcttaattttaaaaggtgtccagtgtgaggtgcagctggtggagtcgtgggggagcttggtacaggccgtgggggtccctgagctctcctgtgcagcctctggnttcattcttagcagctatcgcagtgagcgtgggtcccgccgaggcctaccggaaggggaaggggcgtagggaagtcggggtctacgattcccgtaatttagtcgtacttaacttaccgtgggtcgacctaactacgttaccttcgacgacgtaacctcccggtaggacggggtcccgttctacccagttcctaccgaagaacgaacctaacttaccgaaagaaaccacggtacttagtactcgtacgactaaacgtcggaaactacggttaccgagacggaacggaccggaaacggtaccgaaccggtaccgtaatacgtacgtgtacgaagtaaagtagttaggggaactacggaacgtacggaccgggg

SEQ ID NO: 325095 - DNA, 703 bp, Homo sapiens
  misc_feature: GZ8MTXP02JAIJ9.4.7.A07.1.454.CMB.2.raw
  modified_base (301)..(301): a, c, t, g, unknown or other
  misc_feature (301)..(301): n is a, c, g, or t
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagctggtctttttcttgtggctattttaaaaggtgtccagtgtgaggtgcagctggtggagtcgtgggggaggcttggtacaggccgtggggggtccctgagactctcctgtgcagcctctggattcattcttagcagctatcgccatgagcgtgggtccncgaggctccggaggggaaggggctaggagtggggtcctcgtattcccttaagttagtcgtaccttacttaccgtgggtcggaccaactacttaccgttccgactaacggtacccttcccggggtaagggaaaccgggggttccccggtttacctaccctaacgtttcccacccggaaaggtaacgtaaacctaaacgttacccgaaaaaggaaaccctacggtaccttagtaacctcgttacgaacctaaagtttacggaaaacctcggaccgtaaggaacggaccggacccgggaacggaaccgtaaccgggtacttaaagttaccgttacggtggtaacggtaaacggtaaaacggttacgggttacgggaaactaccggaaccggtacgggtaccgggg

SEQ ID NO: 325096 - DNA, 732 bp, Homo sapiens
  misc_feature: GZ8MTXP02G0NWD.4.7.A07.1.454.CMB.2.raw
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagctggtctttttcttgtggcttaattttaaaaggtgtccagtgtgaggtgcagctggtggagtcgtgggggaggcttggtacagccgtcgggggtccctgagactctcctgtgcacgcctctggtattcattcttagcagctatcgcagtgagcgtcgggtcccgcgacggccgtaccggaaggggaacggggtcgtagggtaacgttcggggtcctcgtagttacccgtttagtttagtcgtaccttaacgttacggttggggtcggctaaaccgtacgttaccttccggactacgtaacccgttcccggtaggtaaacccgggggttcccggtttacctaccctacgttcctacccgaagtaacgtaaactaaacgttaccgaaaacggaaacctaacgtacgttacgttacttaccgtacgtaacttaaacgttacgaaaccgtacgtacccggtaaggaacggaacggacccggtaaaggggaacccgaccgggttacccgttaagttaccgttaccgttaggtaacggtaacggtaaaagttacgggtttaggggaacttaccggaaccgtacgggtacccggggg

SEQ ID NO: 325097 - DNA, 521 bp, Homo sapiens
  misc_feature: GZ8MTXP02FMKL1.4.7.A07.1.454.CMB.2.raw
  modified_base (373)..(373): a, c, t, g, unknown or other
  misc_feature (373)..(373): n is a, c, g, or t
  modified_base (390)..(390): a, c, t, g, unknown or other
  misc_feature (390)..(390): n is a, c, g, or t
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagctggcttttcttgtggctattttaaaaggtgtccagtgtgaggtgcagctggtggagtctgggggaggcttggtacagccgtgggggtccctgagactctcctgtgcagcctctggattcatctttagcagctatgccatgagctgggtccgccaggctccgagggaaggggctggaatggggtctcatcctattagtgctactactggtgcacatacttcgcagactcgngaaggccgtctcgatcnccagagacaatccaaagacacgctgtatctagactaattgaactacgcctagagacgaccgaggaccacggcctagtacttaccgtgtagaacgaaagtagttacgggggaatacggaccacgtacggggg

SEQ ID NO: 325098 - DNA, 781 bp, Homo sapiens
  misc_feature: GZ8MTXP02HTQ6E.4.7.A07.1.454.CMB.2.raw
  modified_base (301)..(301): a, c, t, g, unknown or other
  misc_feature (301)..(301): n is a, c, g, or t
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagctggtctttttcttgtggctattttaaaaggtgtccagtgtgaggtgcagctggtggagtcgtgggggaggcttggtacaggccgtgggggtccctgagactctcctgtgcagcctctggattcattcttagcagctatgccatgagcgtcgggtcccnccgaggccgtccggaaggggaggggtcgtaggaagtcggggtctcgtattcccttaagtttacgtcgtaccttaacgttaccggttgggtcgggacctaactacgttacccgttccgaccgtaacggtacccgttcccgggtaacgggaaacccgggggttcccggtttaccctacccgtaaccgtttaccccgtaccccgaaaggtaaccggtaaaacccttaaaaccgtttaaccccgaaaaaacggtaaaccccgtaaacccggggttacccttttaaggttaacctttacccgtaacggtaacccttaaaagtttaacggaaaacccgtacggtaaccccgttaggggaaacgaacgggtacccggaaacggggtacccgaacccgggtaccgttaaattacgtttaccgtaggtacggtaaacgtaaaaggttaggtttacgggggaaattaccggaaccgtacggtaccggggg

SEQ ID NO: 325099 - DNA, 502 bp, Homo sapiens
  misc_feature: GZ8MTXP02JTT8C.4.7.A07.1.454.CMB.2.raw
  modified_base (293)..(293): a, c, t, g, unknown or other
  misc_feature (293)..(293): n is a, c, g, or t
  modified_base (382)..(382): a, c, t, g, unknown or other
  misc_feature (382)..(382): n is a, c, g, or t
  modified_base (388)..(388): a, c, t, g, unknown or other
  misc_feature (388)..(388): n is a, c, g, or t
  modified_base (411)..(411): a, c, t, g, unknown or other
  misc_feature (411)..(411): n is a, c, g, or t
  modified_base (425)..(425): a, c, t, g, unknown or other
  misc_feature (425)..(425): n is a, c, g, or t
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagctggctttttctgtggctattttaaaaggtgtccagtgtgaggtgcagctggtggagtctgggggaggcttggtacagcctggggggtccctgagactctcctgtgcagccctctggattcatcttagcagctatgccatgagctggtccncaggctccaggggaagggctaggaatgggtctcgatcctatagtgactactactggtgcacatactcgcagactcgtgaaggccgttcnccatcncagacacatccaaagactaccgntatatcagacatanaacacacagagacgacgacgacgacgacgtactactactagtagaagaaagtaagtaggtaagtacgacgacgacgg

SEQ ID NO: 325100 - DNA, 699 bp, Homo sapiens
  misc_feature: GZ8MTXP02IHUZA.4.7.A07.1.454.CMB.2.raw
tcagagcactgtagcacgaccggtgctcgatttagcacgtgtcgcaggggctgagagaggagccccagccctgggattttcaggtgttttcatttggtgatcaggactgaacagagagaactcaccatggagtctgggctgagctggcttttttcttgtggctattttaaaaggtgtccagtgtgaggtgcagcgtggtggagtcgtgggggaggcttggtacagccgtgggggtccctgagctctcctgtgcagccctcgtggtattcattctttagcagctatcgaccagtgagcgtcgggtcccgccgaggctaccggaggggaacggggcgtagggaagtcggggtctcgattcctaagttacgtgactacgttacgtgggtcggcctaacgtacttaccgttccgacgacgtaccgttcccggtagggaaaccggggttcccggtttacctaccaacgttccgtacccgaaagacgaacctaaaattcccaaaacggtaccaaccgtcttagtaactcgtacgaactaaacgttacggaaaccgtacgacccgttaaggacgggacccggaaccggaaaacggggaaccgaccggggttaacccgttaaagttacgtttaaccgtggttaggaaaccggttaaaggttacggtttagggggaaataccggtaacccgacgggttaacccggggg

SEQ ID NO: 325101 - DNA, 581 bp, Homo sapiens
  misc_feature: GZ8MTXP02G01Q4.4.7.A07.1.454.CMB.2.raw
  modified_base (257)..(257): a, c, t, g, unknown or other
  misc_feature (257)..(257): n is a, c, g, or t
  modified_base (286)..(286): a, c, t, g, unknown or other
  misc_feature (286)..(286): n is a, c, g, or t
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagcgtgtcgtttctagtggctaatttaaaggtgtcagtgtgaggtgcagctggtggagtcgtgggggaggcttggtacagccgtggggggtccctgagactctcctgtgcagccctntggattcatcttagcagctatgccatgancgtggtccgcaggctccgagggaacgggctaggatgggtctcgatccgtatagtgtctactactggtggtcatatacttcgacgacgaccgtaccgtacgtaaacgggtcccggttcgtcctaactcttcccacggaaacgaactaactaaccgaaacgaaaccgacgtacgtacgtatactacgtacgtaacgtacgaacgacgacgtacgagacgacggacgacgaccgtacgtaacgtacgttacgtagtagtaagtaagtaacggttacggtagtacgtacgacggtacgg

SEQ ID NO: 325102 - DNA, 678 bp, Homo sapiens
  misc_feature: GZ8MTXP02FIFDH.4.7.A07.1.454.CMB.2.raw
  modified_base (559)..(559): a, c, t, g, unknown or other
  misc_feature (559)..(559): n is a, c, g, or t
  modified_base (638)..(638): a, c, t, g, unknown or other
  misc_feature (638)..(638): n is a, c, g, or t
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagctggcttttcttgtggctattttaaaaggtgtccagtgtgaggtgcagctggtggagtctgggggaggcttggtacaggccggtcgggggtcctgacgtactcctcctgtcgcacgcctcgtggtattcattactttagcagcttagtccgacctagtggacgtcggtccggggtccccgccggaacggtcccgtaccgggaaaggggggaacggggtccgtaaggggtaaacggttcggggtactaccgtaatttacccgtttaagtttaggtacgtaccgttaaaccgttaccggttggggtcggaaccaacgtaactttaccgttcgacgaacgtaccgtacccggtaggtaaccggggtcccgttctccacgttcccacccgaagacgaactaaacgttaccgaaacgaaacncgtactagtactcgtagacctaaagtacgaaacgcgtcgagacgacgacgaacgacgaccggtacctaatacgttacgngtagaacgtaaagtagttacggatacgaccgaggtaccgg

SEQ ID NO: 325103 - DNA, 691 bp, Homo sapiens
  misc_feature: GZ8MTXP02IGMOC.4.7.A07.1.454.CMB.2.raw
  modified_base (304)..(304): a, c, t, g, unknown or other
  misc_feature (304)..(304): n is a, c, g, or t
tcagagcactgtagcacgaccggtgctcgatttagcacgtgtcgcaggggctgagagaggagccccagccctgggattttcaggtgttttcatttggtgatcaggactgaacagagagaactcaccatggagtctgggctgagctggcttttttcttgtggctattttaaaaggtgtccagtgtgaggtgcagcgtggtggagtcgtgggggaggtcttggtacaggccgtgggggtccctgagactctcctgtgcacgcctctggattcattcttagcagctatgccatgagcgtcgggtccnccgaggcctaccgaggggaaggggcgtggaatggggtctcgattcctattagtgctacgttacgtggtggctaacgtacttaccttcggactacggtaccttcccgggtaggaaccggggtcccgttctacccaacttcctacccaaggaacgtaaacctaaacttacccaaaaggaaaccctaaaccgtccgtttagtacttacgtacgtaaccttaaagtttacgaaacctaacggcccgttaagaacgggtaacggacccggaacgggaaccggtaaccggtacccggttaaattacgtttaaccgttaggttacgaaacggttaaaaggttaaacggtttacgggggaaaatttaccggaaccgtacggggttaacccggggg

SEQ ID NO: 325104 - DNA, 661 bp, Homo sapiens
  misc_feature: GZ8MTXP02I27GQ.4.7.A07.1.454.CMB.2.raw
  modified_base (482)..(482): a, c, t, g, unknown or other
  misc_feature (482)..(482): n is a, c, g, or t
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagctggtctttttcttgtggtcttattttaaaaggtgtccagtgtgaggtgcagctggtggagtcgtgggggaggcttggtacaggccgtggggggtccctgagtactctcctgtgcacgcctcgtggtattcattctttagctagctatgccagtgagcgtcgggtcccgccgaggcctaccggaaggggaacggggtcgtagggtaacgttcggggtactacgtacgtcccttagtttacgtcgtaccttacgtaccgtgggtcggacactacttaccttcgacacggtaccgttaccggtagggtaaaccggggttcccggttactcccgtacttaccnccccgaaagaacgtaacctaaactttacccgaaaagtaaccaacggtccgttagtacttacgttacgaccttaaagttaacgaactagacccgtagacggacgaccggagacgtacggtccgtaatacgtacgtggtacgaacgtaaagtagttacgggaatccggaacacggtacggg

SEQ ID NO: 325105 - DNA, 504 bp, Homo sapiens
  misc_feature: GZ8MTXP02HUA0C.4.7.A07.1.454.CMB.2.raw
  modified_base (374)..(374): a, c, t, g, unknown or other
  misc_feature (374)..(374): n is a, c, g, or t
  modified_base (389)..(389): a, c, t, g, unknown or other
  misc_feature (389)..(389): n is a, c, g, or t
  modified_base (394)..(394): a, c, t, g, unknown or other
  misc_feature (394)..(394): n is a, c, g, or t
  modified_base (401)..(401): a, c, t, g, unknown or other
  misc_feature (401)..(401): n is a, c, g, or t
  modified_base (410)..(410): a, c, t, g, unknown or other
  misc_feature (410)..(410): n is a, c, g, or t
  modified_base (416)..(416): a, c, t, g, unknown or other
  misc_feature (416)..(416): n is a, c, g, or t
  modified_base (419)..(419): a, c, t, g, unknown or other
  misc_feature (419)..(419): n is a, c, g, or t
  modified_base (423)..(423): a, c, t, g, unknown or other
  misc_feature (423)..(423): n is a, c, g, or t
  modified_base (425)..(425): a, c, t, g, unknown or other
  misc_feature (425)..(425): n is a, c, g, or t
  modified_base (427)..(427): a, c, t, g, unknown or other
  misc_feature (427)..(427): n is a, c, g, or t
  modified_base (431)..(431): a, c, t, g, unknown or other
  misc_feature (431)..(431): n is a, c, g, or t
  modified_base (435)..(435): a, c, t, g, unknown or other
  misc_feature (435)..(435): n is a, c, g, or t
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagctggtctttttcttgtggctaattttaaaaggtgtccagtgtgaggtgcagctggtggagtcgtgggggagcttggtacagccgtgggggtccctgagactctcctgtgcagcctctggattcattcttagcagctatgccatgagctgggccgccaggctccggaaggggaaggggctgggaatgggtctgatctattagtgctatactggtgcacagtaccttgcagtcncgtgaaggtccgtcncatcnccagaanacatacaanaacacnctntatnananatanacancagagagacgacgacgacgacgtactactactagtagaagaagtaagtaggtaagtacgacgacgacgg

SEQ ID NO: 325106 - DNA, 587 bp, Homo sapiens
  misc_feature: GZ8MTXP02IAK4F.4.7.A07.1.454.CMB.2.raw
  modified_base (374)..(374): a, c, t, g, unknown or other
  misc_feature (374)..(374): n is a, c, g, or t
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagctggcttttcttgtggctattttaaaaggtgtccagtgtgaggtgcagctggtggagtcgtgggggaggcttggtacagccgtggggggtccctgagactctcctgtgcagcctctggattcattcttagcagctatgccatgagcgtgggtcccgccacggctccgaggggaggggctggaatggggtctcatcctattagtcgtctactactgggtggcacatacttcgnacgactccgtgacgggccgttctccatcctccagacgactaactacgaaagaacacgctgtactctagactaaagttgaaacacggtaccgtaggaacggacgacccggaaacgggaccgaaacccggggtaccctaagtttacgttaaccgtggttaacggaacggtaaaagtaggtttacgggggaatacggtaaccgaacggtccggggg

SEQ ID NO: 325107 - DNA, 684 bp, Homo sapiens
  misc_feature: GZ8MTXP02IO117.4.7.A07.1.454.CMB.2.raw
  modified_base (172)..(172): a, c, t, g, unknown or other
  misc_feature (172)..(172): n is a, c, g, or t
  modified_base (295)..(295): a, c, t, g, unknown or other
  misc_feature (295)..(295): n is a, c, g, or t
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagctggctttttctgtggctattttaaaaggngtccagtgtgaggtgcgagcgtgggtggagtcggtgggggagtcgttggtacgcggccgggtcgggggtcctggagtctcctctgtgcacgtcctgtggtactctacttcttagcagtactancgactagtgacgcggtcgggtcccgaccggacggtccgtaaccgggaagggggaacggggtcgtaagggtacggttcgggtacctacgtacttaccgttaagttagtcgtaaccttacgttacggttcgggtcggactaacttaacgtttacgttcgacgtaacgtacccgtccgggtagggtaacccggggttcccttccacctacttccaccgaagaacctaaacctaactaaccgaaaacaaccgtactacgttatacgtcgtacactaagtacgaaacgcgtccgaagacggaccgtaccggaaaggtaccgacggtaactaattacgtacgtgtaacgaaagtaaagttaggttacgggaactaccggaacgacgggtaccggg

SEQ ID NO: 325108 - DNA, 680 bp, Homo sapiens
  misc_feature: GZ8MTXP02HADEL.4.7.A07.1.454.CMB.2.raw
  modified_base (557)..(557): a, c, t, g, unknown or other
  misc_feature (557)..(557): n is a, c, g, or t
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagctggtctttttcttgtggtcttaattttaaaaggtgtccagtgtgaggtgcagcgtggtggaggtcggtgggggagtcgttggtacgacggtccggtcggggggtccctggacgtactctccgtgtcgcacgcctcgtggtattcattcttagctagctatcgcctagtggacgtccggtcgggtcccgccgacggccgtaccgggaagggggacggggtcgtagggacggttcgggtcctatattcgttagttgtcgtacttacgtacggtgggtcgaccacgtacttaccgtcgacacggtacccgtccgggtaggaccggggttcccttccaccgtattccgtaccgaagtaacgaactaacctacgaaaagaccgtacgtctttgaactttcaagaccttaagtaccgaancgtcaaggacgacgaccgggaacgaccgacggttactaaacgtttataccggtggtaaacggtaacgtaaaggttacgggtttaacgggaacttacccggaaccgtacgggggtaacccgggg

SEQ ID NO: 325109 - DNA, 544 bp, Homo sapiens
  misc_feature: GZ8MTXP02JMOC5.4.7.A07.1.454.CMB.2.raw
  modified_base (374)..(374): a, c, t, g, unknown or other
  misc_feature (374)..(374): n is a, c, g, or t
  modified_base (387)..(387): a, c, t, g, unknown or other
  misc_feature (387)..(387): n is a, c, g, or t
  modified_base (390)..(390): a, c, t, g, unknown or other
  misc_feature (390)..(390): n is a, c, g, or t
  modified_base (437)..(437): a, c, t, g, unknown or other
  misc_feature (437)..(437): n is a, c, g, or t
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagctggctttttcttgtggctattttaaaaggtgtccagtgtgaggtgcagctggtggagtcgtgggggaggcttggtacagccgtgggggtccctgagactctcctgtgcagctctggattcatcttagcagctatgccatgagctgggtccgccaggctccgaggggacgggctgggaatgggtctcgatcctattagtgctactacgtggtgcacatacctgcagctccgngaacggtccgtcncanctcagagacatacaagacacgctagtatctagacgtaattagaaacncgccgtaggacgaggaccggacggacgaccgggacccgtattaacgttacgtggtgaacgtaaaaggtacgtttagggggaaattacggaccgtaacggtccggggg

SEQ ID NO: 325110 - DNA, 558 bp, Homo sapiens
  misc_feature: GZ8MTXP02FVSUH.4.7.A07.1.454.CMB.2.raw
  modified_base (297)..(297): a, c, t, g, unknown or other
  misc_feature (297)..(297): n is a, c, g, or t
  modified_base (449)..(449): a, c, t, g, unknown or other
  misc_feature (449)..(449): n is a, c, g, or t
  modified_base (464)..(464): a, c, t, g, unknown or other
  misc_feature (464)..(464): n is a, c, g, or t
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagctggtctttttcttgtggctattttaaaaggtgtccagtgtgagtgcagctggtggagtcgtgggggagcttggtacagccgtgggggtccctgagactctcctgtgcagcctctggattcatcttagcagctatcgccatgagctcgggtcccnccgaggctacccggaggggaacggggctaggaacgttgggctcgattcctagttagtgcttactacgtgggtgcactactaccttcgcagccttcggtagaacggtccgtctcgatctccagacgacaacttcaaagaccactctagtatcngacctaattgaaacngcctagacgacgaccgacggacaccgggtcctaaagttacttaacgtgtaacgaaggaaacgtaggtttacgggatacgaccgacggtacgggg

SEQ ID NO: 325111 - DNA, 650 bp, Homo sapiens
  misc_feature: GZ8MTXP02JS4RI.4.7.A07.1.454.CMB.2.raw
  modified_base (293)..(293): a, c, t, g, unknown or other
  misc_feature (293)..(293): n is a, c, g, or t
  modified_base (358)..(358): a, c, t, g, unknown or other
  misc_feature (358)..(358): n is a, c, g, or t
  modified_base (599)..(599): a, c, t, g, unknown or other
  misc_feature (599)..(599): n is a, c, g, or t
  modified_base (630)..(630): a, c, t, g, unknown or other
  misc_feature (630)..(630): n is a, c, g, or t
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagctggtctttttcttgtggcttattttaaaaggtgtccagtgtgaggtgcagctggtggagtcgtgggggaggtcgttggtacgaggccggtcggggggtccctgacgactctcctgtgcacgcctcgtggtacttcattcttagcagctancgccagtggacgcgtcggggtcccgccgaggcctaccggaggggaacgggcgtaggagtgggtcngtatcctagtagtgtacgttacgtacgtgggtcggacctacgtacttaccgtacgccgtacggtaacccgttcggtacgggtaaaccggggttcccgttacctacctacgtcttaccgaagtacgtaaacctaacgttaccaaaacggtaccacgtactagtacctgtacgacctaagttacgaaccgtgtccgtagacggacgtaccggaaacggcgaaccggtccgtaatacgttacgngtaagaacgtaaaggtacggttacgggaacncggtaccggtacgaccgggg

SEQ ID NO: 325112 - DNA, 661 bp, Homo sapiens
  misc_feature: GZ8MTXP02GLNSE.4.7.A07.1.454.CMB.2.raw
  modified_base (571)..(571): a, c, t, g, unknown or other
  misc_feature (571)..(571): n is a, c, g, or t
  modified_base (615)..(615): a, c, t, g, unknown or other
  misc_feature (615)..(615): n is a, c, g, or t
  modified_base (651)..(651): a, c, t, g, unknown or other
  misc_feature (651)..(651): n is a, c, g, or t
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagctggtctttttcttgtggtcttaattttaaaaggtgtccagtgtgaggtgcagctggtggagtcgtgggggagtcttggtacagccgtggggggtccctggacgactctcctgtgcagcctcgtggattcattcttagctagctatcgccatgacgcgtcgggtcccgccgacggcctaccgggaaggggaacggggtctaggggtaacgttcggggtctacgtacttaccgttagttagtgtaccttaacgttacgttgggttcgaccaacgtattaccgttcgacgtacgtaccgttacccggtagggtaaaccgggttcccgttactacctactcccgtaccgaagtaaacgtaacctaaacgttacccgaaaacgaaacccgtaccggtcttacgttactacgtagaccgttaaagttcgaaacncgtccgagacggacgcggaacgacgacggtactactagttacgngtaacgaagtaaaagtggttaaggactcggaaccgnggtaaccggg

SEQ ID NO: 325113 - DNA, 719 bp, Homo sapiens
  misc_feature: GZ8MTXP02HS6CR.4.7.A07.1.454.CMB.2.raw
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagcgtggtcgttttctaggtggctaattttaaaaggtgtccagtgtgaggtgcagcgtggtggagtcgtgggggaggtcttggtacagccgtggggggtccctgagctctcctgtgcagcctctggtattcattcttagcagctatgccatgagcgtgggtccgcgaggctacgaggggaagggcgtaggaagtgggtctacgtattcctaagttagtcgtaccttaacgttccgtggggttcggacctaactaacttaccgttccggaaccgtaacggtacccgttaccggttagggaaacccgggggttccccggtttacctcccgtaacgttcccttacccgtaagggaaacgtaaaccctaaacttaccccgaaaacggtaaacccgaccgttaaccgttgttaacttcggtaacgtacctaagttacggaaaccgtacgccgtaaggacggtaccggaaccgggtacggaccggtaccggtaccgtttaaacgttacgttaacggtggtacggaaacggttaaaacggtagggtttaacggggaacgtaccggtaaccggtacgggtaccgggg

SEQ ID NO: 325114 - DNA, 530 bp, Homo sapiens
  misc_feature: GZ8MTXP02FF8BN.4.7.A07.1.454.CMB.2.raw
  modified_base (354)..(354): a, c, t, g, unknown or other
  misc_feature (354)..(354): n is a, c, g, or t
  modified_base (379)..(379): a, c, t, g, unknown or other
  misc_feature (379)..(379): n is a, c, g, or t
  modified_base (445)..(445): a, c, t, g, unknown or other
  misc_feature (445)..(445): n is a, c, g, or t
  modified_base (457)..(457): a, c, t, g, unknown or other
  misc_feature (457)..(457): n is a, c, g, or t
  modified_base (492)..(492): a, c, t, g, unknown or other
  misc_feature (492)..(492): n is a, c, g, or t
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagctggtctttttcttgtggcttaattttaaaaaggtgtccagtgtgaggtgcagctggtggagtcgtgggggaggcttggtacagccgtggggggtccctgagactctcctgtgcagcctctggattcatctttagcagctatgccatgagctggggtcccgccaggcctcccgaggggaaggggctgggaatggggtctcgatcctattagngctactactgggtgcacatacttcncagactccgtgaagggcccggttctccactctccagagacaaacttccaaagaacacgctgtatcngcaattgaaacngcctgagacgccgaggacacggccgtatacttacngtagaacgaaagtagttaggggatgaccacgtacgggg

SEQ ID NO: 325115 - DNA, 783 bp, Homo sapiens
  misc_feature: GZ8MTXP02FNAWD.4.7.A07.1.454.CMB.2.raw
  modified_base (291)..(291): a, c, t, g, unknown or other
  misc_feature (291)..(291): n is a, c, g, or t
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagctggtctttttcttgtggcttattttaaaaggtgtccagtgtgaggtgcagctggtggagtcgtgggggaggtcttgggtacaggccggtggggggtccctgacgactctcctgtgcacgcctctggtacttcattctttagcagctancgaccagtgacgtcgtcggggtcccgcgacggccgtccggaaggggacggggtctgggaaagttcggggtctacgtattaccgttagtttacgtcgtaccttacgtacggttgggttcggacctaactacgttaaccgttccgacgtaccggtaccgttacccgggtagggtaaaccgggggttccccgtttaccctacctaacgtttcccgaacccgaaaggtaaaccggtaaacctaaaacctttaacccgaaaacggtaacccgtaaccggttcgttacggttaaacctttcgttacggaacccttaaaagttacggaaaccgtacggtcccgtaaggaacgggaaccggaaccgggaccggggtaacctaacccgggggtactttaaaacgtttacgtttaccggaggtttaaccgggaacgttaaaaagggttacggtttaacgggggaaactttaccgggaacccggttacggggtaacccggggg

SEQ ID NO: 325116 - DNA, 700 bp, Homo sapiens
  misc_feature: GZ8MTXP02H7RDX.4.7.A07.1.454.CMB.2.raw
tcagagcactgtagcacgaccggtgctcgatttagcacgtgtcgcaggggctgagagaggagccccagccctgggattttcaggtgttttcatttggtgatcaggactgaacagagagaactcaccatggagtctgggctgagctggctttttctgtggtctattttaaaaggtgtccagtgtgaggtgcagctggtggagtcgtggggagcgttggtacagccgtgggggtccctgagactctccgtgtgcagcctcgtggattcgattctttagcagcctatcgccagtgcgtcggtcggtccgacggcgccgacgggaaggggtacgggtcggtaggtaggtcggtacagttacgtattagttagtctactacgtacggtgggtccgacctacgtaccgtttacgtactacgacgtcccgttaacgggagggtacccggttccgtacctacgacgttcccagaacgtaccgaaactttacaaaccgaaacgtaccgtaaccgtcgtaagttaccgtataccgtaattaacgaacgaacgttacccgaggtaacgaacggacccggaacgggtaacgaacccggggtaaccgtacgtttaaaccgttacgtaacgttccgggaagtaaaaacgggttaacggtttcggggttaaaacgtaaacgttacccggaacccgttaagggggaacccccgggg

SEQ ID NO: 325117 - DNA, 551 bp, Homo sapiens
  misc_feature: GZ8MTXP02IATBI.4.7.A07.1.454.CMB.2.raw
  modified_base (204)..(204): a, c, t, g, unknown or other
  misc_feature (204)..(204): n is a, c, g, or t
  modified_base (249)..(249): a, c, t, g, unknown or other
  misc_feature (249)..(249): n is a, c, g, or t
  modified_base (258)..(258): a, c, t, g, unknown or other
  misc_feature (258)..(258): n is a, c, g, or t
  modified_base (260)..(260): a, c, t, g, unknown or other
  misc_feature (260)..(260): n is a, c, g, or t
  modified_base (262)..(262): a, c, t, g, unknown or other
  misc_feature (262)..(262): n is a, c, g, or t
  modified_base (264)..(264): a, c, t, g, unknown or other
  misc_feature (264)..(264): n is a, c, g, or t
  modified_base (266)..(269): a, c, t, g, unknown or other
  misc_feature (266)..(269): n is a, c, g, or t
  modified_base (271)..(272): a, c, t, g, unknown or other
  misc_feature (271)..(272): n is a, c, g, or t
  modified_base (274)..(275): a, c, t, g, unknown or other
  misc_feature (274)..(275): n is a, c, g, or t
  modified_base (277)..(277): a, c, t, g, unknown or other
  misc_feature (277)..(277): n is a, c, g, or t
  modified_base (302)..(302): a, c, t, g, unknown or other
  misc_feature (302)..(302): n is a, c, g, or t
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagcgtgtcgttttctaggtggctattttaaaaggtgtccagtgtgaggtgcagctggtggagtntgggggaggcttggtacagccgtgggggcctgagctctctgtgcncgctcgtgntntntntnnnntnncnngngcgtcgtcgcgcgcgcgaggagggngagagtgtgtctatctatagtgtactacgtacgtcggtcgactactactactcgcgacgtacgtaccgtacgtacggtccggtccgtcctactactacgacgacgaacgtactaacgaaacgaacgtacgtacgtacgtacgtacgtacgtactaactacgaacgacgtacgagacgacgacgacgacgacgtacgtacgtacgtacgtagtagaagtaagtagtacggtacgtacgtacgtacgacgg

SEQ ID NO: 325118 - DNA, 631 bp, Homo sapiens
  misc_feature: GZ8MTXP02G3QIO.4.7.A07.1.454.CMB.2.raw
  modified_base (392)..(392): a, c, t, g, unknown or other
  misc_feature (392)..(392): n is a, c, g, or t
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagctggctttttcttgtggctattttaaaaggtgtccagtgtgaggtgcagctggtggagtcgtgggggaggtcttggtacgaggccgtcggggggtccctgagactctctgtgcacgcctctggattcattctttagcagctatcgccagtgagcgtcgggtccgccgaggccgtccgaggggacggggacgtaggaagtgggtctctatctatagtgacttacgtacgtgggtcggccactactacgtcncgacgtacctccgtagggtacgggtcccgttccgtcccactccctccgtaagacgtaaactaaacttacccgaaaagaaccgtaacgtaccgtagttacgtacttagtaccgtaattaccgaaactacggccctaggacgacggaccggaacgaccgtacggaccgttaattacgtacgttagtacgtaacggtaaaggtacggtttagggaactacggtaccgtacggtacccggggg

SEQ ID NO: 325119 - DNA, 724 bp, Homo sapiens
  misc_feature: GZ8MTXP02JW01Y.4.7.A07.1.454.CMB.2.raw
  modified_base (292)..(292): a, c, t, g, unknown or other
  misc_feature (292)..(292): n is a, c, g, or t
tcagagcactgtagcacgaccggtgctcgatttagcacgtgtcgcaggggctgagagaggagcccagccctgggattttcaggttgttttcatttggtgatcaggactgaacagagagaactcaccatggagtctgggctgagctggtctttttcttgtggcttaattttaaaaggtgtccagtgtgaggtgcagcgtggtggaggtcggtgggggaggtcgttggtacgacggtccggttcggggggtccctggacgtacctcctcctgtcgcacgtccctcgtggattcnttcttagcagctatcgccagtgagtcgtcggtaccaccgtaggccgtaccggaaggggtacggggtcgtagggtaagttcggggtctcgtaattcccgtagttacgtcgtacctaccgttaagtgggttcggacctaacgtacgttaaccgttcgacgtacgtacccgttacccgggtagggtaaaccggggttcccgtttcctacccgtaactttcccgtaaccgaacggaaacgtaaaccgtaaaaccttaacccgaaaaaggtaacccaaaccgggtcttacgtaaccgttacgtacgtaactaagtaaccgaacgacgaccgtaagacggacgaccggaacggaccgtaccgtacgttaaattacgtacgtagtaacggtaacgtaaaggttacggtacggaacgtacggaccggtacgggtaccggg

SEQ ID NO: 325120 - DNA, 771 bp, Homo sapiens
  misc_feature: GZ8MTXP02JA60L.4.7.A07.1.454.CMB.2.raw
  modified_base (226)..(226): a, c, t, g, unknown or other
  misc_feature (226)..(226): n is a, c, g, or t
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagctggtctttttcttgtggcttaattttaaaaggtgtccagtgtgaggtgcagctggtggagtcgtgggggaggtcttggtaacngccgtggggggtccctgagactctcctgtgcagcctctggattcatcttagcagctatgccatgagcgtcgggtaccgccgaaggccgtaccggaaggggaaacggggtctaggggtaaacgttggggtacctactagttacccctttaagttacgtcggtaccttaacttaaccgtggggttaccgggacctaaacgttaactttaacccgttcgaccgtaaacggtacccgttacccgggtagggttaaaacccgggggtcccgggttttacccgtacccgtaactttccctaccccgtaaagggaacgtaaaacccgtaaaactttaaccccgaaaaaacggtaaacccaaaccggtccttaaaggtaaccttcgtaacggtacctaaaatttcgggaaaacttcgtacccgtaagggacggaacgaccgggaacggaacccgtacggggtacccttaaacttagtttaaccggtaggtaacggaaacggtaaaggttacggttaacgggaactacccgggtaaccgtaacgggtaccgggg

SEQ ID NO: 325121 - DNA, 757 bp, Homo sapiens
  misc_feature: GZ8MTXP02JILXH.4.7.A07.1.454.CMB.2.raw
  modified_base (699)..(699): a, c, t, g, unknown or other
  misc_feature (699)..(699): n is a, c, g, or t
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagctggtcttttttcttgtggtcttaattttaaaaggtgtccagtgtggaggtgcagcgtgggtggaggtccggggagggcgttggtacgacggccggtcgggggtccggtcgagacgtctcctgtgcacgccgtctggtacgttctacttctttacgtcacgtctatacgtccagtggtacggtcgtcggggtcccggacccgacggaccgtccggtaacggggaacggggacggtacggggtaaggttcggggtacgttacgtacgttacgttagtttacgtacgtaccgttacgtttacggtacggggttcggtcgaacgttaacgttaaccgttaccgacgacggtaaccgtacccgggtaacgggggtaaaccgggggttaccccgtttcctacctaccgttaccgttacccgaaagaaacgtaaccttaaactacccgaaagaaaccgccgtagtacgtactctaggaactaacgttacgaacctaacgtccgtagacggacggcccggtaaacggaccgtaccggtccgttaaattacgtaccggtacgtanaaacggggtaaagtcggttagggggtaaccaacggtccgaacgggtcgggaaccccgg

SEQ ID NO: 325122 - DNA, 668 bp, Homo sapiens
  misc_feature: GZ8MTXP02JQA2G.4.7.A07.1.454.CMB.2.raw
  modified_base (357)..(357): a, c, t, g, unknown or other
  misc_feature (357)..(357): n is a, c, g, or t
  modified_base (487)..(487): a, c, t, g, unknown or other
  misc_feature (487)..(487): n is a, c, g, or t
tcagagcactgtagcacgaccggtgctcgatttagcacgtgtcgcaggggctgagagaggagcccagccctgggattttcaggtgttttcatttggtgatcaggactgaacagagagaactcaccatggagtctgggctgagctggcttttttcttgtggcttattttaaaaggtgtccagtgtgaggtgcagctggtggagtcgtgggggagcttggtacaggccgtggggggtccctgagactctcctgtgcagcctcgtggatcattcttagcagctatgccatgagcgtgggtccgcaggctccggaaggggaaggggtctagggaatgggtctcaagttcctaatttacgtnaccttactacgtggggtcgctaaacattaccgttcgacgaagtaacctccgggtaagaaacggggtcccgtttacacctaagtcctaccgagaaacaactaacttacccaaaaggaaacaccggacttanaacgttctaagacttaaacgttagaacgaacgaccgtagacgaacggaccgaaccggaaaccggaaccggaacccggttaaacgttaaacttaacgttaacgttacgaaacggtaaaaacggtaaacggtttaaacggggttaaaaggtaacggtaaaccggaaccggttaaacccggggg

SEQ ID NO: 325123 - DNA, 524 bp, Homo sapiens
  misc_feature: GZ8MTXP01CW59V.9.52.E08.1.454.CMB.2.raw
  modified_base (203)..(203): a, c, t, g, unknown or other
  misc_feature (203)..(203): n is a, c, g, or t
  modified_base (364)..(364): a, c, t, g, unknown or other
  misc_feature (364)..(364): n is a, c, g, or t
  modified_base (490)..(490): a, c, t, g, unknown or other
  misc_feature (490)..(490): n is a, c, g, or t
  modified_base (504)..(504): a, c, t, g, unknown or other
  misc_feature (504)..(504): n is a, c, g, or t
tcagtgatacgtctcacgaccggtgctcgatttagtcgagctctcagagagaaaggggaggaactgctcagttaggacccagagggaaccatggaagccccagcccagcttctcttcctcctgctactctggctcccagaaaacgccggagaaattgtgttggcacagtctccagccaccctgtctatgtctccaggggaaangccaccctctcctgcagggccagtcagagtgttggtactccttactctggtaccaacaaaacctggccaggctcccaggctcctcatctatgatgcatccaccagggccactggcactcccccgcagattcagtggcaggtgggtctgggacagaacttcnctctcacatcagcagcctggaccctgaactatttgactagtttatactgtcagcagcgggactagttcgcccctctccctctacgtttccgggcgggggtaccaagggtcgagctacaaacgtacngtcggcttgcaccntcctgtctcatccgttccgc

SEQ ID NO: 325124 - DNA, 532 bp, Homo sapiens
  misc_feature: GZ8MTXP01BVDBF.9.52.E08.1.454.CMB.2.raw
  modified_base (204)..(204): a, c, t, g, unknown or other
  misc_feature (204)..(204): n is a, c, g, or t
  modified_base (285)..(285): a, c, t, g, unknown or other
  misc_feature (285)..(285): n is a, c, g, or t
  modified_base (288)..(288): a, c, t, g, unknown or other
  misc_feature (288)..(288): n is a, c, g, or t
  modified_base (294)..(294): a, c, t, g, unknown or other
  misc_feature (294)..(294): n is a, c, g, or t
  modified_base (329)..(329): a, c, t, g, unknown or other
  misc_feature (329)..(329): n is a, c, g, or t
  modified_base (502)..(502): a, c, t, g, unknown or other
  misc_feature (502)..(502): n is a, c, g, or t
tcagtgatacgtctcacgaccggtgctcgatttagtcgagctctcggagagaaagggggaggaactgctcagttaggacccagagggaaccatggaagccccagcccagcttctcttcctcctgctactctggctcccagaaaacgccggagaaattgtgttggcacagtctccagccaccctgtctatgtctccaggggaaanagccaccctctcctgcagggccagtcagagtgttggtacgtccttactctggtaccaacaaaacctgccaggctccaggcnctnatctangatgcatccaccaggccactggcactccccgcagnttcagtggcaggtcggtctggggacagacttcactctcaccatcagcagccctgaccctgaacgtatttgactagtttattactgtcagcagcggaccaattcggcccctctccctcgtcgttcgggacgggggactaagggtgacgctaacgaaacgacgtgttcgactgcncatctcgtcttcacttccgttcccgctaac

SEQ ID NO: 325125 - DNA, 594 bp, Homo sapiens
  misc_feature: GZ8MTXP01AGXM7.9.52.E08.1.454.CMB.2.raw
  modified_base (204)..(204): a, c, t, g, unknown or other
  misc_feature (204)..(204): n is a, c, g, or t
  modified_base (370)..(370): a, c, t, g, unknown or other
  misc_feature (370)..(370): n is a, c, g, or t
tcagtgatacgtctcacgaccggtgctcgatttagtcgagctctcagagagaaagggggaggaactgctcagttaggacccagagggaaccatggaagccccagcccagcttctcttcctcctgctactctggctcccagaaaacgccggagaaattgtgttggcacagtctccagccaccctgtctatgtctccaggggaaanagccaccctctcctgcagggccagtcagagtgttggtacgtccttactctggtaaccaaacaaaacctggccaggctcccaggctcctcatctatgatgcatccacgacgggccactggcactccccgcagattcagtggcagtgggtctggggacagtaacttcnctctcaccatcagcacgcctggaccctgaacgtattttgactagttttattactgttacagtcaggccgggtacctaagttccggcccccttcgtcccctcgtaccggtttccggggcgggggtacccaaggggttcggacgtccgtaacgaaacggtaccgttggtggaccgttcgcccacctaacgttcgtcgttacccttcttacttcccttccccgaacc

SEQ ID NO: 325126 - DNA, 537 bp, Homo sapiens
  misc_feature: GZ8MTXP01AKZNR.9.52.E08.1.454.CMB.2.raw
  modified_base (203)..(203): a, c, t, g, unknown or other
  misc_feature (203)..(203): n is a, c, g, or t
  modified_base (365)..(365): a, c, t, g, unknown or other
  misc_feature (365)..(365): n is a, c, g, or t
  modified_base (514)..(514): a, c, t, g, unknown or other
  misc_feature (514)..(514): n is a, c, g, or t
tcagtgatacgtctcacgaccggtgctcgatttagtcgagctctcagagagaaaggggaggaactgctcagttaggacccagagggaaccatggaagccccagcccagcttctcttcctcctgctactctggctcccagaaaacgccggagaaattgtgttggcacagtctccagccaccctgtctatgtctccaggggaaanagccacctctcctgcagggccagtcagagtgttggtacgtcttactctggtaccaacaaaacctggccaggctcccaggctcctcatctatgatgcatccaccagggccactggcactccccgcagattcagtggcaggtgggtctggggacagaaccttcnctctcaccatcagcagccctggaccctgaacgtattttgctagtttattactgtcagcagcggggacaacgttcgcccctctccctcacgtttcgggcgggggtaccaaggtcgagctacgaaacgacttggtcggcttcggcaacctntctcgtctcttactccgttccgc

SEQ ID NO: 325127 - DNA, 540 bp, Homo sapiens
  misc_feature: GZ8MTXP01DYMM6.9.52.E08.1.454.CMB.2.raw
  modified_base (204)..(204): a, c, t, g, unknown or other
  misc_feature (204)..(204): n is a, c, g, or t
  modified_base (520)..(520): a, c, t, g, unknown or other
  misc_feature (520)..(520): n is a, c, g, or t
tcagtgatacgtctcacgaccggtgctcgatttagtcgagctctcagagagaaagggggaggaactgctcagttaggacccagagggaaccatggaagccccagcccagcttctcttcctcctgctactctggctcccagaaaacgccggagaaattgtgttggcacagtctccagccaccctgtctatgtctccaggggaaangccaccctctcctgcagggccagtcagagtgttggtacgtccttactctggtaaccaaacaaaaacctggccaggcctcccaggctcctcatctatgatgcatccaccagggccactggcactcccccgcagattcagtggcagtgggtctgggacagaacttcaactctcaccatcagcagcctggaccctgaagtatttgactagtttatactgtcagacagcggggacctaagttccggcccccttctccccgtcaccgtttcgggcgggggtaccaagggtcggagctacgaaacgacttgtggcttgcacntctgtctcattccttcccgc

SEQ ID NO: 325128 - DNA, 527 bp, Homo sapiens
  misc_feature: GZ8MTXP01BTQ1D.9.52.E08.1.454.CMB.2.raw
  modified_base (203)..(203): a, c, t, g, unknown or other
  misc_feature (203)..(203): n is a, c, g, or t
  modified_base (364)..(364): a, c, t, g, unknown or other
  misc_feature (364)..(364): n is a, c, g, or t
  modified_base (397)..(397): a, c, t, g, unknown or other
  misc_feature (397)..(397): n is a, c, g, or t
  modified_base (449)..(449): a, c, t, g, unknown or other
  misc_feature (449)..(449): n is a, c, g, or t
tcagtgatacgtctcacgaccggtgctcgatttagtcgagctctcagagagaaagggggaggaactgctcagttaggacccagagggaaccatggaagccccagcccagcttctcttcctcctgctactctggctcccagaaaacgccggagaaattgtgttggcacagtctccagccaccctgtctatgtctccaggggaangccacctctcctgcagggccagtcagagtgttggtacgtccttactctggtaccaaacaaaacctggccaggctcccaggctcctcatctatgatgcatccaccagggccactggcatcccccgcagattcagtggcagtgggtctggggacagaacttcnctctcaccatcagcagcctggaccctgaacgtnttttgactagtttatactgtcagcagcgggactattcggcccctctcccctnacgtttcgggcgggggtaccagggtcggagctacaacgtacttgtggcttgcaccaatctgtctcacttccttcccgc

SEQ ID NO: 325129 - DNA, 591 bp, Homo sapiens
  misc_feature: GZ8MTXP01CEAU1.9.52.E08.1.454.CMB.2.raw
  modified_base (289)..(289): a, c, t, g, unknown or other
  misc_feature (289)..(289): n is a, c, g, or t
tcagtgatacgtctcacgaccggtgctcgatttagtcgagctctcggagagaaagggggaggaactgctcagttaggacccagagggaaccatggaagccccagcccagcttctcttcctcctgctactctggctcccagaaaacgccggagaaattgtgttggcacagtctccagccaccctgtctatgtctccaggggaaagagccaccctctcctgcagggccagtcagagtgttggtacgtccttactctggtaccaacaaaacctggccaggctcccagctccnatctatgatgcatcccaccaggccactcggcactccccgacagacttcagtggcaggtcgggtctgggacagtacttcactctcacatcagcagcctcggaccctaggaagtacttttgcttaagtttattactgtcagcacgcggtaacctaagtttccggccccttctccccgttcgtaccggttttcgggggccgggggtaaccctaaaggggttcggacgtccgtaacgaaaacggttacgtcggttcggctgccgttacacgttcgtcgttcttcctacttcccttccccgctaacg

SEQ ID NO: 325130 - DNA, 577 bp, Homo sapiens
  misc_feature: GZ8MTXP01DUZZC.9.52.E08.1.454.CMB.2.raw
  modified_base (204)..(204): a, c, t, g, unknown or other
  misc_feature (204)..(204): n is a, c, g, or t
  modified_base (392)..(392): a, c, t, g, unknown or other
  misc_feature (392)..(392): n is a, c, g, or t
  modified_base (545)..(545): a, c, t, g, unknown or other
  misc_feature (545)..(545): n is a, c, g, or t
tcagtgatacgtctcacgaccggtgctcgatttagtcgagctctcagagagaaagggggaggaactgctcagttaggacccagagggaaccatggaagccccagcccagcttctcttcctcctgctactctggctcccagaaaacgccggagaaattgtgttggcacagtctccagccaccctgtctatgtctccaggggaaangccaccctctcctgcagggccagtcagagtgttggtactccttatctggtaaccaacaaaactgccaggctccaggctcctcatctatgatgcatccacaggccatgcactccccgcagattcagtggcaggtgggtctgggacagtaaccttcaactctacaccatcagcagcctggaccctgaatntttgactagtttatactgtcagtcgagacggggaacctaagtttccggcccccttacgtcccctcgtaacccggttttccgggggaccggggggtaccctaagggtcggaagcctacggaaaacgtacgttggtacggtcttcggccaccgtntccgtgttcctacttacttcctttcccgaacc

SEQ ID NO: 325131 - DNA, 525 bp, Homo sapiens
  misc_feature: GZ8MTXP01EKM7A.9.52.E08.1.454.CMB.2.raw
  modified_base (204)..(204): a, c, t, g, unknown or other
  misc_feature (204)..(204): n is a, c, g, or t
  modified_base (286)..(286): a, c, t, g, unknown or other
  misc_feature (286)..(286): n is a, c, g, or t
  modified_base (290)..(290): a, c, t, g, unknown or other
  misc_feature (290)..(290): n is a, c, g, or t
  modified_base (499)..(499): a, c, t, g, unknown or other
  misc_feature (499)..(499): n is a, c, g, or t
tcagtgatacgtctcacgaccggtgctcgatttagtcgagctctcagagagaaagggggaggaactgctcagttaggacccagagggaaccatggaagccccagcccagcttctcttcctcctgctactctggctcccagaaaacgccggagaaattgtgttggcacagtctccagccaccctgtctatgtctccaggggaaanagccaccctctcccgcagggccagtcagagtgttggtacgtccttactctggtaccaacaaaacctggccaggctccaggcncctnatctatgatgcatcccacaggccactggcactccccgcagattcagtggcagtcgggctgggacagacttcactctcaccatcagcagccctggaccctgaatatttgactagtttattactgtcagcagcggacaattcggccctctccctcaccgtttcgggacgggggacctaagggtcggacgctaacaaacgagtgttgctgcncatctgtcttcattccttccgctaac

SEQ ID NO: 325132 - DNA, 540 bp, Homo sapiens
  misc_feature: GZ8MTXP01BKLVT.9.52.E08.1.454.CMB.2.raw
  modified_base (203)..(203): a, c, t, g, unknown or other
  misc_feature (203)..(203): n is a, c, g, or t
  modified_base (369)..(369): a, c, t, g, unknown or other
  misc_feature (369)..(369): n is a, c, g, or t
  modified_base (401)..(401): a, c, t, g, unknown or other
  misc_feature (401)..(401): n is a, c, g, or t
  modified_base (508)..(508): a, c, t, g, unknown or other
  misc_feature (508)..(508): n is a, c, g, or t
  modified_base (524)..(524): a, c, t, g, unknown or other
  misc_feature (524)..(524): n is a, c, g, or t
tcagtgatacgtctcacgaccggtgctcgatttagtcgagctctcagagagaaagggggaggaactgctcagttaggacccagagggaaccatggaagccccagcccagcttctcttcctcctgctactctggctcccagaaaacgccggagaaattgtgttggcacagtctccagccaccctgtctatgtctccaggggaanagccaccctctcctgcagggccagtcagagtgttggtacgtccttactctggtaaccaaacaaaacctggccaggctcccaggctcctcatctatgatgcatcccaccgaggcccactcggcactccccgcagattcagtggcaggtgggtctgggacagacttcnctctcacatcagcacgcctggaccccgaagtntttgctagttttatctgtcagcagccggactagttcggcccctcgtccctcgtcgttcgggaccgggggactaaggggtgacgctaacgaaacgagtgttgctgacncttcgtctgtccttcncttcccttcccgctcg

SEQ ID NO: 325133 - DNA, 610 bp, Homo sapiens
  misc_feature: GZ8MTXP01ES0ID.9.52.E08.1.454.CMB.2.raw
  modified_base (579)..(579): a, c, t, g, unknown or other
  misc_feature (579)..(579): n is a, c, g, or t
tcagtgatacgtctcacgaccggtgctcgatttagtcgagctctcagagagaaagggggaggaactgctcagttaggacccagagggaaccatggaagccccagcccagcttctcttcctcctgctactctggctcccagaaacgccggagaattgtgttggcacagtctccagccaccctgtctatgtctccgaaggggaaagacgccaccctctcctgcgagggccagtcagagtgttggtacgtccttactctaggtaaccaaacaaaactggaccaggcctccaggctcctcatctatgatgcactccaccgaggggccacgtcggccactcccccgcagattcgagtggcaggtggggtcgtagggacagtaacttcaactctcaccatcagcacgcctgacctagacgtatttgacttaagttttatactgtacagtacacggaccggggaactaacgttccggccccttccgttccccgttcgtaccggtttccgggggccggggggtaacctaacgggggtcggaacgtaaccgtaacgaaacggtacgttggtcggtcttcggccacgtntctcgttcttcttactcccgttcccgtaacc

SEQ ID NO: 325134 - DNA, 670 bp, Homo sapiens
  misc_feature: GZ8MTXP01AQUMD.9.52.E08.1.454.CMB.2.raw
  modified_base (206)..(206): a, c, t, g, unknown or other
  misc_feature (206)..(206): n is a, c, g, or t
  modified_base (476)..(476): a, c, t, g, unknown or other
  misc_feature (476)..(476): n is a, c, g, or t
tcagtgatacgtctcacgaccggtgctcgatttagtcgagctctcagagagaaagggggaggaactgctcagttaggacccagagggaaccatggaagccccagcccagcttctcttcctcctgctactctggctcccagaaaacgccggagaaattgtgttggcacagtctccagcccaccctgtctatgtctccgaggggaaangcccaccctctcctgcagggccagtcagagttgttggtacgtccttactctggtaaccaaacaaaacctggccaggcctcccaggcctcctcatctatgatgcactcccaccgacggggcccacgtcgggaccaccgtccccccggctaaggtactttccgaggttcggccgtaggggttcgggggtcgtagggggacctaaggtaccctttccaaccttcctaccaccctatcacgccaacggcccgttacggacccctggaaacgttnttttcgacttagttttatacgtgtcaggtcacggaccggtactaacgttccggcccccttcctaccccgttcgtaccggtttccgggggccgggggtaacctaaggggtcggacgtaaccgtaacgaaaccggtacgttggtcggtcttcgccacctaacttcgtcgttacctcttacttcccgttcccgtaac

SEQ ID NO: 325135 - DNA, 597 bp, Homo sapiens
  misc_feature: GZ8MTXP01AD94Z.9.52.E08.1.454.CMB.2.raw
  modified_base (204)..(204): a, c, t, g, unknown or other
  misc_feature (204)..(204): n is a, c, g, or t
  modified_base (564)..(564): a, c, t, g, unknown or other
  misc_feature (564)..(564): n is a, c, g, or t
tcagtgatacgtctcacgaccggtgctcgatttagtcgagctctcagagagaaagggggaggaactgctcagttaggacccagagggaaccatagaagccccagcccagcttctcttcctcctgctactctggctcccagaaaacgccggagaaattgtgttggcacagtctccagccaccctgtctatgtctccaggggaaanagcccaccctctcctgcagggccagtcagagtgttggtactcttactctaggtaaccaaacaaaacctggccaggcctcccaggctcctcatctatgatgcatccaccagggcccacgtcggcacctccccgccagtacttcgagtggctaggtgggtcgtgggacagtaacttcaactctcacatcagcacgcctgaccctgaacgttatttgactagtttattactggtacagtcacggacggggtaactaagttccggccccttacctccctcgtaccggtttcgggggaccgggggtacctaaggggtcggacgtcgtaaccgaaacgtacgttggtacggcttcggcttaaccgnttctcgttcttcttacttcccgttcccgtaacc

SEQ ID NO: 325136 - DNA, 523 bp, Homo sapiens
  misc_feature: GZ8MTXP02HFF62.9.52.E08.1.454.CMB.2.raw
  modified_base (204)..(204): a, c, t, g, unknown or other
  misc_feature (204)..(204): n is a, c, g, or t
  modified_base (503)..(503): a, c, t, g, unknown or other
  misc_feature (503)..(503): n is a, c, g, or t
tcagtgatacgtctcacgaccggtgctcgatttagtcgagctctcagagagaaagggggaggaactgctcagttaggacccagagggaaccatggaagccccagcccagcttctcttcctcctgctactctggctcccagaaaacgccggagaaattgtgttggcacagtctccagccaccctgtctatgtctccaggggaaanagccaccctctcctgcagggccagtcagagtgttggtacgtccttactctggtaaccaaacaaaaacctggccaggctcccaggctcctcatctatgatgcatccacagggccatggcatccccgcagattcagtggcagtggggtctgggacagacttcactctcaccatcagcagcctgaccctgaagattttgctagtttattactgtcagcagcggacctaaattcggcccctctccctcacgtttcgggcgggggaccaagggtgagctacaaaacgaactggcgctcgacacntctcgtctctactcctcctc

SEQ ID NO: 325137 - DNA, 536 bp, Homo sapiens
  misc_feature: GZ8MTXP02HCXGE.9.52.E08.1.454.CMB.2.raw
  modified_base (204)..(204): a, c, t, g, unknown or other
  misc_feature (204)..(204): n is a, c, g, or t
  modified_base (365)..(365): a, c, t, g, unknown or other
  misc_feature (365)..(365): n is a, c, g, or t
tcagtgatacgtctcacgaccggtgctcgatttagtcgagctctcagagagaaagggggaggaactgctcagttaggacccagagggaaccatggaagccccagcccagcttctcttcctcctgctactctggctcccagaaaacgccggagaaattgtgttggcacagtctccagccaccctgtctatgtctccaggggaaangccacctctcctgcagggccagtcagagtgttggtacgtccttactctggtaccaacaaaacctggccaggctcccaggctcctcatctatgatgcatccaccagggcccactggcatcccccgcagattcagtggcaggtgggtctggggacagacttcnctctcaccatcagcagccctggaccctgaacgtattttgctagtttattactgtcagcagcggacctaagttcggcccctctccctcacgtttcgggcgggggtaccaagggtcgagtctacgaaacgactggtcggctcgctacaatctgttcttcacttccttcccgtc

SEQ ID NO: 325138 - DNA, 530 bp, Homo sapiens
  misc_feature: GZ8MTXP02FSRWP.9.52.E08.1.454.CMB.2.raw
  modified_base (204)..(204): a, c, t, g, unknown or other
  misc_feature (204)..(204): n is a, c, g, or t
tcagtgatacgtctcacgaccggtgctcgatttagtcgagctctcagagagaaagggggaggaactgctcagttaggacccagagggaaccatggaagccccagcccagcttctcttcctcctgctactctggctcccagaaaacgccggagaaattgtgttggcacagtctccagccaccctgtctatgtctccaggggaaanagccaccctctcctgcagggccagtcagagtgttggtacgtccttactctggtaccaacaaaacctggccaggctcccaggctcctcatctatgatgcatccaccgagggccactggccactcccccgcagattcagtggcagtggggtctggggacagacttcgctctcacatcagcagcctggaccctgaacgtatttgctagtttattactgtacagcagcggtaccagttcggcccctctccctcgtacgtttcgggcgggggtaccaagggtggacgtctacaaacgactgcgctgcaccaatctcgtctacatcctccgc

SEQ ID NO: 325139 - DNA, 585 bp, Homo sapiens
  misc_feature: GZ8MTXP02JPC1H.9.52.E08.1.454.CMB.2.raw
  modified_base (204)..(204): a, c, t, g, unknown or other
  misc_feature (204)..(204): n is a, c, g, or t
tcagtgatacgtctcacgaccggtgctcgatttagtcgagctctcagagagaaagggggaggaactgctcagttaggacccagagggaaccatggaagccccagcccagcttctcttcctcctgctactctggctcccagaaaacgccggagaaattgtgttggcacagtctccagccaccctgtctatgtctccaggggaaanagccaccctctcctgcagggccagtcagagtgttggtacgtccttactctggtaaccaaacaaaacctggccaggctcccaggctcctcatctatgatgcatccaccaggccactggcactccccgcagattcagtggcagtgggtctgggacagacttcactctcaccatcagcacgcctagaccctgaagtatttgcttagtttattactgtacagtcagtcggaactaagttccggacccccttctcccctcgtaccggtttccgggggacgggggtaaccaaggggtcggaacgtccgtacgaaaacggtacgtggtacgggccttacggcctaacgtaagttccgttcgtccttactactttcccgttaccccgtc

SEQ ID NO: 325140 - DNA, 634 bp, Homo sapiens
  misc_feature: GZ8MTXP02GOYNM.9.52.E08.1.454.CMB.2.raw
  modified_base (204)..(204): a, c, t, g, unknown or other
  misc_feature (204)..(204): n is a, c, g, or t
  modified_base (280)..(280): a, c, t, g, unknown or other
  misc_feature (280)..(280): n is a, c, g, or t
  modified_base (418)..(418): a, c, t, g, unknown or other
  misc_feature (418)..(418): n is a, c, g, or t
tcagtgatacgtctcacgaccggtgctcgatttagtcgagctctcagagagaaagggggaggaactgctcagttaggacccagagggaaccatggaagccccagcccagcttctcttcctcctgctactctggctcccagaaacgccggagaaattgtgttggcacagtctccagccaccctgtctatgtctccgaggggaaancgcccaccctctcctgcagggccagtcagagtgttggtactccttatctggtaccaacaaactggccaggctccgngctcctcatctatgatgcactccaccgaggcccactggccacgtcccccgcagtacttcgaggtcggcagggtgggtcgtggggacaggtaccttcactcctcaccatcacgcacgcccgtcggaccctgaaacgttnttttgacgttagttttaacttactgttaccagtacgacggaccggaacctaacgttcccggccccttccgtccccgttaccgtaccggtttccgggggaccggggggtaaccaagggggttacggaccggtacgtaaccgaaaacggtacgttcgggtacggtcgtcgaccgaccgtaagttccgtacgttccttactactttcccgttacccgac

SEQ ID NO: 325141 - DNA, 502 bp, Homo sapiens
  misc_feature: GZ8MTXP02F2APZ.9.52.E08.1.454.CMB.2.raw
  modified_base (204)..(204): a, c, t, g, unknown or other
  misc_feature (204)..(204): n is a, c, g, or t
  modified_base (430)..(430): a, c, t, g, unknown or other
  misc_feature (430)..(430): n is a, c, g, or t
tcagtgatacgtctcacgaccggtgctcgatttagtcgagctctcagagagaaagggggaggaactgctcagttaggacccagagggaaccatggaagccccagcccagcttctcttcctcctgctactctggctcccagaaaacgccggagaaattgtgttggcacagtctccagccaccctgtctatgtctccaggggaaangccaccctctcctgcagggccagtcagagtgttggtacgtccttactctggtaaccaaacaaaacctggccaggctcccagctcctcatctatgatgcatccaccaggccactggcactccccgcagattcagtgcagtggctgggacagacttcactctcaccatcagcagctgacccgatactttgctagtttatactgtcagcagcgacattcgccctctccncacgttcggcggggacagggtgagctacgaaacgactgtggctgacaccagtctgtctcactctcccgctac

SEQ ID NO: 325142 - DNA, 553 bp, Homo sapiens
  misc_feature: GZ8MTXP02JQIN8.9.52.E08.1.454.CMB.2.raw
  modified_base (204)..(204): a, c, t, g, unknown or other
  misc_feature (204)..(204): n is a, c, g, or t
  modified_base (395)..(395): a, c, t, g, unknown or other
  misc_feature (395)..(395): n is a, c, g, or t
  modified_base (515)..(515): a, c, t, g, unknown or other
  misc_feature (515)..(515): n is a, c, g, or t
tcagtgatacgtctcacgaccggtgctcgatttagtcgagctctcagagagaaagggggaggaactgctcagttaggacccagagggaaccatggaagccccagcccagcttctcttcctcctgctactctggctcccagaaaacgccggagaaattgtgttggcacagtctccagccaccctgtctatgtctccaggggaaanagcccaccctctcctgcagggccagtcagagtgttggtacgtcttatctggtaccaacaaaacctggccaggctcccaggctcctcatctatgatgcatccaccaggccacgtggcactccccgcagacttcagtgcagtgggtctgggacagacttcactctcaccatcagcagcctcggaccctgaatntttgactagtttattacgtgtcagtcagcgacctagtcgccctctcctcgtacgtttcgggcggggtaccagggtcgacgtactacgaaacgtacgtggtacggcgtacgaccaaccgtnttccgttacgtcctttccgacttcccgttacccccgtc

SEQ ID NO: 325143 - DNA, 568 bp, Homo sapiens
  misc_feature: GZ8MTXP02HOB35.9.52.E08.1.454.CMB.2.raw
  modified_base (204)..(204): a, c, t, g, unknown or other
  misc_feature (204)..(204): n is a, c, g, or t
  modified_base (289)..(289): a, c, t, g, unknown or other
  misc_feature (289)..(289): n is a, c, g, or t
  modified_base (373)..(373): a, c, t, g, unknown or other
  misc_feature (373)..(373): n is a, c, g, or t
  modified_base (410)..(410): a, c, t, g, unknown or other
  misc_feature (410)..(410): n is a, c, g, or t
  modified_base (541)..(541): a, c, t, g, unknown or other
  misc_feature (541)..(541): n is a, c, g, or t
tcagtgatacgtctcacgaccggtgctcgatttagtcgagctctcagagagaaagggggaggaactgctcagttaggacccagagggaaccatggaagccccagcccagcttctcttcctcctgctactctggctcccagaaaacgccggagaaattgtgttggcacagtctccagccaccctgtctatgtctccaggggaaangccaccctctcctgcaggccagtcagagtgttggtacgtccttactctggtaccaaacaaaacctggccaggctcccaggctccncatctatgatgcatccaccgagggcccacgtggccactccccgccagtacttcgagtggcaggttcggggtctggggacagacntcactctcaccatcagcagcctggaccctaggaattnttttgactaagttttacttactgtcagctacgcggtaacagttccggccctcctcctcgtacgtttcggggcgggggacctagggtggacgtccgtacgaaacgtactggtacgcgtacgactaaccgttntcgttcgtcttactactttccgtcccg

SEQ ID NO: 325144 - DNA, 667 bp, Homo sapiens
  misc_feature: GZ8MTXP02HOL7Z.9.52.E08.1.454.CMB.2.raw
  modified_base (202)..(202): a, c, t, g, unknown or other
  misc_feature (202)..(202): n is a, c, g, or t
  modified_base (229)..(229): a, c, t, g, unknown or other
  misc_feature (229)..(229): n is a, c, g, or t
tcagtgatacgtctcacgaccggtgctcgatttagtcgagctctcagagaggaaagggggaggaactgctcagttaggacccagagggaaccatggaagccccagcccagcttctcttcctcctgctactctggctccagaaacgccggagaaattgtgttggcacagtctccagccacctgtctatgtctcgaggggaaangccacctctcctgcagggccagtcagngtgttggtactcttactctgtaaccaaacaaactgccaggctccagctcctcatctatgatgcactccaccgacggccacgtcggccactccccgcagtacttcagtggctaggtgggtctggggactagtaccttcactctacaccatcacgcacgcctaggaccctagaacgttagtttttcgacttagttttacttacgtgttacgagtacgaggtaccggaaccttaagtttcccggacccccttacttacccccgttcgttaacccgggtttccgggggacccggggggtaacctaaagggggttcggaaccggtaccgttaaaacccggaaaaccgggtaacgttacgggttcggggacccgttcggtaacccgaaccttaacgtttcggttcgtttaccgttacctacgtttccccgtttaccccggaacc

SEQ ID NO: 325145 - DNA, 585 bp, Homo sapiens
  misc_feature: GZ8MTXP02JE8Y1.9.52.E08.1.454.CMB.2.raw
  modified_base (204)..(204): a, c, t, g, unknown or other
  misc_feature (204)..(204): n is a, c, g, or t
  modified_base (376)..(376): a, c, t, g, unknown or other
  misc_feature (376)..(376): n is a, c, g, or t
  modified_base (554)..(554): a, c, t, g, unknown or other
  misc_feature (554)..(554): n is a, c, g, or t
tcagtgatacgtctcacgaccggtgctcgatttagtcgagctctcagagagaaagggggaggaactgctcagttaggacccagagggaaccatggaagccccagcccagcttctcttcctcctgctactctggctcccagaaaacgccggagaaattgtgttggcacagtctccagccaccctgtctatgtctccaggggaaangccaccctctcctgcagggccagtcagagttgttggtacgtccttactctggtaaccaacaaaacctggaccaggctcccaggctcctcatcatgatgcatccaccaggccactggcactcccccgcagattcagtggcaggtgggtctggggacagacttcactctcaccntcagcacgcctggaccctagacgttatttgacttacgtttatacgtgtacagtcacggcggtaacctagtttcccggcccccttactcccccgttagtacccggtttcgggggaaccgggggtacctaaaggggtcgaacgtcaacgaaaacggtctggtacggtctacgctaacgtntcgtcgttctactaccgtttccgtacccctc

SEQ ID NO: 325146 - DNA, 560 bp, Homo sapiens
  misc_feature: GZ8MTXP02G5WZ3.9.52.E08.1.454.CMB.2.raw
  modified_base (204)..(204): a, c, t, g, unknown or other
  misc_feature (204)..(204): n is a, c, g, or t
  modified_base (369)..(369): a, c, t, g, unknown or other
  misc_feature (369)..(369): n is a, c, g, or t
tcagtgatacgtctcacgaccggtgctcgatttagtcgagctctcagagagaaagggggaggaactgctcagttaggacccagagggaaccatggaagccccagcccagcttctcttcctcctgctactctggctcccagaaaacgccggagaaattgtgttggcacagtctccagccaccctgtctatgtctccaggggaaanagccaccctctcctgcagggccagtcagagtgttggtacgtccttactctggtaccaacaaaacctggccaggctcccaggctcctcatctatgatgcatccaccagggccactggcactcccccgcagattccagtggcaggtggggtctggggacagacttcnctctcaccatcagcagcctggaccctgaagtattttgctagtttattactgtcagcaggacggacctaagttcggaccccttcgtcccctcgtaccgtttcggggacgggggtaccaaggggtcgacggactacgaaacgtaacgtggtacggctcgactaccaatcgtacgtcttctctccttccgtacc

SEQ ID NO: 325147 - DNA, 629 bp, Homo sapiens
  misc_feature: GZ8MTXP02GLWTJ.9.52.E08.1.454.CMB.2.raw
  modified_base (203)..(203): a, c, t, g, unknown or other
  misc_feature (203)..(203): n is a, c, g, or t
  modified_base (394)..(394): a, c, t, g, unknown or other
  misc_feature (394)..(394): n is a, c, g, or t
tcagtgatacgtctcacgaccggtgctcgatttagtcgagctctcagagaggaaagggggaggaactgctcagttaggacccagagggaaccatggaagccccagcccagcttctcttcctcctgctactctggctcccagaaacgcggagaattgtgttggcacagtctccagccaccctgtctatgtctccgaggggaaancgcccaccctctcctgcagggccagtcagagttgttggtacgttccttactctaggtaacccaaacaaaacctggacccaggcctcccgaggcctcctcatctatgatgcactcccaccgacgggccacgtcggccactcccccgcagtacttcgaggtcggcgaggtggggtcgtgggacagtaccttcnctcctaccacatcagccacgtcccgtgggaccctagaagttattttcgacttaggtttttactacgttgtacagtaccgacgggtacccggtaaccttacgttcccggtaccccccttcgtacccccttacggtaccgggttttccgggggaccgggggtaccaaggggtcgacgtacgtacgaaacgtacgtggcgtcctacgcctactgtcctgttctactcttctcccgtac

SEQ ID NO: 325148 - DNA, 537 bp, Homo sapiens
  misc_feature: GZ8MTXP02I91TA.9.52.E08.1.454.CMB.2.raw
  modified_base (204)..(204): a, c, t, g, unknown or other
  misc_feature (204)..(204): n is a, c, g, or t
  modified_base (366)..(366): a, c, t, g, unknown or other
  misc_feature (366)..(366): n is a, c, g, or t
  modified_base (400)..(400): a, c, t, g, unknown or other
  misc_feature (400)..(400): n is a, c, g, or t
  modified_base (516)..(516): a, c, t, g, unknown or other
  misc_feature (516)..(516): n is a, c, g, or t
tcagtgatacgtctcacgaccggtgctcgatttagtcgagctctcagagagaaagggggaggaactgctcagttaggacccagagggaaccatggaagccccagcccagcttctcttcctcctgctactctggctcccagaaaacgccggagaaattgtgttggcacagtctccagccaccctgtctatgtctccaggggaaangccaccctctcctgcagggccagtcagagtgttggtacgtccttactctggtaccaacaaaacctggccaggctcccaggctcctcatctatgatgcatccaccagggccactggcactcccccgcagacttcagtggcaggtgggtctgggacagacttcnctctcaccatcagcagccctggaccctgaacgtnttttgctagtttattactgtcagcagcggacctaagttcggccccttcgtcccctcaccgtttcggggccgggggaccaggggtgacgtctacgaaacgactgtcggctcgccacntctcgtctcactcctcccgtc

SEQ ID NO: 325149 - DNA, 761 bp, Homo sapiens
  misc_feature: GZ8MTXP02GT5S0.9.52.E08.1.454.CMB.2.raw
  modified_base (200)..(200): a, c, t, g, unknown or other
  misc_feature (200)..(200): n is a, c, g, or t
  modified_base (213)..(213): a, c, t, g, unknown or other
  misc_feature (213)..(213): n is a, c, g, or t
tcagtgatacgtctcacgaccggtgctcgatttagtcgagctctcagagaggaaagggggaggaactgctcagttaggacccagagggaaccatggaagccccagcccagcttctcttcctcctgctactctggctccagaaacgcggagaattgtgttggcacagtctccagccacctgtctatgtctccgagggaacncgccacctctcgngcgaggccagtcgagtagttgttacgtaccttccttactcgtacggtaacccaaacgtaaccgtcggaccgacggaccctacccgacggtccttacctactacttctagtcgactcgacctaccgtacccgaccggacggccctacgtcggacctacccgtccccgacgtaacgttacttacgaggtcggtcgtaccgggtcgggtacgtacgggactacgttaccttaccgaccttcctacctaccgactccgaacgtccacggtcccgtacggtaacccttaggtaacgtttacgtttacgtaactttacgtttacgtacgttacgtacgtacggtaccgaacggtaccgtaaccgttacgttcccgtaccccgttaccgtccccgttacggttacccggggttacgggggaaccggggtaaccgtaacggggtcgtaaccgtaaccgtaaaccgtaaacggtacggttacggtaccgtaccgtaccggtaccttacgtaacgtttcccgttacgttacttaccgttaccgtttcccgttaccgac

SEQ ID NO: 325150 - DNA, 607 bp, Homo sapiens
  misc_feature: GZ8MTXP02GK4NN.9.52.E08.1.454.CMB.2.raw
  modified_base (204)..(204): a, c, t, g, unknown or other
  misc_feature (204)..(204): n is a, c, g, or t
tcagtgatacgtctcacgaccggtgctcgatttagtcgagctctcagagagaaagggggaggaactgctcagttaggacccagagggaaccatggaagccccagcccagcttctcttcctcctgctactctggctcccagaaaacgccggagaaattgtgttggcacagtctccagccaccctgtctatgtctccaggggaaangccaccctctcctgcagggccagtcagagtgttggtacgtccttactctggtaaccaaacaaaacctggccaggctcccaggctcctcatctatgatgcatccaccgaggccactcggcactcccccgcagtacttcagtggcaggtcggggtctggggacaggtaccttcacctcctcacctatcagcacgcctggacccttgaactattttgctagttttatactgtacagcaggccggaactagttcccggacccccttctcccgtcgtacggtttccgggggaccgggggtacctaaggggtcggacgtacgtaaccgaaaaggtacgtcgggtcggtaccgtacgacctacccaagttccgttacgttcccttaccgtactttcccgtttccccgaac

SEQ ID NO: 325151 - DNA, 731 bp, Homo sapiens
  misc_feature: GZ8MTXP02HIU0J.9.52.E08.1.454.CMB.2.raw
  modified_base (202)..(202): a, c, t, g, unknown or other
  misc_feature (202)..(202): n is a, c, g, or t
tcagtgatacgtctcacgaccggtgctcgatttagtcgagctctcggagagaaagggggaggaactgctcagttaggacccagagggaaccatggaagccccagcccagcttctcttcctcctgctactctggctccagaagcgccggagaattgtgttggcacagtctccagccaccctgtctatgtctccgaggggaaancgccaccctctcctgcgagggccagtcagagtgttggtacgtcttactcgtggtaaccaaacaaaacctggaccaggcctcccgaggcctcctcatctatgatcgacactcccaccgacggccctacgtggccaccgtcccccgactagtcttacgacggtggactagggtcgggtcgtacgggactacggtaccttcgacctccttacaccctataccgacgtacgtaccgtcccgtacgacccgtagtaaacgttcgtttttacgactttaaggttttacttacgtcgttacgacgacgtacggtaccggtaaccttaacgttcccggtaccccccttcgttaccccgttacccggttaccgggttttacccgggggacccgggggtaaacccggtaaggggttcccggaaaccggtacctttaaaaccgggaaaaccggttaccttacgggtacggtaccgttacgaccctaacggtaacttcggttaccgtttctaccgtaccgtttacccttaccccggtaacg

SEQ ID NO: 325152 - DNA, 524 bp, Homo sapiens
  misc_feature: GZ8MTXP02GPVGS.9.52.E08.1.454.CMB.2.raw
  modified_base (205)..(205): a, c, t, g, unknown or other
  misc_feature (205)..(205): n is a, c, g, or t
  modified_base (251)..(251): a, c, t, g, unknown or other
  misc_feature (251)..(251): n is a, c, g, or t
  modified_base (305)..(305): a, c, t, g, unknown or other
  misc_feature (305)..(305): n is a, c, g, or t
  modified_base (327)..(327): a, c, t, g, unknown or other
  misc_feature (327)..(327): n is a, c, g, or t
  modified_base (357)..(357): a, c, t, g, unknown or other
  misc_feature (357)..(357): n is a, c, g, or t
  modified_base (361)..(361): a, c, t, g, unknown or other
  misc_feature (361)..(361): n is a, c, g, or t
  modified_base (365)..(365): a, c, t, g, unknown or other
  misc_feature (365)..(365): n is a, c, g, or t
  modified_base (371)..(371): a, c, t, g, unknown or other
  misc_feature (371)..(371): n is a, c, g, or t
  modified_base (391)..(391): a, c, t, g, unknown or other
  misc_feature (391)..(391): n is a, c, g, or t
  modified_base (403)..(403): a, c, t, g, unknown or other
  misc_feature (403)..(403): n is a, c, g, or t
  modified_base (408)..(409): a, c, t, g, unknown or other
  misc_feature (408)..(409): n is a, c, g, or t
  modified_base (514)..(514): a, c, t, g, unknown or other
  misc_feature (514)..(514): n is a, c, g, or t
tcagtgatacgtctcacgaccggtgctcgatttagtcgagctctcagagagaaagggggaggaactgctcagttaggacccagagggaaccatggaagccccagcccagcttctcttcctcctgctactctggctcccagaaaacgccggagaaattgtgttggcacagtctccagccaccctgtctatgtctccgaggggaaangccaccctctcctgcagggccagtcagagtgttggtactccttacnctggtaccaacaaactggccaggctcccagctcctcatctatgatgcatccacnggccactggcactccccgcagnttcagtggcagtgggtctgggacagcttcnctcncacntcagcngcctgaccctgaactatttnctagtttatacngtacnncagcgtacaagttccggccctctccctcgtacgtttcggggacgggggaccaaggggtcgacgacgtacgaaacgtacgtgtcgctcgcaccaagtctgtctacnctccgtccgc

SEQ ID NO: 325153 - DNA, 757 bp, Homo sapiens
  misc_feature: GZ8MTXP02F4HLE.9.52.E08.1.454.CMB.2.raw
  modified_base (204)..(204): a, c, t, g, unknown or other
  misc_feature (204)..(204): n is a, c, g, or t
tcagtgatacgtctcacgaccggtgctcgatttagtcgagctctcggagagaaagggggaggaactgctcagttaggacccagagggaaccatggaagccccagcccagcttctcttcctcctgctactctggctcccagaaacgccggagaaattgtgttggcacagtctccagccaccctgtctatgtctccaaggggaaanagcccaccctctcctgcagggccagtcagagtgttggtacgttccttactctggtaccaaacaaaacctggacccaggcctcccaggctcctcatctatgatgcatccacgaggccacgtggcactccccgcagattcagtggcaggtggtctgggacagacttcactctcaccatcagcacggccctacgaccccgtagtaaacgttagttttacgaccgtttaaaggttttactttaacgttacggttacctaaacggtaccgaaacgggtacccccgggtaaaacccgttaaaacgggttttcccccgggcccccccttttaaacccccggttcccccgtttacccccgggtttaacccccggggtttttacccgggggaaccccgggggggtaaaacccgttaacgggggaccgggtaacggtacccgtaaaaccggtaaaaccggtaaaccggttcggttacggaaccgttcgacccgtaacccttaacgtccgtttacggtttaacctttccgtacctttaccccgttccccggtaacctttaaccg

SEQ ID NO: 325154 - DNA, 689 bp, Homo sapiens
  misc_feature: GZ8MTXP02H3C7A.9.52.E08.1.454.CMB.2.raw
  modified_base (203)..(203): a, c, t, g, unknown or other
  misc_feature (203)..(203): n is a, c, g, or t
  modified_base (211)..(211): a, c, t, g, unknown or other
  misc_feature (211)..(211): n is a, c, g, or t
  modified_base (250)..(250): a, c, t, g, unknown or other
  misc_feature (250)..(250): n is a, c, g, or t
tcagtgatacgtctcacgaccggtgctcgatttagtcgagctctcagagagaaagggggaggaactgctcagttaggacccagagggaaccatggaagccccagcccagcttctcttcctcctgctactctggctcccagaaaacgccggagaaattgtgttggcacagtctccagccacctgtctatgtctccaggggaaangccacctntcctgcagggccagtcagagttgttggtacgtccttacnctaggtaaccaaacaaaacctggccaggctcccagctcctcatctatgatgacatccacgaggcccagcggcactccccgcagacttcgagtcggctaggtggggtcctggggaactagtactttaccacttctaccaaccattccgagctacggccctaggaccctagaacgttattttgacctttaagtttactttacgtcgttctagacgacggtaccggtaactaacgttcccgggacccctttccgtaccccttcggtaaccggtttttaccggggggacgggggtaacccgtaaagggggttcgggaaccgtaccgttaaacggaaaaacccggtacgttacggggtacggtaccgttaccggaccctaaccgtaaccgttccccggtttacttacccgtaacgtttacccccggtttccccgaaccttaccg

SEQ ID NO: 325155 - DNA, 541 bp, Homo sapiens
  misc_feature: GZ8MTXP02G7V8I.9.52.E08.1.454.CMB.2.raw
  modified_base (204)..(204): a, c, t, g, unknown or other
  misc_feature (204)..(204): n is a, c, g, or t
  modified_base (364)..(364): a, c, t, g, unknown or other
  misc_feature (364)..(364): n is a, c, g, or t
  modified_base (398)..(398): a, c, t, g, unknown or other
  misc_feature (398)..(398): n is a, c, g, or t
tcagtgatacgtctcacgaccggtgctcgatttagtcgagctctcagagagaaagggggaggaactgctcagttaggacccagagggaaccatggaagccccagcccagcttctcttcctcctgctactctggctcccagaaaacgccggagaaattgtgttggcacagtctccagccaccctgtctatgtctccaggggaaanagccaccctctcctgcagggccagtcagagtgttggtacgtccttactctggtaccaacaaaacctggccaggctcccagctcctcatctatgatgcatccacaggccacgtggcactccccgcagattcgagtggcaggtggtctggggacagacttcnctctcaccatcagcacgcctcggaccctgaagtntttgctagtttattactgtacagcaggacgacctagtcgccctctcctctacgtttcgggacgggggtaccaagggtcggacgtcgtacgaaaacgaccgtggtacggctacgcaacctgtctcgtctctacttccctcctac

SEQ ID NO: 325156 - DNA, 634 bp, Homo sapiens
  misc_feature: GZ8MTXP02J12GN.9.52.E08.1.454.CMB.2.raw
  modified_base (205)..(205): a, c, t, g, unknown or other
  misc_feature (205)..(205): n is a, c, g, or t
  modified_base (407)..(407): a, c, t, g, unknown or other
  misc_feature (407)..(407): n is a, c, g, or t
tcagtgatacgtctcacgaccggtgctcgatttagtcgagctctcggagagaaagggggaggaactgctcagttaggacccagagggaaccatggaagccccagcccagcttctcttcctcctgctactctggctcccagaaaacgccggagaaattgtgttggcacagtctcccagccaccctgtctatgtctccaggggaaanagccaccctctcctgcagggccagtcagagtgttggtacgtccttactctgtaccaacaaaacctggcccaggctcccaggctcctcatctatgatgcatccaccagggccactggcactccccgcagtattcagtggcaggtcgggtctggggacagactttcactctcacagtcagcacgcctggacccctagaaagttntttgacttattttattactgtcacgcacggaccggtaacctacgttcccggtcccccttcccttccccgtacccgttaccggtttaccgggggaccgggggtaaacccgtaacggggttacgggactacccgtaaccgaaaacgtaaccgttcggtcggtcgtacgaccctaacctacgttccttcgtttacctttacctacctttccccgtttaccccgacctacg

SEQ ID NO: 325157 - DNA, 605 bp, Homo sapiens
  misc_feature: GZ8MTXP02H7KRP.9.52.E08.1.454.CMB.2.raw
  modified_base (205)..(205): a, c, t, g, unknown or other
  misc_feature (205)..(205): n is a, c, g, or t
  modified_base (382)..(382): a, c, t, g, unknown or other
  misc_feature (382)..(382): n is a, c, g, or t
  modified_base (396)..(396): a, c, t, g, unknown or other
  misc_feature (396)..(396): n is a, c, g, or t
tcagtgatacgtctcacgaccggtgctcgatttagtcgagctctcagagagaaagggggaggaactgctcagttaggacccagagggaaccatggaagccccagcccagcttctcttcctcctgctactctggctcccagaaaacgccggagaaattgtgttggcacagtctccagccaccctgtctatgtctccgaaggggaanagccaccctctcctgcagggccagtcagagtgttggtacgtccttactctggtaccaaacaaaacctggccaggcctcccaggctcctcatctatgatgcactccaccgagggcccacgtggaccactcccccgcagtacttcaggtggcaggtggggtctggggacaggtacttcncctctacaccatcncgacacgccctcggaccctggaacgttattttcgacgttacgtttttattaacgtggttcaacggacacggtaccgggtaacctaagttcccggccccttaccgtcccctacgttcggttccgggggcgggggtaaccaggggtgacgtctacgaaacgtacgtggtacgctacgcacctaagtccgtgtacttcaccttcttacccgc

SEQ ID NO: 325158 - DNA, 629 bp, Homo sapiens
  misc_feature: GZ8MTXP02I34O1.9.52.E08.1.454.CMB.2.raw
  modified_base (204)..(204): a, c, t, g, unknown or other
  misc_feature (204)..(204): n is a, c, g, or t
  modified_base (293)..(293): a, c, t, g, unknown or other
  misc_feature (293)..(293): n is a, c, g, or t
  modified_base (377)..(377): a, c, t, g, unknown or other
  misc_feature (377)..(377): n is a, c, g, or t
  modified_base (413)..(413): a, c, t, g, unknown or other
  misc_feature (413)..(413): n is a, c, g, or t
tcagtgatacgtctcacgaccggtgctcgatttagtcgagctctcagagagaaagggggaggaactgctcagttaggacccagagggaaccatggaagccccagcccagcttctcttcctcctgctactctggctcccagaaaacgccggagaaattgtgttggcacagtctccagccaccctgtctatgtctccaggggaaanagccaccctctcctgcagggccagtcagagtgttggtacgtccttactctggtaaccaacaaaacctggccaggcctcccgaggctccncatctatgatgcactccaccgacgggccacgtggcacctcccccgcagacttcgagtggcaggtgggtctgggacagtacttcnctctcaccatcacgcacgcctaggaccctgaagttnttttgcttagttttattactgtacagtcacggtccggaacctagttccggcccccttctcccctctaccggtttccgggggaccgggggtaccaaggggtcggaacgtccgtaaacgaaacggtaaccgttgggtaccgggtacttaccggacctaacccgtaacttaccgttacggtttccttaaccgtactttaccccggtttcccccgtaacc

SEQ ID NO: 325159 - DNA, 544 bp, Homo sapiens
  misc_feature: GZ8MTXP02GZKVC.9.52.E08.1.454.CMB.2.raw
  modified_base (204)..(204): a, c, t, g, unknown or other
  misc_feature (204)..(204): n is a, c, g, or t
  modified_base (401)..(401): a, c, t, g, unknown or other
  misc_feature (401)..(401): n is a, c, g, or t
  modified_base (444)..(444): a, c, t, g, unknown or other
  misc_feature (444)..(444): n is a, c, g, or t
tcagtgatacgtctcacgaccggtgctcgatttagtcgagctctcagagagaaagggggaggaactgctcagttaggacccagagggaaccatggaagccccagcccagcttctcttcctcctgctactctggctcccagaaaacgccggagaaattgtgttggcacagtctccagccaccctgtctatgtctccaggggaaangccaccctctcctgcagggccagtcagagtgttggtactccttactctggtaaccaaacaaaacctggaccaggctcccaggcctcctcatctatgatgcatccaccaggccactggcactcccccgcagattcagtggcaggtgggtctggggacagtacttcactctcaccatcagcagcctggaccctgaagtntttgactagtttatactgtcagtcagcgactagtcggcccctntccctcacgttcggggcgggggtacctagggtgacgccgtacgaaacgtactggtacgctacgccaccaagttcgtcgtacttctacttcccttccgacc

SEQ ID NO: 325160 - DNA, 732 bp, Homo sapiens
  misc_feature: GZ8MTXP02GS4MY.9.52.E08.1.454.CMB.2.raw
  modified_base (151)..(151): a, c, t, g, unknown or other
  misc_feature (151)..(151): n is a, c, g, or t
tcagtgatacgtctcacgaccggtgctcgatttagtcgagctctcagagagaaagggggaggaactgctcagttaggacccagagggaaccatggaagccccagcccagcttctcttcctcctgctactctggctccagaaaacgccgganaaattgtgttggcacagtctccagccaccctgtctatgtctccgaagggaaagcgcccacctctcctgcgacgggccagtcaagtagttgttcggttacttcctactcgtacggtaaaccaaaactaaaacgtcggaccaggccctacccgaggccttcctactactctatgtaactcgactacaccaaccggaacgggccctacgtcggacccaccgtcccccgacaaggtacttacgaggttcgggactaggggttgggtccgtaggggaacctagtaccttcacctcctaacaccactcgaacgaccaccggtaccgtccggaaacccgttaggaaactttgttttcgacttaaagtttttactaaccggtgtaaccaggtcgaacgggaccgtaaactacgttcccgtcccctccgtcccctacgtaccgggggtttcgggggaccggggtaacaaggggtcggacgtaccgtaaaacgaaaaccggttgtcgggtacggtaccgtacgacccgttaaacctaacgtttccggttaacgtttccctttaccaacctttccccgttacccgtaaaccc

SEQ ID NO: 325161 - DNA, 768 bp, Homo sapiens
  misc_feature: GZ8MTXP02F0TZ2.9.52.E08.1.454.CMB.2.raw
  modified_base (205)..(205): a, c, t, g, unknown or other
  misc_feature (205)..(205): n is a, c, g, or t
  modified_base (281)..(281): a, c, t, g, unknown or other
  misc_feature (281)..(281): n is a, c, g, or t
  modified_base (285)..(285): a, c, t, g, unknown or other
  misc_feature (285)..(285): n is a, c, g, or t
  modified_base (291)..(291): a, c, t, g, unknown or other
  misc_feature (291)..(291): n is a, c, g, or t
  modified_base (307)..(307): a, c, t, g, unknown or other
  misc_feature (307)..(307): n is a, c, g, or t
  modified_base (324)..(324): a, c, t, g, unknown or other
  misc_feature (324)..(324): n is a, c, g, or t
  modified_base (335)..(335): a, c, t, g, unknown or other
  misc_feature (335)..(335): n is a, c, g, or t
tcagtgatacgtctcacgaccggtgctcgatttagtcgagctctcagagagaaagggggaggaactgctcagttaggacccagagggaaccatggaagccccagcccagcttctcttcctcctgctactctggctcccagaaaacgccggagaaattgtgttggcacagtctccagccaccctgtctatgtctccgaggggaaanagccaccctctcctgcagggccagtcagagttgttggtactccttactcgtacgaaccaaacaaacgtgacagccnccgngctccnatctatgatgactacnccacgcggccagcgacnccgtccccganagtactacgaggtggacgtacgggtgggtccgtagggacctagtaccttcgaccttcctaccaacttcaccgacgaccaccgtacccgtaccgggtaacccttaggttaaaacgtttcgttttacgaacgttttaaggtttttaaacctttaccggttagtaccgaaacgtccggtaaaccgggtacccggttaaaacccgttacgggtttccccccggtcccccctttacccgttaccccccgttccggtttaacccgggggtttacccggggggaaacccgggggtaccgtaaaagggggttccggggaaccttaaccggtaaaacccggaaaaacggttccggttacggggccgtaccggtacgcccttaaaccggtcttacccgttcggttaccctttaccgttacccttcccccggtttccgtaaccg

SEQ ID NO: 325162 - DNA, 677 bp, Homo sapiens
  misc_feature: GZ8MTXP02GEHH7.9.52.E08.1.454.CMB.2.raw
  modified_base (284)..(284): a, c, t, g, unknown or other
  misc_feature (284)..(284): n is a, c, g, or t
tcagtgatacgtctcacgaccggtgctcgatttagtcgagctctcagagagaaagggggaggaactgctcagttaggacccagagggaaccatagaagccccagcccagcttctcttcctcctgctactctggctccagaaacgcggagaattgtgttggcacagtctccagccaccctgtctatgtctccgaggggaaagacgcccacctctcctgcagggccagtcagagtgttggtacgtcttactctggtaccaacaaaactgaccaggctccagctctnatctatgatgcatccacgaggccactggcactccccgacagtcttcgagtggcaggtcgggtcgtcggggaacagtaccttcaccgtctacaaccattccgaacgcgacgtcccgacggtaaccccttaggaaacgtttacgtttttgaccgtttaaggtttttaactttaaccgtgttacgacggtaccgtaacgggacccgggtaaacccttaaacggtttcccgggaccccccttttacgtacccccctttcggtacccgggttttacccggggggaccggggggttaaaccaagggggttacggaacgtacgttaacccgaaaacgtacgtggtacggcctacgacctaccgtaattcgacgttaccttctacgtttcccgtacccgtc

SEQ ID NO: 325163 - DNA, 691 bp, Homo sapiens
  misc_feature: GZ8MTXP02FX3BJ.9.52.E08.1.454.CMB.2.raw
  modified_base (203)..(203): a, c, t, g, unknown or other
  misc_feature (203)..(203): n is a, c, g, or t
  modified_base (360)..(360): a, c, t, g, unknown or other
  misc_feature (360)..(360): n is a, c, g, or t
  modified_base (376)..(376): a, c, t, g, unknown or other
  misc_feature (376)..(376): n is a, c, g, or t
  modified_base (380)..(380): a, c, t, g, unknown or other
  misc_feature (380)..(380): n is a, c, g, or t
  modified_base (410)..(410): a, c, t, g, unknown or other
  misc_feature (410)..(410): n is a, c, g, or t
tcagtgatacgtctcacgaccggtgctcgatttagtcgagctctcagagagaaagggggaggaactgctcagttaggacccagagggaaccatggaagccccagcccagcttctcttcctcctgctactctggctcccagaaaacgccggagaaattgtgttggcacagtctccagccaccctgtctatgtctccaggggaangccaccctctcctgcagggccagtcagagtgttggtacgtccttactctggtaccaaacaaacctggccaggctcccaggctcctcatctatgatgcactccaccgacgggccacgtcggccactcccccgcagtacttcagtcggcaggtgggtcnggggacagtaccttcnctcncacctatcagcagcctggaccctgtaagtnttttgactagttttacttacgtgtacgagtacgacggaccggtaaccgtaacgtttcccgggacccccctttaccgttacccccccgttcgttaaaccccgggtttttcccggggggaacccgggggggtaacccctaagggggttcggggaaccgtacccgttaacccggtaaaaccgggaccgtttacgggtaccgggtccgttacggacccgttaaaccctaagttcccgtttacggttaccctttccgtaaccgtttccccgttaccccggtacccg

SEQ ID NO: 325164 - DNA, 648 bp, Homo sapiens
  misc_feature: GZ8MTXP02HA658.9.52.E08.1.454.CMB.2.raw
  modified_base (205)..(205): a, c, t, g, unknown or other
  misc_feature (205)..(205): n is a, c, g, or t
  modified_base (441)..(441): a, c, t, g, unknown or other
  misc_feature (441)..(441): n is a, c, g, or t
tcagtgatacgtctcacgaccggtgctcgatttagtcgagctctcagagagaaagggggaggaactgctcagttaggacccagagggaaccatggaagccccagcccagcttctcttcctcctgctactctggctcccagaaaacgccggagaaattgtgttggcacagtctccagccaccctgtctatgtctccgaggggaaancgccacctctcctgcagggccagtcagagttgttggtacgtcttactctaggtaccaaacaaacctggaccaggcctcccgaggctcctcatctatgatgctatccaccgagggcccacgtggaccaccgtcccccgacacggtactttcgaggttcggctacggtcggggtctaggggacacgtacttcactctacaccatccaagtccacgtccctcggaccctagtaacgttntttcggacttaagtttattaaccgtgtacagtacgtacgtaccggaccttaagtccccgggtcccctcttccccgtacgttacccggggtttcggggaccgggggtaacctagggggtcgacgtaccgtaacgaaacggtcgttgggacgtctaccggcctacgtaactcggttcgttactttacccgtccgtttcccgtaccctcg

SEQ ID NO: 325165 - DNA, 694 bp, Homo sapiens
  misc_feature: GZ8MTXP02F1VE1.9.52.E08.1.454.CMB.2.raw
  modified_base (151)..(151): a, c, t, g, unknown or other
  misc_feature (151)..(151): n is a, c, g, or t
  modified_base (204)..(204): a, c, t, g, unknown or other
  misc_feature (204)..(204): n is a, c, g, or t
tcagtgatacgtctcacgaccggtgctcgatttagtcgagctctcagagagaaagggggaggaactgctcagttaggacccagagggaaccatggaagccccagcccagcttctcttcctcctgctactctggctcccagaaacgccgganaattgtgttggcacagtctccagcccaccctgtctatgtctccgaggggaaancgccaccctctcctgcagggccagtcagtagttgttggtaccgttcttactctaggtaaccaaacaaaactggaccaggcctacccaggctcctcatctatgatgcactccacgacggccacgtggcactccccgcagtacttcgaggtcggctacgggtgggtcgtaggggactagtaccctttcaccttcctaccaccattaccgagtaccaacggtcccgttacgggaaaccccttaggtaaaacgtttcgttttagaccgtttaacgtttttaagttacctgttaccgagtaccgaacggaccggtaaccctacgttcccggtacccccttccgttcccccgtacgttacccgggtttaccgggggacccggggggtaacctaaagggggtcggaacgtaccgtaaccgaaaacggtacggttcgtacggccttacggcttaacccgtaattcgttactccgttacaccggttccctacccgtacc

SEQ ID NO: 325166 - DNA, 606 bp, Homo sapiens
  misc_feature: GZ8MTXP02JSHJI.9.52.E08.1.454.CMB.2.raw
  modified_base (205)..(205): a, c, t, g, unknown or other
  misc_feature (205)..(205): n is a, c, g, or t
tcagtgatacgtctcacgaccggtgctcgatttagtcgagctctcagagagaaagggggaggaactgctcagttaggacccagagggaaccatggaagccccagcccagcttctcttcctcctgctactctggctcccagaaaacgccggagaaattgtgttggcacagtctccagccaccctgtctatgtctccgaggggaaangccacctctcctgcagggccagtcagagtgttggtactccttactctggtaccaacaaaacctggccaggctcccaggctcctcatctatgatgcactccaccgacgggccacgtggccactcccccgccagacttcagtggcaggtgggtctaggggacagtaccttcacctctcaccatcagccagccctaggaccctagaagttattttgacttagtttattacctgttacgagacgaggaccggactaacgttcccgggtcccctttcccgcccctttacgtaccgtttccgggggaccggggggtacctaagggggtcggacgtacctacggaaaacgtcgttaggcgtccgcggacctactaacgtcttcgtcctttacaccgttcctccgtacc

SEQ ID NO: 325167 - DNA, 708 bp, Homo sapiens
  misc_feature: GZ8MTXP02GBKOH.9.52.E08.1.454.CMB.2.raw
  modified_base (207)..(207): a, c, t, g, unknown or other
  misc_feature (207)..(207): n is a, c, g, or t
  modified_base (301)..(301): a, c, t, g, unknown or other
  misc_feature (301)..(301): n is a, c, g, or t
tcagtgatacgtctcacgaccggtgctcgatttagtcgagctctcggagagaaaggggggaggaactgctcagttaggacccagagggaaccatggaagccccagcccagcttctcttcctcctgctactctggctcccagaaaacgccggagaaattgtgttggcacagtctccagccaccctgtctatgtctccgaggggaaagngccacctctcctgcagggccagtcagtagtgttggtacgtccttactctaggtaccaaacaaaacctggaccaggctcccagctcctcatctangatgacactccaaccgacgggccacgtcggaccaccgtccccgacagtacttacgaggtggacgtaggttcggggtacgtagggacacgttaccttcaaccttcctaccacctatcccagtaccacgtccgtacggaccctagtaaacgttatttcacgttttattacttacgtgtacagcgaacggtaccgaacttaacgttccgtccccttcgtcccgttaccgtacgggtttaccgggggaccgggggttaacgaacgggggttcgaaaccggtaccgtaaaaccgtaaaaccgggtacgtttacgggccgggttaacctccggttaaacgaacccttacgtttccggttccgttttacctacccttaccgtttacccccgttaaaccccggtctttaaaccgg

SEQ ID NO: 325168 - DNA, 649 bp, Homo sapiens
  misc_feature: GZ8MTXP02FIR6V.9.52.E08.1.454.CMB.2.raw
  modified_base (232)..(232): a, c, t, g, unknown or other
  misc_feature (232)..(232): n is a, c, g, or t
  modified_base (294)..(294): a, c, t, g, unknown or other
  misc_feature (294)..(294): n is a, c, g, or t
  modified_base (614)..(614): a, c, t, g, unknown or other
  misc_feature (614)..(614): n is a, c, g, or t
tcagtgatacgtctcacgaccggtgctcgattttagtcgagctctcagagagaaagggggaggaactgctcagttaggacccagagggaaccatggaagccccagcccagcttctcttcctcctgctactctggctcccagaaaacgccggagaaattgtgttggcacagtctccagccaccctgtctatgtctccaggggaaagagccacctctcctgcaggccagtcagngtgttggtacgtcttactctggtaccaacaaaactggccaggctcccaggctcctcatctangatgcatccacagggccactggcactccccgcagattcagtggcagtgggtctgggacagacttcactctacacctatcgacgtacacggcccgttcggaacccctgaaacgttaatttttggacctaggttttaactttaaccgtgttaccgagtacaacggaccggtaacccgtaaacgtttccggaccccccttcttaccccccgttaccgtaccggtttttcccgggggaccggggggtaaccccgtaagggggttcgggacggtaccgtttaccgaaaacccggtaacgtcgggtacggtcgtacgcctaaccgnttacgttcgtcttccgtactcccgttcccgtaccc

SEQ ID NO: 325169 - DNA, 720 bp, Homo sapiens
  misc_feature: GZ8MTXP02J193C.9.52.E08.1.454.CMB.2.raw
  modified_base (204)..(204): a, c, t, g, unknown or other
  misc_feature (204)..(204): n is a, c, g, or t
  modified_base (234)..(234): a, c, t, g, unknown or other
  misc_feature (234)..(234): n is a, c, g, or t
  modified_base (295)..(295): a, c, t, g, unknown or other
  misc_feature (295)..(295): n is a, c, g, or t
tcagtgatacgtctcacgaccggtgctcgatttagtcgagctctcagagagaaagggggaggaactgctcagttaggacccagagggaaccatggaagccccagcccagcttctcttcctcctgctactctggctcccagaaacgccggagaaattgtgttggcacagtctccagcccaccctgtctatgtctccgagggaaancgcccaccctctcctgcagggccagtcagngtgttgtacgtccttactcgtagtaaccaaacaaaactggccacggcctcccaggcctccncatctatgatcgactactccgaccgacggcccacgtcggcctacccgtcccccgactacggtacttccgaaggtcgggtacgtacggggttcgggtaccgtggggacctagtaccgttccacgtcctaccaaccatacgacgccacggtaccctacggaacccttaggtaaagtttacgtttttcgcgtttaacgttttaacgtttacgttacgaccgtacgaccggtaacggtaccggtaacccttaacgttccccgggtaccccctttccggttcccctacgggtttaccccgggttacgggggacccgggggtaacccgtaaggggtacggaccgtaccgtaaccgtaaaccggacgttacggtacggctaccgcctaaccgtgttccgtacgttccttacgtaccttcccggttacccacg

SEQ ID NO: 325170 - DNA, 581 bp, Homo sapiens
  misc_feature: GZ8MTXP02IEQU9.9.52.E08.1.454.CMB.2.raw
  modified_base (203)..(203): a, c, t, g, unknown or other
  misc_feature (203)..(203): n is a, c, g, or t
  modified_base (212)..(212): a, c, t, g, unknown or other
  misc_feature (212)..(212): n is a, c, g, or t
  modified_base (246)..(246): a, c, t, g, unknown or other
  misc_feature (246)..(246): n is a, c, g, or t
  modified_base (306)..(306): a, c, t, g, unknown or other
  misc_feature (306)..(306): n is a, c, g, or t
tcagtgatacgtctcacgaccggtgctcgatttagtcgagctctcagagagaaagggggaggaactgctcagttaggacccagagggaaccatggaagccccagcccagcttctcttcctcctgctactctggctcccagaaaacgccggagaaattgtgttggcacagtctccagccaccctgtctatgtctccaggggaangccaccgtntcctgcagggccagtcagagtgttggactcttantggtaccaaacaaaacctggacaggctcccaggctcctacatctatcgatgcatccacgnggccagtggcactccccgcagattcagtgcagtggtctgggacagtaccttcactctacaccctatcagcacgcctacggaccctagaacgtattttacgacttaagtttattaactcgtacagtccagccggaactaagttccggtaccctcctcccttacgtacgtttcggggcgggggtaccagggttcggacgcgttacgaaaccgtagtaggtacggcttacggaccacgtaactcgttacgttcttacgtactttccgtttcccgaccc

SEQ ID NO: 325171 - DNA, 513 bp, Homo sapiens
  misc_feature: GZ8MTXP01BP4J3.10.36.D03.1.454.CMB.2.raw
tcagcatagtagtgcacgaccggtgctcgatttagctgcgtcacgatctctcttggggagagaagacaggattcaggacaatctccagcatggccggcttccctctcctcctcaccctcctcactcactgtgcagggtcctgggcccagtctgtgctgactcagccaccctcagcgtctgggacccccggcagagggtcaccatctcttgttctggaagcagctccaatgtcgggagagataatgtgtactggtaccagcaggtcccaggaacgcccccaaatcctcatctataacgattatcggcggcctcaggggtccctgaccgattctctcggctcaagtctggcacctcagccctcctggccatcagtggctcggtcgaggatgacgctgattatactgtgtagcatggggatgacagcctgagtgtctatgtctcgtacgttgggacgacgtacgtacgttccgttcgttcgaacgccaacggaccacccacctaacgttcgtaacc

SEQ ID NO: 325172 - DNA, 661 bp, Homo sapiens
  misc_feature: GZ8MTXP01DBBXM.10.36.D03.1.454.CMB.2.raw
  modified_base (194)..(194): a, c, t, g, unknown or other
  misc_feature (194)..(194): n is a, c, g, or t
  modified_base (245)..(245): a, c, t, g, unknown or other
  misc_feature (245)..(245): n is a, c, g, or t
tcagcatagtagtgcacgaccggtgctcgatttagctgcgtcacgatctctcttggggagagaagacaggattcaggacaatctccagcatggccggcttccctctcctcctcaccctcctcactcactgtgcagggtcctgggcccagtctgtgctgactcagccaccctcagcgtcgtcggggacccccggnaggacgggtcaccatctcttgttctggaagcagctaccaagtggtcggganagataatgtgtactggtaccagcacggtcccaaggaaccgcccccaaactcctacatactaataacgattacgtccggccggccctcgacgggggtccctcggaccgtattcctcgtacggcctacgaagtccgtcggacctaccctcaccgtccctcccgtcggacctagtccgacgggttcgggccgttcccgggtaccgagggtacgttcggaaccggtcttaggtatttacgttacgtgtagtagcgtaggttaggggtatcggaacgtacgtccgtaggtaagggttgtacgtttacgttcggttaccgttaacggtaacggttacgggaaccgttacggtacccgtaccgttacccgttacgaccgaaccgacccgaaccgaccccaacccttactccgttccgtaaccg

SEQ ID NO: 325173 - DNA, 540 bp, Homo sapiens
  misc_feature: GZ8MTXP01DY0J0.10.36.D03.1.454.CMB.2.raw
  modified_base (191)..(191): a, c, t, g, unknown or other
  misc_feature (191)..(191): n is a, c, g, or t
tcagcatagtagtgcacgaccggtgctcgatttagctgcgtcacgatctctcttggggagagaagacaggattcaggacaatctccagcatggccggcttccctctcctcctcaccctcctcactcactgtgcagggtcctgggcccagtctgtgctgactcagccaccctcagcgtctgggacccccggnagagggtcaccatctcttgttctggaagcagctccaatgtcgggagagataatgtgtactggtaccagcaggtcccaaggaaccggcccccaaactcctcatctataacgattatcggcggccctcgagggggtccctgaccgattctctcggctcaagtctggccacctcagccctccctggcccatcagtgggctccgggtcgaggatgacgctgattattactgtgtagcgagtggggatgacagccttgacgtgtcttatcgtcttcggaagttcgggaccttaagggtccaccgttccgttacgttcaacgtcccaacggtccccaacccgactcgttctaacc

SEQ ID NO: 325174 - DNA, 543 bp, Homo sapiens
  misc_feature: GZ8MTXP01BHUNR.10.36.D03.1.454.CMB.2.raw
  modified_base (191)..(191): a, c, t, g, unknown or other
  misc_feature (191)..(191): n is a, c, g, or t
  modified_base (237)..(237): a, c, t, g, unknown or other
  misc_feature (237)..(237): n is a, c, g, or t
  modified_base (439)..(439): a, c, t, g, unknown or other
  misc_feature (439)..(439): n is a, c, g, or t
tcagcatagtagtgcacgaccggtgctcgatttagctgcgtcacgatctctcttggggagagaagacaggattcaggacaatctccagcatggccggcttccctctcctcctcaccctcctcactcactgtgcagggtcctgggcccagtctgtgctgactcagccaccctcagcgtctgggacccccggnagagggtcaccatctcttgttctggaagcagctccaatgtcggganagataatgtgtactggtaccagcaggtcccaggaaccgcccccaaatcctcatctataacgattatcggcggccctcgagggggtccctgaccgtattctctcggcctcaagtctcggaccacctcagccctccctggccatcgagtcggctccggtccgaggatgacgctgtattattactgtgtagcagtgggatggacngctgagtgtcttagtcgtcttaacggaacgttgggaccaaggtccaaccgttccgttacgttccgaacgcccgaacggccccaaccccttactcgttcctaacc

SEQ ID NO: 325175 - DNA, 685 bp, Homo sapiens
  misc_feature: GZ8MTXP01EG9O9.10.36.D03.1.454.CMB.2.raw
  modified_base (194)..(194): a, c, t, g, unknown or other
  misc_feature (194)..(194): n is a, c, g, or t
  modified_base (237)..(237): a, c, t, g, unknown or other
  misc_feature (237)..(237): n is a, c, g, or t
tcagcatagtagtgcacgaccggtgctcgatttagctgcgtcacgatctctcttggggagagaagacaggattcaggacaatctccagcatggccggcttccctctcctcctcaccctcctcactcactgtgcagggtcctgggcccagtctgtgctgactcagcccaccctcagcgtcgtcgggacccccggnagaggtcaccatctcttgttctgaagcagctcaatgtcggganagataatgtgtactggtacagcaggtcccaaggaaccgcccccaaatcctcatctaataacgattatcggcgccctcgacggggtcctgaccgtattctctcggcctacgaagtctcggcccacctcacgtcccctcccgtgggccctatccgtaaggtcggggccgttccccgggtccggaaggtacgttacggaaccggtcttaggtaactttacttaaccgttggttacgtaaggtcgtaaaggttgggggtaaattcgggaaactaggtcccgttggtaaacggttggtaccttttaagtccggtttccgtttaacggggaaacgttacgggggaaaccccgttaaaggggtcccctaacccggttccccgttaacgttaccgaacccggaccccgtaaaccgggacccccaaacccccgttacttcgggttaacctaaccccg

SEQ ID NO: 325176 - DNA, 684 bp, Homo sapiens
  misc_feature: GZ8MTXP01BZUIL.10.36.D03.1.454.CMB.2.raw
  modified_base (193)..(193): a, c, t, g, unknown or other
  misc_feature (193)..(193): n is a, c, g, or t
  modified_base (219)..(219): a, c, t, g, unknown or other
  misc_feature (219)..(219): n is a, c, g, or t
  modified_base (347)..(347): a, c, t, g, unknown or other
  misc_feature (347)..(347): n is a, c, g, or t
tcagcatagtagtgcacgaccggtgctcgatttagctgcgtcacgatctctcttggggagagaagacaggattcaggacaatctccagcatggccggcttccctctcctcctcaccctcctcactcactgtgcagggtcctgggcccagtctgtgctgactcagcccacctcagcgtcgtcgggacccccggnaggaggtcaccatctcttgtctggancagctccaatggtcggagagatagtgtgtacgtggtaccagcgacggtaccccaaggaacccggcccccaaactcctacatactataacgattacgcggccgccctcgcgggtccctgaccgtattcnctcggcctacgaagtctcggaccacctcgaccgtcccctcccgtcgacctacgtaccgtcgggtcgggtcccgtacccggggtacccggagggtaacgtcggtaaccgtcgttagtactttagtacgttggttagtaacgcgggtagttggggaatacggtaaaccgtcggtccgtaggttaacgttcggttacttttacggtccggtttacggtaacccgggtaaacggttccggggaaacccgttaacgggtaccccgtaacccgttcccgttaccgacccgtaacgggaccccctaacgacccccgaacccttaccgttaacgcccgttccccg

SEQ ID NO: 325177 - DNA, 661 bp, Homo sapiens
  misc_feature: GZ8MTXP01AJI02.10.36.D03.1.454.CMB.2.raw
  modified_base (192)..(192): a, c, t, g, unknown or other
  misc_feature (192)..(192): n is a, c, g, or t
  modified_base (238)..(238): a, c, t, g, unknown or other
  misc_feature (238)..(238): n is a, c, g, or t
  modified_base (292)..(292): a, c, t, g, unknown or other
  misc_feature (292)..(292): n is a, c, g, or t
  modified_base (309)..(309): a, c, t, g, unknown or other
  misc_feature (309)..(309): n is a, c, g, or t
tcagcatagtagtgcacgaccggtgctcgatttagctgcgtcacgatctctcttggggagagaagacaggattcaggacaatctccagcatggccggcttccctctcctcctcaccctcctcactcactgtgcagggtcctgggcccagtctgtgctgactcagccaccctcagcgtctcgggacccccggnagagggtcaccatctcttgttctggaagcagctccaatgtcggganagataatgtgtactggtacagcaggtcccaaggaaccggcccccaaactccctnaatctataacgattacncggcgccctcgacgggggtccctgaccgtattcctacgtcggcctccgaagtccgtcggaccaacccgtcacgccccttcccgtcggcctactcgacgggtcgggcccgtccgggtaccggaggtacgtcggtaaccgtccttaggtaactttacgttaacgtggtacgttacgcggtagtcggggtaatcggaaccgagtccgtaggtacgttgtaccgtttagttcggttccggtttaaccggaaccggttcgggggtaaacccttaagggtccctaacccggttaccgttaccgttacgaaccggaccccgaaacggtccccaaccccgttacgtcgttcctaaccccg

SEQ ID NO: 325178 - DNA, 735 bp, Homo sapiens
  misc_feature: GZ8MTXP01EJAC1.10.36.D03.1.454.CMB.2.raw
  modified_base (195)..(195): a, c, t, g, unknown or other
  misc_feature (195)..(195): n is a, c, g, or t
tcagcatagtagtgcacgaccggtgctcgatttagctgcgtcacgatctctcttggggagagaagacaggattcaggacaatctccagcatggccggcttccctctcctcctcaccctcctcactcactgtgcagggtcctgggcccagtctgtgctgactcagcccacctcagccgtcgtcgggacccccgggnaggacggtccacctattccttcgtttgttcgtaggaacgcacgtcctacgtaagtgggtacgggaagaagtaattaagtgtacgtacgtacggtaccagacgacggtacccgaacggaaccccgaccccctaaactcctacactactaataacgtatacgccggccgtccctcggtacggtcctacgaccgtcttcgtcgtccgtcctacgtagtccgtcgaccctacctcgccgtccccttcccgcgacctacgtcgtacgggtccgggtcccgtccgggtacggaggtacgtacggtacgtcgttagttaacgtttacgttacgtaggttagtacgtacggtaggtgggtatacgacgtcgtcgtaggtacgttcgttacgtttagttccggttacggttaacgggtaacggttaccgggtaaacccgttaaaccgggtcccgttaaccccggttaccgttaaccggttacccgaacccggtaaccccggaacccggtaccccctaacccgttacgttaacccgttaacccgtaaccg

SEQ ID NO: 325179 - DNA, 673 bp, Homo sapiens
  misc_feature: GZ8MTXP01B2TIS.10.36.D03.1.454.CMB.2.raw
  modified_base (217)..(217): a, c, t, g, unknown or other
  misc_feature (217)..(217): n is a, c, g, or t
  modified_base (233)..(233): a, c, t, g, unknown or other
  misc_feature (233)..(233): n is a, c, g, or t
  modified_base (470)..(470): a, c, t, g, unknown or other
  misc_feature (470)..(470): n is a, c, g, or t
tcagcatagtagtgcacgaccggtgctcgatttagctgcgtcacgatctctcttggggagagaagacaggattcaggacaatctccagcatggccggcttccctctcctcctcaccctcctcactcactgtgcagggtcctgggcccagtctgtgctgactcagccaccctcagcgtctcgggacccccggagaggtcaccatctcttgtctggaancagctcaatgtcgganagatatgtgtactggtacagcacggtcccaaggaaccggcccccaaactcctacactctaactaacgatttacgtccggccggtcccctacggacggggttcccctaggaccgtacttctccgtcggcctaccgaagtcctcggacctacccctcaccgtccctcccgtcggcctactcgaggtcgggtccgtccggtccgaggatcgacgtctagtattacttacgtgtagtacgngtaagttggggatacgacgtacgccgttaggtacgttcgtcctttaagttcggttcgttaacgggtaaccggtttacggggaaaccccgttacggggtacccctaaccccgggttacccgtttaccggttacccgaaccggtaacccccgtaaccgggaccccctaaaacccccggttacttccggttaacccgttaaccccg

SEQ ID NO: 325180 - DNA, 577 bp, Homo sapiens
  misc_feature: GZ8MTXP01EXEG5.10.36.D03.1.454.CMB.2.raw
  modified_base (194)..(194): a, c, t, g, unknown or other
  misc_feature (194)..(194): n is a, c, g, or t
  modified_base (314)..(314): a, c, t, g, unknown or other
  misc_feature (314)..(314): n is a, c, g, or t
  modified_base (338)..(338): a, c, t, g, unknown or other
  misc_feature (338)..(338): n is a, c, g, or t
  modified_base (564)..(564): a, c, t, g, unknown or other
  misc_feature (564)..(564): n is a, c, g, or t
tcagcatagtagtgcacgaccggtgctcgatttagctgcgtcacgatctctcttggggagagaagacaggattcaggacaatctccagcatggccggcttccctctcctcctcaccctcctcactcactgtgcagggtcctgggcccagtctgtgctgactcagcccaccctcagcgtcgtcgggacccccggnagagggtcaccatctcttgttctggagcagctccaatggtcgggagagataagtgtgtactggtacagcacggtcccaaggaaccggacccccaaactcctacatctaataacgattacncggccggtccctcgacgggtcccngaccgtattctctcggcctcaagtctcgccctacctcgacgccctcccgtggacctatcgaggtcggctcccgggtcgaggatgacgtctagtatttagtacgtgtagtagcgagtggggatcgacagcctggagtgtcttagtcgtcgtaacggacgttgggaacccttaaggtcctaacccgttcgttcgttaccgaacgacccgaacggcccctaacccgttntcgttaaccgtcc

SEQ ID NO: 325181 - DNA, 608 bp, Homo sapiens
  misc_feature: GZ8MTXP01ETQST.10.36.D03.1.454.CMB.2.raw
  modified_base (322)..(322): a, c, t, g, unknown or other
  misc_feature (322)..(322): n is a, c, g, or t
  modified_base (443)..(443): a, c, t, g, unknown or other
  misc_feature (443)..(443): n is a, c, g, or t
  modified_base (466)..(466): a, c, t, g, unknown or other
  misc_feature (466)..(466): n is a, c, g, or t
  modified_base (474)..(474): a, c, t, g, unknown or other
  misc_feature (474)..(474): n is a, c, g, or t
tcagcatagtagtgcacgaccggtgctcgatttagctgcgtcacgatctctcttggggagagaagacaggattcaggacaatctccagcatggccggcttccctctcctcctcaccctcctcactcactgtgcagggtcctgggcccagtctgtgctgactcagcccaccctcagccgtcgtcggggaccccccgggcaggacgggtcaacccatccttcttgttctggaagcagctccaatggtcgggagagataatgtgtactggtaccagcacggtcccaggaaccggcccccaaactcctcactactaataacgattnccggaccggtccctcgacgggggtccctgaccgtattctcgtcggcctcgaagtctcggaccacctcacgccctccctcggctagtcaggtcgggccgtccgggtccgaggctggaccgtntagtattattacgtgtagagcgngtgggtanacgacgtcgtcgtaggtgtcgtacttagtcgttacggttaacggtacggttacgggaaccgttacggtacccgtccttaccgaccgttaccgaacccgcccgaaccgaccccacccgttactccgttccgtccg

SEQ ID NO: 325182 - DNA, 576 bp, Homo sapiens
  misc_feature: GZ8MTXP01DJSXE.10.36.D03.1.454.CMB.2.raw
  modified_base (192)..(192): a, c, t, g, unknown or other
  misc_feature (192)..(192): n is a, c, g, or t
  modified_base (219)..(219): a, c, t, g, unknown or other
  misc_feature (219)..(219): n is a, c, g, or t
  modified_base (561)..(561): a, c, t, g, unknown or other
  misc_feature (561)..(561): n is a, c, g, or t
tcagcatagtagtgcacgaccggtgctcgatttagctgcgtcacgatctctcttggggagagaagacaggattcaggacaatctccagcatggccggcttccctctcctcctcaccctcctcactcactgtgcagggtcctgggcccagtctgtgctgactcagccaccctcagcgtctcgggacccccggnagagggtcaccatctcttgtctggaancagctccaatgtcgggagagataatgtgtactggtaccagcacggtcccaaggaacccggacccccaaactcctcaatctaataacgattagcggcggccctcgacggggtccctgaccgtattctctcggctcaagtcctggcccacctcacgtcccctcccgtggcccatcgaggtcggctccggtcgaggatgacgctagtattagttactgtgtagcgagtgggatgacagtcgtgacgtgtacttagtcgttcgttaacgggaacgttcggggaaaccttaagggtcctaccgttaccgttacgttaccgaaccgacccgaacggaccccaaccccncgttcgccgtaaccc

SEQ ID NO: 325183 - DNA, 614 bp, Homo sapiens
  misc_feature: GZ8MTXP01ALOF1.10.36.D03.1.454.CMB.2.raw
  modified_base (194)..(194): a, c, t, g, unknown or other
  misc_feature (194)..(194): n is a, c, g, or t
  modified_base (241)..(241): a, c, t, g, unknown or other
  misc_feature (241)..(241): n is a, c, g, or t
  modified_base (331)..(331): a, c, t, g, unknown or other
  misc_feature (331)..(331): n is a, c, g, or t
  modified_base (341)..(341): a, c, t, g, unknown or other
  misc_feature (341)..(341): n is a, c, g, or t
  modified_base (408)..(408): a, c, t, g, unknown or other
  misc_feature (408)..(408): n is a, c, g, or t
tcagcatagtagtgcacgaccggtgctcgatttagctgcgtcacgatctctcttggggagagaagacaggattcaggacaatctccagcatggccggcttccctctcctcctcaccctcctcactcactgtgcagggtcctgggcccagtctgtgctgactcagccaccctcagcgtcgtcgggaccccccggnaggagggtcaccatctcttgttctggaagcagctcaatggtcggganagatatgtgtactggtaccagcacggtcccaggaaccgcccccaaactcctacactctaataacgattagcggccgcctgacgggtcccngaccgattcncgtcgctcagtctgccacctcacgccctccgtgccatcgagtcggctccggtcgaggactgaccgtntagtacttacgttacgtgtagtacgcggtaggtgggtactacggacgtacggtccgtaggtacgttcggtactttaggttcggttacccggttaacgggaacggttacgggtaaacccgttacggtcccgtacccgttaccgttaccggttaccgaacccggaccccgaaccggacccctaacccgttcgttaaccgttccgtccg

SEQ ID NO: 325184 - DNA, 643 bp, Homo sapiens
  misc_feature: GZ8MTXP01DVV5A.10.36.D03.1.454.CMB.2.raw
  modified_base (192)..(192): a, c, t, g, unknown or other
  misc_feature (192)..(192): n is a, c, g, or t
  modified_base (508)..(508): a, c, t, g, unknown or other
  misc_feature (508)..(508): n is a, c, g, or t
tcagcatagtagtgcacgaccggtgctcgatttagctgcgtcacgatctctcttggggagagaagacaggattcaggacaatctccagcatggccggcttccctctcctcctcaccctcctcactcactgtgcagggtcctgggcccagtctgtgctgactcagccaccctcagcgtcgtcgggaccccggnagaggtcaccatctcttgtctggaagcagctcaatggtcgggagagataatgtgtactggtacagcaggtcccaaggaaccgcccccaaactcctacatactaataacgattaacgcggccggccctcgacgggggtccctagaccgtattcctcgtcggcctacaagtctcggacccacctcgacgtcccctcccgtcggacccctagtccgacgggttcggggcccttcccggggtacccggaagggtacttcggaacgtcttaggtaatttaagttacctggttgtaacgcgtaagttggggaactgaaccgnggtcctaggtacgttgtctttaagtcgttcgttaaccgggtaaacgttcggggaaaccttaaacggtccgtaacccgttccgttcgttaccaacggacccaacggccccaaccccgttactcggttctaaccccg

SEQ ID NO: 325185 - DNA, 775 bp, Homo sapiens
  misc_feature: GZ8MTXP01EMKUD.10.36.D03.1.454.CMB.2.raw
  modified_base (194)..(194): a, c, t, g, unknown or other
  misc_feature (194)..(194): n is a, c, g, or t
  modified_base (210)..(210): a, c, t, g, unknown or other
  misc_feature (210)..(210): n is a, c, g, or t
  modified_base (222)..(222): a, c, t, g, unknown or other
  misc_feature (222)..(222): n is a, c, g, or t
  modified_base (240)..(240): a, c, t, g, unknown or other
  misc_feature (240)..(240): n is a, c, g, or t
tcagcatagtagtgcacgaccggtgctcgatttagctgcgtcacgatctctcttggggagagaagacaggattcaggacaatctccagcatggccggcttccctctcctcctcaccctcctcactcactgtgcagggtcctgggcccagtctgtgctgactcagccaccctcgagcgtcgtcgggacccccggnaggaggtcaccatctnttgttctggaancagctcaagtggtggganagtataagtgtagtactggtacagcgacggtacccaaggaacccgcccccaaactcctacaatctaataacgtattagccggcggtccctacgacggggtcccctaggaccgtacttccgtcgttcggaccttaccgaagttccgtacggaccctaacccgttcccgacgggtcccccttccccgttacggggacccctaacgttccgggtaaacgggttccgggggtacccgttccccggggttaccggaagggtacgtcggtaaaccggtctttaggtaaacttttaagtttaccgtggttaaggttacgacggtaagggtttcgggggaattacggaacgtaaccggtcccgttagggtaagttcggtaccttttaaggttcgggttccgttaaacggggtaacctttacgggggaacccttaaacgggtccccgtaaccccgggttaccccgtttacgaccgaaccccgggtaaccccgtaaaccgggacccccaaacccccggttcttaaccggtttccccgtaaccccg

SEQ ID NO: 325186 - DNA, 651 bp, Homo sapiens
  misc_feature: GZ8MTXP01ECVK4.10.36.D03.1.454.CMB.2.raw
  modified_base (195)..(195): a, c, t, g, unknown or other
  misc_feature (195)..(195): n is a, c, g, or t
  modified_base (223)..(223): a, c, t, g, unknown or other
  misc_feature (223)..(223): n is a, c, g, or t
  modified_base (243)..(243): a, c, t, g, unknown or other
  misc_feature (243)..(243): n is a, c, g, or t
  modified_base (300)..(300): a, c, t, g, unknown or other
  misc_feature (300)..(300): n is a, c, g, or t
  modified_base (349)..(349): a, c, t, g, unknown or other
  misc_feature (349)..(349): n is a, c, g, or t
tcagcatagtagtgcacgaccggtgctcgatttagctgcgtcacgatctctcttggggagagaagacaggattcaggacaatctccagcatggccggcttccctctcctcctcaccctcctcactcactgtgcagggtcctgggcccagtctgtgctgactcagcccacctcagccgtcgtcggggacccccggnaggacgggtcaccatctcttgtctggancagctcaagtggtacggganagtataatgtagtacgtggtaccagcacggtcccgaaggaaccgcccccaaatccanatctataacgattacgcggccgtcccgtacgacggggtccctgaccgtnttctcgtcgcctacgaagtctcggaccctacctctacgtcccctcccgcggacctatcgtagggtccgggaccttccgggaccgaggtactcggacgtcttagtatttacgttacgtggtagtcgtacggtaggttaggtacgtcgaacgtgtaccgttggtaaccgtgttaccgttagttcggtccggttaacggggtaacgttacggggaaaccttacgggtcccgtaaccggttacccgttacgttaccgaaccgaaccccgaacggtccccaaacccgttcttaacggccttaacccg

SEQ ID NO: 325187 - DNA, 670 bp, Homo sapiens
  misc_feature: GZ8MTXP01AG561.10.36.D03.1.454.CMB.2.raw
  modified_base (196)..(196): a, c, t, g, unknown or other
  misc_feature (196)..(196): n is a, c, g, or t
tcagcatagtagtgcacgaccggtgctcgatttagctgcgtcacgatctctcttggggagagaagacaggattcaggacaatctccagcatggccggcttccctctcctcctcaccctcctcactcactgtgcagggtcctgggcccagtctgtgctgactcagcccaccctcagcgtcgtcggggaccccccggnaggagggtcaccatctcttgttctggaagcagctcaatggtcgggagagataatgtagtactggtaccagcacggtcccaggaacccgcccccaaactcctacatctaataacgtattacgtccggccggccctcgacgggggtcccctgaccgtattcgtcgtcggcctacgaagtcgtcggaccacctcacgtccctccgtcggaccctagtcgaggtcgggccgtccgggtacgaggtactcgacgtctagtaatttattacgtggtagtacgcggtaaggtggggatacggaacacgtccgtaggtacgttcgtaccgtttagtcggttaccgttaacgggtaaccggttacggggaaacccgttaacgggttccccgtaacccggttcccgttaccggttacccgaacccgggtaccccgaaaccgggacccccaaaccccgttacgttccggttaacccttaaccccg

SEQ ID NO: 325188 - DNA, 546 bp, Homo sapiens
  misc_feature: GZ8MTXP01DNNPO.10.36.D03.1.454.CMB.2.raw
  modified_base (191)..(191): a, c, t, g, unknown or other
  misc_feature (191)..(191): n is a, c, g, or t
  modified_base (445)..(445): a, c, t, g, unknown or other
  misc_feature (445)..(445): n is a, c, g, or t
  modified_base (533)..(533): a, c, t, g, unknown or other
  misc_feature (533)..(533): n is a, c, g, or t
tcagcatagtagtgcacgaccggtgctcgatttagctgcgtcacgatctctcttggggagagaagacaggattcaggacaatctccagcatggccggcttccctctcctcctcaccctcctcactcactgtgcagggtcctgggcccagtctgtgctgactcagccaccctcagcgtctgggacccccggnaggagggtcaccatctcttgttctggaagcagctccaatgtcgggagagataatgtgtactggtaccagcaggtcccaaggaccggcccccaaactcctcatctataacgattatcggcgccctcgagggtccctgaccgtattctcgtcggcctcaagtctggccacctcacgccctccctggccatcgaggtcggctccggtccgaggactgacgtctagtattattactgtgtagcagttggggactgacngctgacgtgtcttatcggtcttaacggaacgttcgggaaccttaagggtccaccgttcgttacgttcaacgcccaacggcccaacccnctcgttctaaccg

SEQ ID NO: 325189 - DNA, 622 bp, Homo sapiens
  misc_feature: GZ8MTXP01BIWO8.10.36.D03.1.454.CMB.2.raw
  modified_base (191)..(191): a, c, t, g, unknown or other
  misc_feature (191)..(191): n is a, c, g, or t
  modified_base (195)..(195): a, c, t, g, unknown or other
  misc_feature (195)..(195): n is a, c, g, or t
  modified_base (212)..(212): a, c, t, g, unknown or other
  misc_feature (212)..(212): n is a, c, g, or t
  modified_base (216)..(216): a, c, t, g, unknown or other
  misc_feature (216)..(216): n is a, c, g, or t
  modified_base (232)..(232): a, c, t, g, unknown or other
  misc_feature (232)..(232): n is a, c, g, or t
  modified_base (277)..(277): a, c, t, g, unknown or other
  misc_feature (277)..(277): n is a, c, g, or t
  modified_base (317)..(317): a, c, t, g, unknown or other
  misc_feature (317)..(317): n is a, c, g, or t
  modified_base (328)..(328): a, c, t, g, unknown or other
  misc_feature (328)..(328): n is a, c, g, or t
tcagcatagtagtgcacgaccggtgctcgatttagctgcgtcacgatctctcttggggagagaagacaggattcaggacaatctccagcatggccggcttccctctcctcctcaccctcctcactcactgtgcagggtcctgggcccagtctgtgctgactcagccacctcagcgtcgtcgggaccccggnaggnggtcacatctcttgtcnggancagctcagtgtcgganagtatatgtgtactggacagcacggtccaggaccgccccaatccncatctataacgtattacgcggcgccctcggacgggtcccngaccgtattcncgtcgctacgagtctcggaccctacctcgaccgtcccgtcccgtcgggaccctagtccggacgggttcgggcccgtcccggggtaccggaggtacgtcggtaacgtcttagtactttagttacgttggtagtacgacgtaggtacgggtatacgaacgtagccgttgtaacggttctcgtttagttcgttcggttaacggtaaacggttcgggaaaccgttacggtccgtaccgttaccgttcgttaccgaaccgacccgaacggaccccaacccgttcttccgttctaacccg

SEQ ID NO: 325190 - DNA, 688 bp, Homo sapiens
  misc_feature: GZ8MTXP01AZ0QJ.10.36.D03.1.454.CMB.2.raw
  modified_base (193)..(193): a, c, t, g, unknown or other
  misc_feature (193)..(193): n is a, c, g, or t
  modified_base (223)..(223): a, c, t, g, unknown or other
  misc_feature (223)..(223): n is a, c, g, or t
  modified_base (242)..(242): a, c, t, g, unknown or other
  misc_feature (242)..(242): n is a, c, g, or t
  modified_base (258)..(258): a, c, t, g, unknown or other
  misc_feature (258)..(258): n is a, c, g, or t
  modified_base (294)..(294): a, c, t, g, unknown or other
  misc_feature (294)..(294): n is a, c, g, or t
tcagcatagtagtgcacgaccggtgctcgatttagctgcgtcacgatctctcttggggagagaagacaggattcaggacaatctccagcatggccggcttccctctcctcctcaccctcctcactcactgtgcagggtcctgggcccagtctgtgctgactcagccaccctcagcgtcgtcgggacccccggnaggagggtccaccatctcttgttctggaancagctcaagtggtcggganagataagtgtagtacnggtaccagcacgtcccaaggaccgccccaaatcctnatactaataacgattacgcggccgtcctcggacgggtccctagaccgtattcgcgtcggcctacgaagtcgtcgaaccacctcacgccctcccgcggaccacgtcgtacggtccggtccgtaccgggacggtacggattacggaccccgtagttacgtaaacgtttacgtttacgtggttacgtacgacggtacggttgggacgttacgacgtacgtaccgttggtaaacgttcgttaacgtttagttacggttaccggttaacgggtaaacggttacgggtaacccgttaacgggttacccgtaacccggttacccgttacggttaccgaacccggtaccccgtaaaccggacccccgtaaacccgttacttccggttaaccctttaaccccg

SEQ ID NO: 325191 - DNA, 775 bp, Homo sapiens
  misc_feature: GZ8MTXP01CXLWO.10.36.D03.1.454.CMB.2.raw
  modified_base (195)..(195): a, c, t, g, unknown or other
  misc_feature (195)..(195): n is a, c, g, or t
  modified_base (224)..(224): a, c, t, g, unknown or other
  misc_feature (224)..(224): n is a, c, g, or t
tcagcatagtagtgcacgaccggtgctcgatttagctgcgtcacgatctctcttggggagagaagacaggattcaggacaatctccagcatggccggcttccctctcctcctcaccctcctcactcactgtgcagggtcctgggcccagtctgtgctgactcagcccaccctcagcgtcgtcgggacccccgggnaggagggtcaccatctcttgttctggaancagcccaatggtcgggagagataagtgtgtactggtaccagcgacggtcccaacgggaaccggcccccaaactcctacatactaataacgattacgtcggcgccctcgacgggggtccctggaccgtacttctcgtcggaccccttaccgaacgtcgtcggccctaacccctcgaacgtcccctccccgtcgggaccctacgtccgtaacggggtccgggggtcccttcccgggggttacccggaaggggtacgtacgggaaccggtcgttacggttaatttacgtttaacgttggttaggttaacggcgttaaggggttcgggggtaagttacggaaaccgtacggtacccgttgggtaacggttcggttacttttaaagttcgggtttccgtttaaccggggaaaccggttacgggggaacccgttaaaaccgggttcccgttaaaccccgggttacccgttaacccggttcccggaaccgaaccccgaaacccgggaaccccctaaaccccgtaccgttaccggttaacccttaacccgtttcccccg

SEQ ID NO: 325192 - DNA, 750 bp, Homo sapiens
  misc_feature: GZ8MTXP01A6VTN.10.36.D03.1.454.CMB.2.raw
  modified_base (192)..(192): a, c, t, g, unknown or other
  misc_feature (192)..(192): n is a, c, g, or t
  modified_base (220)..(220): a, c, t, g, unknown or other
  misc_feature (220)..(220): n is a, c, g, or t
  modified_base (238)..(238): a, c, t, g, unknown or other
  misc_feature (238)..(238): n is a, c, g, or t
tcagcatagtagtgcacgaccggtgctcgatttagctgcgtcacgatctctcttggggagagaagacaggattcaggacaatctccagcatggccggcttccctctcctcctcaccctcctcactcactgtgcagggtcctgggcccagtctgtgctgactcagccaccctcagcgtctcgggacccccggnaggagggtcaccatctcttgtctggaancagctccaatgtcggganagataatgtgtactggtaccagcacggtcccaaggaaccggacccccaaactcctacatctaataacgattagcggcggccctcgacgggggtccctagaccgtattctcgtcggcctacaagtctacggccacccttcgacggtccccttcccgtcgggaccctacgtccgtaacgggtcggggtacccgttcccggggttcccggaagggtacgttacgggaaccggtccgttaggtaacttttaacgttaacgttggttaccggtttaagccggtaaggttacgggggtaattacgggtaaccgacgggtcccgttagggtaaggttcggtacctttaaggttcgttccgggtttaacccgggaaacgttcgggggtaaacccccagggggttacccctaaccccggtttaccccgttaaccgggttaccctaaacccggggtacccccgtaaaaccggggcccccccaaaaccccccggttacttccggttaaccccgttaacccccg

SEQ ID NO: 325193 - DNA, 668 bp, Homo sapiens
  misc_feature: GZ8MTXP01A6UEL.10.36.D03.1.454.CMB.2.raw
  modified_base (195)..(195): a, c, t, g, unknown or other
  misc_feature (195)..(195): n is a, c, g, or t
  modified_base (225)..(225): a, c, t, g, unknown or other
  misc_feature (225)..(225): n is a, c, g, or t
  modified_base (244)..(244): a, c, t, g, unknown or other
  misc_feature (244)..(244): n is a, c, g, or t
tcagcatagtagtgcacgaccggtgctcgatttagctgcgtcacgatctctcttggggagagaagacaggattcaggacaatctccagcatggccggcttccctctcctcctccaccctcctcactcactgtgcagggtcctgggcccagtctgtgctgactcagcccaccctcagccgtcgcgggacccccggnaggacgggtcaccatctcttgttctggaancagctcaagtggtcggganagataagtgtgtactggtaccagcgacggtacccgaaggaacccgacccccaaactcctacatactaagtaacgtattcgacggccgtcccctcggaccgggtccacggtacctacttcgtcgtccggcctacgaagtccgtcgacctacctcaccgtccctcccgtggacctatcggagggtccgggtccgtacccggggtcgaaggtacgtcggaccgtcgttagtactttacgttacgtggttagtacgtagggtaggtaggggtactacggaacgtcggtcgttaggtaggttcgttacgttagttccggttcgttaaccgggaacggttacgggaacccgttacgtacccgtaaccgttccgttcgaccaaccggacccgaacccggacccctacccgttcgtccgttccgttaacccg

SEQ ID NO: 325194 - DNA, 680 bp, Homo sapiens
  misc_feature: GZ8MTXP01D0UG1.10.36.D03.1.454.CMB.2.raw
  modified_base (197)..(197): a, c, t, g, unknown or other
  misc_feature (197)..(197): n is a, c, g, or t
  modified_base (218)..(218): a, c, t, g, unknown or other
  misc_feature (218)..(218): n is a, c, g, or t
  modified_base (223)..(223): a, c, t, g, unknown or other
  misc_feature (223)..(223): n is a, c, g, or t
  modified_base (498)..(498): a, c, t, g, unknown or other
  misc_feature (498)..(498): n is a, c, g, or t
  modified_base (531)..(531): a, c, t, g, unknown or other
  misc_feature (531)..(531): n is a, c, g, or t
tcagcatagtagtgcacgaccggtgctcgatttagctgcgtcacgatctcttcttggggagagaagacaggattcaggacaatctccagcatggccggcttccctctcctcctccaccctcctcactcactgtgcagggtcctgggcccagtctgtgctgactcagcccaccctcagccgtcgtcgggacccccggnagaggtcaccatctcttgtcnggaancagctacaagtggtacggaagagaatagtgtagtactggtaccagcgacggtcccaaggaacccgtacccccaaatcctacatactaagtaacgtagttacgccggaccggtccctacgggacggggttcccctaggaccccgttagttccgtcgtcggtaccctaccgaagttccacggaccctaccctcaaccgtccccgttcccgtcggacctagtcgtacggtcgggccttcccgggacggagtctaggaccgttgtagtattacgttagngttaacgtgtacgggagttggggattacggacncgtcgttaggtagttcgtacgtttacgtcggttacggtaacggtaacgttccgggtaaaccgttaccggtaccctaacccggttaccgttccgttaccgaacccgacccgtaacccggacccctaaaccgttcgttccgttcccgtccg

SEQ ID NO: 325195 - DNA, 718 bp, Homo sapiens
  misc_feature: GZ8MTXP01EWL7T.10.36.D03.1.454.CMB.2.raw
  modified_base (196)..(196): a, c, t, g, unknown or other
  misc_feature (196)..(196): n is a, c, g, or t
tcagcatagtagtgcacgaccggtgctcgatttagctgcgtcacgatctctcttggggagagaagacaggattcaggacaatctccagcatggccggcttccctctcctcctccaccctcctcactcactgtgcagggtcctgggcccagtctgtgctgactcagcccaccctcagccgtcgtcgggacccccggnaggagggtccaccatctcttgttctggaagcagctccaagtggtacgggagagataatggtgtacgtggtaccagcacggtcccgaaggaacccggcccccaaactccctacactactaataacgtatttacgccggccggtcccctacggacgggggttcccctaggacccgtattccgtcgtcggcccttacgaagttccgcggacccaccctcgaccgtcccctccccgtgggacccctagtcgtacgggtcggggtacccgttccccggggtacccggaaggtacgtacggtaccgtcctttaagggttactttaacgtttaccgttaggttaggttaacgtacgggtaagggtttacggggtaacgtacgggaaccgtacggtcccggttaggtaacggttcgtcgtttaagttcgggttacgttaaccgggtaacgttacggggaaccgttacgtccgtacccgttacgttcgttcaaccgacccgaaccggccccacccgttactcgttcctccg

SEQ ID NO: 325196 - DNA, 631 bp, Homo sapiens
  misc_feature: GZ8MTXP01AT0WJ.10.36.D03.1.454.CMB.2.raw
  modified_base (193)..(193): a, c, t, g, unknown or other
  misc_feature (193)..(193): n is a, c, g, or t
  modified_base (240)..(240): a, c, t, g, unknown or other
  misc_feature (240)..(240): n is a, c, g, or t
  modified_base (263)..(263): a, c, t, g, unknown or other
  misc_feature (263)..(263): n is a, c, g, or t
  modified_base (292)..(292): a, c, t, g, unknown or other
  misc_feature (292)..(292): n is a, c, g, or t
  modified_base (301)..(301): a, c, t, g, unknown or other
  misc_feature (301)..(301): n is a, c, g, or t
tcagcatagtagtgcacgaccggtgctcgatttagctgcgtcacgatctctcttggggagagaagacaggattcaggacaatctccagcatggccggcttccctctcctcctcaccctcctcactcactgtgcagggtcctgggcccagtctgtgctgactcacgcccacctcagcgtcgtcgggaccccggnagaggtcacatctcttgttctggaagcagctacaagtcgtacggganagataagtgtcgtactggtaccngcacggtccaaggaccgaccccaatcctnatctataanttacgcggccgcctagacgggtcctagaccgtattcgctcggcctacgaagtctcggaaccactcacgtccctcccgtcggctagtcgtacggtcgggtccgtaccgggtcggaggtacgtacggaccgtcgttagtacgtttacgtacgttggtacgtagacgtaggtgggtatacggacgacgtcgtagtacggtgttaccttggttcgttccggttaaacggaacggtttcgggaaacccggacggttaccgtacccgggttaccttcggttaccgaaccggacccaaccgggtaccccaacccgttcgttaacccgcttaaccccg

SEQ ID NO: 325197 - DNA, 519 bp, Homo sapiens
  misc_feature: GZ8MTXP02J3IAH.10.36.D03.1.454.CMB.2.raw
  modified_base (191)..(191): a, c, t, g, unknown or other
  misc_feature (191)..(191): n is a, c, g, or t
  modified_base (238)..(238): a, c, t, g, unknown or other
  misc_feature (238)..(238): n is a, c, g, or t
  modified_base (322)..(322): a, c, t, g, unknown or other
  misc_feature (322)..(322): n is a, c, g, or t
  modified_base (365)..(365): a, c, t, g, unknown or other
  misc_feature (365)..(365): n is a, c, g, or t
  modified_base (450)..(450): a, c, t, g, unknown or other
  misc_feature (450)..(450): n is a, c, g, or t
  modified_base (491)..(491): a, c, t, g, unknown or other
  misc_feature (491)..(491): n is a, c, g, or t
tcagcatagtagtgcacgaccggtgctcgatttagctgcgtcacggatctctcttggggagagaagacaggattcaggacaatctccagcatggccggcttccctctcctcctcaccctcctcactcactgtgcagggtcctgggcccagtctgtgctgactcagccaccctcagcgtctgggaccccggnaggagggtcaccatctcttgttctggaagcagctccaatgtcggganagataagtgtgtactggtaccagcaggtcccaggaccgccccaaatcctcatctatacgatagtcggcgccctgaggggtcccngaccgattctctggctccaagtctggccacctcagccctccgnggccatcagtcgggcctcccggccgagggactgacggctgtattattactgtgtagcagtgggatgacagccgtgacgtgcttanggtcttcggaactgggaccaaggtccacgtccgtaacgtcncgacccacggccaacccgctcgtcaccg

SEQ ID NO: 325198 - DNA, 519 bp, Homo sapiens
  misc_feature: GZ8MTXP02HJAZT.10.36.D03.1.454.CMB.2.raw
  modified_base (287)..(287): a, c, t, g, unknown or other
  misc_feature (287)..(287): n is a, c, g, or t
  modified_base (293)..(293): a, c, t, g, unknown or other
  misc_feature (293)..(293): n is a, c, g, or t
  modified_base (302)..(302): a, c, t, g, unknown or other
  misc_feature (302)..(302): n is a, c, g, or t
tcagcatagtagtgcacgaccggtgctcgatttagctgcgtcacgatctctcttggggagagaagacaggattcaggacaatctccagcatggccggcttccctctcctcctcaccctcctcactcactgtgcagggtcctgggcccagtctgtgctgactcagccaccctcagcgtctgggacccccggcagagggtcaccatctcttgttctggaagcagctccaatgtcgggagagataatgtgtactggtaccagcaggtcccaggaaccgccccaaatcctnatctanaacgattancggcgccctcgaggggtccctgaccgattctctcggctccaagtcctggccacctcacgccctccctggcctatcgagtggctccggtccgaggatgacgctgattatactgtgtagcagtggatgacagcctgagtgcttagtgtcgttacggaacttgggaccaagggtccaccgtcctacgtcaacgcccaacggcccaacccgactcgtcacc

SEQ ID NO: 325199 - DNA, 563 bp, Homo sapiens
  misc_feature: GZ8MTXP02H2J7L.10.36.D03.1.454.CMB.2.raw
  modified_base (246)..(246): a, c, t, g, unknown or other
  misc_feature (246)..(246): n is a, c, g, or t
  modified_base (296)..(296): a, c, t, g, unknown or other
  misc_feature (296)..(296): n is a, c, g, or t
  modified_base (551)..(551): a, c, t, g, unknown or other
  misc_feature (551)..(551): n is a, c, g, or t
tcagcatagtagtgcacgaccggtgctcgatttagctgcgtcacgatctctcttggggagagaagacaggattcaggacaatctccagcatggccggcttccctctcctcctccaccctcctcactcactgtgcagggtcctgggcccagtctgtgctgactcagcccaccctcagccgtcgtcggggaccccccgggcaggagggtcaccatctcttgttctggaagcagctccaatgtcggganagataatgtgtactggaccagcaggtcccaggaaccgcccccaaatcctnatctaataacgattagcggcgccctcgacggggtccctgacccgtattcctcgtcggcctaccgaagtcctaggccacctcacgccctcccgtgcccatccaggtcggctcccggtccgagatgacgctgtattattactgtacgtagctaagtgggatggacagcctagagtgtcttagtcgttcgttacggaacgttggggaacctaaagggtcctaccggtccttaacgcaacgcccaacggcccaaacccncgtcgtactacc

SEQ ID NO: 325200 - DNA, 588 bp, Homo sapiens
  misc_feature: GZ8MTXP02HM8HB.10.36.D03.1.454.CMB.2.raw
  modified_base (308)..(308): a, c, t, g, unknown or other
  misc_feature (308)..(308): n is a, c, g, or t
tcagcatagtagtgcacgaccggtgctcgatttagctgcgtcacgatctctcttggggagagaagacaggattcaggacaatctccagcatggccggcttccctctcctcctcaccctcctcactcactgtgcagggtcctgggcccagtctgtgctgactcagcccaccctcagcgtctcgggacccccgggcagagggtcaccatctcttgttctggaagcagctccaatggtcgggagagataatgtgtactggtaccagcaggtcccaggaaccgcccccaaatcctcatctaataacgattancggcgccctgacggggtccctgaccgtattctctcggcctccaagtctggccacctcacgtccctcccgtggcccagtccgaggtcgggtcctcccggtaccggaggatcgaccgtctggtatttattacgtggttagtagctagttgggaatggacagtccgtagagtgactttagtcgttccgttacgggaacgtgggaacccgtaaagggtccctaacccggtcctaaccgtcgaaccgacccgaaacggccccaaacccctacgtcgtacctaccg

SEQ ID NO: 325201 - DNA, 547 bp, Homo sapiens
  misc_feature: GZ8MTXP02IL76Q.10.36.D03.1.454.CMB.2.raw
  modified_base (193)..(193): a, c, t, g, unknown or other
  misc_feature (193)..(193): n is a, c, g, or t
  modified_base (455)..(455): a, c, t, g, unknown or other
  misc_feature (455)..(455): n is a, c, g, or t
tcagcatagtagtgcacgaccggtgctcgatttagctgcgtcacgatctctcttggggagagaagacaggattcaggacaatctccagcatggccggcttccctctcctcctcacccctcctcactcactgtgcagggtcctgggcccagtctgtgctgactcagccaccctcagcgtctgggacccccgggnagagggtcaccatctcttgttctggaagcagctccaatgtcgggagagataatgtgtaactggtaccagcaggtcccaggaaccggcccccaaactccctacactctaataacgattactcggcggcccctcgacggggtccctgaccgtattctctcggctccaagtctggccacctcgagccctcccgtgcccatcgacgtgggcctcccggtcgaggtgtcgacgctagattattactgtagtagcgagtggatgaacngcctagagtgcttatcgtcttacggacgtcggactaaaggtcctaccgtcctacgtcaacgacccgaacggacccaacccactacgactacc

SEQ ID NO: 325202 - DNA, 612 bp, Homo sapiens
  misc_feature: GZ8MTXP02H3M76.10.36.D03.1.454.CMB.2.raw
  modified_base (195)..(195): a, c, t, g, unknown or other
  misc_feature (195)..(195): n is a, c, g, or t
tcagcatagtagtgcacgaccggtgctcgatttagctgcgtcacgatctctcttggggagagaagacaggattcaggacaatctccagcatggccggcttccctctcctcctcaccctcctcactcactgtgcagggtcctgggcccagtctgtgctgactcagcccaccctcagcgtcgtcgggacccccgggnaggagggtcaccatctcttgttctggaagcagctccaatggtcgggagagataatgtgtactggtaccagcacggtcccaggaacccggcccccaaactccctacatctaataacgattagcggcggccctcgacggggtccctgaccgtacttctcgtcggcctaccgaagtccgtggcctaccctcgaccgtcccctccccgtcggccctatccgtacggtcggggcctcccgggtccggaggtactcggacgtcgtgtaattacttacgtgtagtagctaggtgggatcgactacgccgtggagtgtcttagtcgtacgttacgggaacgttggggaaccctaagggtccctaccgttcctaacgtccgaaccgtccccgaaacggccccaaaccccgtacgtcgtacctaccg

SEQ ID NO: 325203 - DNA, 672 bp, Homo sapiens
  misc_feature: GZ8MTXP02IQLSJ.10.36.D03.1.454.CMB.2.raw
tcagcatagtagtgcacgaccggtgctcgatttagctgcgtcacgatctctcttggggagagaagacaggattcaggacaatctccagcatggccggcttccctctcctcctcaccctcttcactcactgtgcagggtcctgggcccagtctgtgctgactcagcccaccctcagcgtctcgggacccccggcagagggtcaccatctcttgttctggaagcagctccaatggtcggagagataatgtgtactggtaccagcaggtcccaggaaccggacccccaaactcctacatctaataacgattactcggcgccctcgacggggtccctgaccgtattctcgtcggcctaccagtcctggcctacctcacgcccctcccgtcggccctatcgaggtcgggccgtcccggtaccgaggtacgtcgacgtcttagtaatttacgttacgtgttgtacgtacgtaggttaggggattaggaaccaggtcccgttaggtacggttacgttaccgtttaagtcggtttacccggtttaacggggaaacgttaccgggggtaaaccctaaaacgggttcccgtaaccccggttaccgttaaccggtccgtaacccggacccccgtaaaacgggtaccccccaaaacccctaccgttaccggttaccctaacccg

SEQ ID NO: 325204 - DNA, 696 bp, Homo sapiens
  misc_feature: GZ8MTXP02HSEB5.10.36.D03.1.454.CMB.2.raw
  modified_base (237)..(237): a, c, t, g, unknown or other
  misc_feature (237)..(237): n is a, c, g, or t
tcagcatagtagtgcacgaccggtgctcgatttagctgcgtcacgatctctcttggggagagaagacaggattcaggacaatctccagcatggccggcttccctctcctcctcaccctcctcactcactgtgcagggtcctgggcccagtctgtgctgactcagccaccctcagcgtctcgggacccccgggcagagggtcaccatctcttgtctggaagcagctcaatgtcggganagataatgtgtactggtaccagcacggtcccaggaaccgcccccaaatcctcatctaataacgattagtccggccgccctgacggggtccctgaccgtattctctcggcctaccgtaagtcctggcctacctcgacgtcccctcccgtcgggacccaagtccgacgggtcggggcccttcccggggtacccggaagggtacttcggaccgtccgtttaggtaacttttaacgtttaccgttggttaggttaacggccgttaaagggttgggggtaattcgggaaccgtacggtccgttagggtaacggttcggtactttagtcggtttaccgttacggggtaaaaccgttcgggggaaaccctaaacggggttccctaaccccgggttacccttaccggacgaaacccggaccccgaaacggacccccaaaacccctaccgttcggttaccctaacccg

SEQ ID NO: 325205 - DNA, 574 bp, Homo sapiens
  misc_feature: GZ8MTXP02FYQK9.10.36.D03.1.454.CMB.2.raw
  modified_base (192)..(192): a, c, t, g, unknown or other
  misc_feature (192)..(192): n is a, c, g, or t
tcagcatagtagtgcacgaccggtgctcgatttagctgcgtcacgatctctcttggggagagaagacaggattcaggacaatctccagcatggccggcttccctctcctcctcaccctcctcactcactgtgcagggtcctgggcccagtctgtgctgactcagccaccctcagcgtctgggacccccgggnagagggtcaccatctcttgttctggaagcagctccaatggtcgggagagataatgtgtactggtaccagcaggtcccaggaaccgcccccaaactcctcatctaataaacgatttactcggccggccctcgacggggtccctagaccgtatttcctctcggacctccaagtctaggccacctcacgccctccctggccagtccaggtcggcctcccggtccgaggactgacgctgattattactgtagtagctagtgggatcggacacgcctagagtgcttagtcgttcgttacggaactggggaaccaaaggttccgaaccgttccgtacgtccgaacgaccccgaaacgggtaccccaaccccgtactacgtcctaaccg

SEQ ID NO: 325206 - DNA, 654 bp, Homo sapiens
  misc_feature: GZ8MTXP02GRCGE.10.36.D03.1.454.CMB.2.raw
  modified_base (192)..(192): a, c, t, g, unknown or other
  misc_feature (192)..(192): n is a, c, g, or t
  modified_base (220)..(220): a, c, t, g, unknown or other
  misc_feature (220)..(220): n is a, c, g, or t
  modified_base (238)..(238): a, c, t, g, unknown or other
  misc_feature (238)..(238): n is a, c, g, or t
  modified_base (438)..(438): a, c, t, g, unknown or other
  misc_feature (438)..(438): n is a, c, g, or t
tcagcatagtagtgcacgaccggtgctcgatttagctgcgtcacgatctctcttggggagagaagacaggattcaggacaatctccagcatggccggcttccctctcctcctcaccctcctcactcactgtgcagggtcctgggcccagtctgtgctgactcagccaccctcagcgtctcgggacccccggnagagggtcaccatctcttgttctggaancagctccaatggtcgganagataatgtgtactggtaccagcacggtcccaggaacccggacccccaaactccctacactctaataaccgatttacgccgggcggtcccctcggacggggtcccctacggaccgtattcctcgtcggcctccgtaagtccgtggcctacctcacggtccctcccgtggcccaagtccgagtcggccgtccggtcgaggntcgacgcttgaactttatacgtgttagtagactggtacgggattcgggacacggtcccgtggtaagttcgtaccgtttagttcggtaccgtttacgggaacgttcggggaaacctaaacgggttcccgaacccgttcccgtaacggtacccgtaaccggacccccgtaaacgggtacccccaaaacccccgtacgttcccggtaccttaacccccg

SEQ ID NO: 325207 - DNA, 726 bp, Homo sapiens
  misc_feature: GZ8MTXP02FORHH.10.36.D03.1.454.CMB.2.raw
  modified_base (221)..(221): a, c, t, g, unknown or other
  misc_feature (221)..(221): n is a, c, g, or t
tcagcatagtagtgcacgaccggtgctcgatttagctgcgtcacgatctctcttggggagagaagacaggattcaggacaatctccagcatggccggcttccctctcctcctcaccctcctcactcactgtgcagggtcctgggcccagtctgtgctgactcagccaccctcagcgtcgtcgggaccccccggagagggtcaccatctcttgttctggaancagctcaagtggtcggagagtataagtgtagtacgtggtaccagcgacggtcccaaggaaccccggacccccaaactcctacatctaataacgattacgcggccgccctacggacgggtccctagaccgtattctcgtcggcctaccgaagtctcggcctacgtcacgcccctccgtcgacctacgtcgacggtcggacccttcccggggtcgaagggtacttcggaccgcgttaggtaactttacgttaacgtggtttagtaacgtcgtaagggttggggtattaccgggaaacgtaccggtccgttagggtaaggtttcgttaccgttttaaggttcggtttaccgtttaaaccggggtaaaccggttacggggggaaacccttaaacgggggttaccctaacccccggttaccgttaaccggtacccgaaacccggtacccccggtaaaaccggaaccccccctaaaccccggttaactcccggttaaccctttaacccccg

SEQ ID NO: 325208 - DNA, 630 bp, Homo sapiens
  misc_feature: GZ8MTXP02JXHC7.10.36.D03.1.454.CMB.2.raw
  modified_base (193)..(193): a, c, t, g, unknown or other
  misc_feature (193)..(193): n is a, c, g, or t
  modified_base (472)..(472): a, c, t, g, unknown or other
  misc_feature (472)..(472): n is a, c, g, or t
tcagcatagtagtgcacgaccggtgctcgatttagctgcgtcacgatctctcttggggagagaagacaggattcaggacaatctccagcatggccggcttccctctcctcctcaccctcctcactcactgtgcagggtcctgggcccagtctgtgctgactcagccaccctcagcgtctcgggacccccgggnaggagggtcaccatctcttgttctggaagcagctccaatggtcgggagagataatgtgtactggtaccagcgacggtcccaaggaaccggacccccaaactcctcaatctaataacgtattacgtcggccggcccctcggacggggtccctaggaccgtattccgtacgtcggcctaccaaggttcctggcccacctcacgtccctcccgtggcctatccgagggtcgggccgttcccgggtcgaggtactcggacgtcctaggtaactttatttacgnggttcgtaagcgtacggtgggtaatcggacgacgtccgtagtagtgtacgtttagtcgtcgtttacgggacgttacgggaacctaacggtcctaccggtccttaaccggcgaacccgacccgaaccggaccccaacccctcgttaccgaccttacccg

SEQ ID NO: 325209 - DNA, 698 bp, Homo sapiens
  misc_feature: GZ8MTXP02FYXGL.10.36.D03.1.454.CMB.2.raw
  modified_base (199)..(199): a, c, t, g, unknown or other
  misc_feature (199)..(199): n is a, c, g, or t
tcagcatagtagtgcacgaccggtgctcgatttagctgcgtcacgatctctcttggggagagaagacaggattcaggacaatctccagcatggccggcttccctctcctcctccaccctcctcactcactgtgcagggtcctgggcccagtctgtgctgactcacgcccaccctcagccgtcgtcggggaccccccggnaggacgggtccaccatctcttgttctggaagcagcctccaagtggcggagagataatgtgtacgtggtaccagcgacggtcccgaacggaacccgacccccaaactccacatactaataaccgtattacgcggccggccctacggaccggggtccctcgaccgtattccgtcgtccgtacctaccgaagtcgtcggacctacctcgaccgtccctccgtcgaccctagtccgtacgggtcgggacccttcccgggtaccggaaggtactacggaccgtcgttacggtaatttaacgttacgttgggttacgtaacgtcgtaaaggttggggaacttacgggaactaccggtaccgtagggttacgtcggttaacctttagtttcgggtaccgtttaacgggaacgttcggggaaaccaaccgggttacctaccccggtacgtacccgtaccgaaccgccccgaaaaccggtacccccaaacccgtctccgtacctaccg

SEQ ID NO: 325210 - DNA, 633 bp, Homo sapiens
  misc_feature: GZ8MTXP02HL3WJ.10.36.D03.1.454.CMB.2.raw
  modified_base (173)..(173): a, c, t, g, unknown or other
  misc_feature (173)..(173): n is a, c, g, or t
  modified_base (194)..(194): a, c, t, g, unknown or other
  misc_feature (194)..(194): n is a, c, g, or t
  modified_base (300)..(300): a, c, t, g, unknown or other
  misc_feature (300)..(300): n is a, c, g, or t
  modified_base (340)..(340): a, c, t, g, unknown or other
  misc_feature (340)..(340): n is a, c, g, or t
tcagcatagtagtgcacgaccggtgctcgatttagctgcgtcacgatctctcttggggagagaagacaggattcaggacaatctccagcatggccggcttccctctcctcctccaccctcctcactcactgtgcagggtcctgggcccagtctgtgctgactcagccaccctnagcgtctcggggacccccggnaggacggtcaccatctcttgttctggaagcagcctccaatggtcggagagataatgtgtactggtaccagcacggtcccaaggaacccgcccccaaaagtccctanatctaataacgtattagtcggccgccctgacggggtcccngaccgtatctcgcggcctaccgagtctggccacctcacgccctcccgtcgccagtccagggtcgggcctcccgggtacgaggacgtgaccgtcgtagtaacttattacgtgtagttagctaggttgggaatcgaacgcggcctaggtagtcgtacttagtcggttacgttacgggtaaacgtcggggaaacctaaacggggtccttacccggtacccttaacggtaccaaccggaacccccgtaaaaccgggtacccccaaaacccccggtacttcgtttaacccccgtaccg

SEQ ID NO: 325211 - DNA, 864 bp, Homo sapiens
  misc_feature: GZ8MTXP02JUQLB.10.36.D03.1.454.CMB.2.raw
  modified_base (193)..(193): a, c, t, g, unknown or other
  misc_feature (193)..(193): n is a, c, g, or t
tcagcatagtagtgcacgaccggtgctcgatttagctgcgtcacgatctctcttggggagagaagacaggattcaggacaatctccagcatggccggcttccctctcctcctcaccctcttcactcactgtgcagggtcctgggcccagtctgtgctgactcagccaccctcagcgtcgtcgggacccccggnagaggtcaccatctcttgtctggaagcagctcaagtggtcgggagagataagtgtagtacgtggtaccagccgtacggtaccccgacggaaccccggaccccctaaactcccgtactacttacttaacgtaaacgtactttaaccgtccgggaccggtacccccgtacggtaaccgggggttcccctacggtaaaccccggttactttcccgttaccgtccgggtaccctacccgtaacgttccgttacgggaccctaaccgtccgaccgtccccttccccgtacgggaccctagtaccgtacggggttccggggcccggtttacccggtacccggaaggggtaccttcgggaacccggttagttacggttaaacttttaacggttaccgtgggttaaacggtacgtaccggtacggggttaagggtaacttccgggaaaaccgtaccgggtacccgttggggtaaaccgggttttacgttaccggttttacggttacccgggtttacccgggtttaaaccggggtaaaaccgggttacccggggtaaaacccggttaacccggggttaccccgttaaccccgggttacccgtaaccggtaacccggaacccggtaaaccccggtaaacccggtaccccctaaacccggtccgttaccgtacccgtacccg

SEQ ID NO: 325212 - DNA, 688 bp, Homo sapiens
  misc_feature: GZ8MTXP02GBLQT.10.36.D03.1.454.CMB.2.raw
  modified_base (307)..(307): a, c, t, g, unknown or other
  misc_feature (307)..(307): n is a, c, g, or t
tcagcatagtagtgcacgaccggtgctcgatttagctgcgtcacgatctctcttggggagagaagacaggattcaggacaatctccagcatggccggcttccctctcctcctccaccctcctcactcactgtgcagggtcctgggcccagtctgtgctgactcagcccaccctcagccgtcgtcgggaccccccgggcaggagggtccaccatccttctttgttctaggaacgcagctccaatggtcgggagagatatgtgtactggtacagcgacggtcccaaggaccccggcccccaaactcccnaactctaataacgtattacgcggtccgccctcgacggggtcctcgaccgtattcctcgtcggtacctaccgaagtccgtcggaccctaccttccgacgtcccccttcccgtaggtccccaagtccggtacgggttcgggggcccgtttcccggggacccggaacggggtacttacgggaccgtccgttagttaacgtttacgttacgtcggttagtacgacgttaggtttaggggattacgggaacaccggtcgttaggtagtcgttacgttagttccgttacgttaacggaacgttaggggacctaaaacgggttcctaaacccgtccgtaccggtacaaccggtaccgaaccgtaccccaacctacgttcgccctaccg

SEQ ID NO: 325213 - DNA, 584 bp, Homo sapiens
  misc_feature: GZ8MTXP02I4URV.10.36.D03.1.454.CMB.2.raw
  modified_base (221)..(221): a, c, t, g, unknown or other
  misc_feature (221)..(221): n is a, c, g, or t
  modified_base (339)..(339): a, c, t, g, unknown or other
  misc_feature (339)..(339): n is a, c, g, or t
  modified_base (427)..(427): a, c, t, g, unknown or other
  misc_feature (427)..(427): n is a, c, g, or t
  modified_base (453)..(453): a, c, t, g, unknown or other
  misc_feature (453)..(453): n is a, c, g, or t
tcagcatagtagtgcacgaccggtgctcgatttagctgcgtcacgatctctcttggggagagaagacaggattcaggacaatctccagcatggccggcttccctctcctcctcaccctcctcactcactgtgcagggtcctgggcccagtctgtgctgactcagccaccctcagcgtctcgggacccccgggcagagggtcaccatctcttgttctggaancagctaccaatgtcggagagataatgtgtactggtaccagcacggtcccaaggaaccggcccccaaactccctacatctataacgattatcggcgcctcgacggggtccctgaccgtntcgtctcggtctccaagtctcggccacctcacgcctcctggcccatccagtcgggctcccggtcgaggactgacgctgtattattacngttagtagctagtgggactggaaccncgtcgtagtagtcgtgttagtcgttacgttacggacggtacgggaccgtaacggtacccgtaccgttaccgtaaccgtaccgaaccggaccccgaacggaccccctaacccgtacgttaccgtacctaccg

SEQ ID NO: 325214 - DNA, 795 bp, Homo sapiens
  misc_feature: GZ8MTXP02FIZDS.10.36.D03.1.454.CMB.2.raw
  modified_base (192)..(192): a, c, t, g, unknown or other
  misc_feature (192)..(192): n is a, c, g, or t
  modified_base (214)..(214): a, c, t, g, unknown or other
  misc_feature (214)..(214): n is a, c, g, or t
  modified_base (219)..(219): a, c, t, g, unknown or other
  misc_feature (219)..(219): n is a, c, g, or t
  modified_base (348)..(348): a, c, t, g, unknown or other
  misc_feature (348)..(348): n is a, c, g, or t
tcagcatagtagtgcacgaccggtgctcgatttagctgcgtcacgatctctcttggggagagaagacaggattcaggacaatctccagcatggccggcttccctctcctcctcaccctcctcactcactgtgcagggtcctgggccagtctgtgctgactcagccaccctcagcgtctcggggacccccggnaggaggtccacatctcttgtcnggaancagctcaagtggtcggagagataagtgtcgtactcggtaccagtccgacgggtacccaaggtaaccggccaaccccgtaaaacgtcctacaattactaaacgtaacgtatacgtccgggaccgtacccncggtacggggtccctaggacctactttcgtacccgtcgggtcccttaaccgtaaggtccgttcggacccttacccgtcgtaacccggtccccgttaccccgtacggggtaccctaacggttacccgtaaacggggttccgggtaccccggtttacccggggtacccggtaacggggtactttaaccgggaccggtaccgtttaacgggttaactttaaacgtttaccggttaggttaccggtaagtacccgtaaggtacgggtaacgtaggtaaccctacgggtcctagggttacgtcgggtacctttaaagtccggtttaaggttaaacggtaccggtacggggtaaacctaacgggttacccgtaacccggtaccgttaaccggaaccgaaccgttaaccccggaaacccggttccccaaaacccgtccgttacgttaacccccg

SEQ ID NO: 325215 - DNA, 694 bp, Homo sapiens
  misc_feature: GZ8MTXP02FUK8E.10.36.D03.1.454.CMB.2.raw
  modified_base (240)..(240): a, c, t, g, unknown or other
  misc_feature (240)..(240): n is a, c, g, or t
  modified_base (293)..(293): a, c, t, g, unknown or other
  misc_feature (293)..(293): n is a, c, g, or t
tcagcatagtagtgcacgaccggtgctcgatttagctgcgtcacgatctctcttggggagagaagacaggattcaggacaatctccagcatggccggcttccctctcctcctcaccctcctcactcactgtgcagggtcctgggcccagtctgtgctgactcagccaccctcagcgtcgtcgggaccccccggagagggtccaccatctcttgtctggaagcagctccaatggtcggganagataagtgtgtacgtggtaccagcaggtcccaggaaccggcccccaaactcnctactctaataacgtattacgtccggccggtccctacgaccggggttccctacggaccgtattcctcgttaccgggtccctaccgaagttccgtcggacccctacccgttccgacgtcccccgttcccgtcgggtacccaagtcccggaagggttcccggggtccgttccccgggtacggaacgggtactaaccgggtacgtcgttacgtaacgttttacgttacgttcgttaggttacgacgtagggtacggtagtacgacgtacgcgttaggacgttgtacgtttagtcgttacgttacggaacggtacgggtaaccgtaacgggtacctacccggtccgtacgtaccgaaccggtacccgaaaaccgcccccgaaacccgtctacgtacctttacccg

SEQ ID NO: 325216 - DNA, 651 bp, Homo sapiens
  misc_feature: GZ8MTXP02GNKJJ.10.36.D03.1.454.CMB.2.raw
  modified_base (190)..(190): a, c, t, g, unknown or other
  misc_feature (190)..(190): n is a, c, g, or t
  modified_base (212)..(212): a, c, t, g, unknown or other
  misc_feature (212)..(212): n is a, c, g, or t
  modified_base (232)..(232): a, c, t, g, unknown or other
  misc_feature (232)..(232): n is a, c, g, or t
  modified_base (368)..(368): a, c, t, g, unknown or other
  misc_feature (368)..(368): n is a, c, g, or t
  modified_base (486)..(486): a, c, t, g, unknown or other
  misc_feature (486)..(486): n is a, c, g, or t
  modified_base (528)..(528): a, c, t, g, unknown or other
  misc_feature (528)..(528): n is a, c, g, or t
tcagcatagtagtgcacgaccggtgctcgatttagctgcgtcacgatctctcttggggagagaagacaggattcaggacaatctccagcatggccggcttccctctcctcctcaccctcctcactcactgtgcagggtcctgggcccagtctgtgctgactcagccaccctcagcgtctggaccccgggnagaggtcaccatctcttgttcngaagcagctccatgtcgganagataagtgtggtacctggtaccaggcacggtaccccgacggaaccggacccccctaaactcctcattcctaataacggacttcgtcgggtccggaccccttcggtaacggggtccctaggacctaacttcgttcncccggtcctacgtacgtcgtcgaccgactcccgactccctccccgttgacctacgtcgacggtcggaccggtcccgttcgggacgtcgtagcggtcttcgaatttagtcgtacggttnaggttcaaacgtggggtcaagggtcacgacgtcggttaacgngttaccgttagtcgttctaacgggtccgttagggaaacccgtaggttaccgacccgttaccgtacccttacgaaaccgttcccggaacggtaaacccccgcccaaaccttcgtacccgtaccc

SEQ ID NO: 325217 - DNA, 631 bp, Homo sapiens
  misc_feature: GZ8MTXP02GQV46.10.36.D03.1.454.CMB.2.raw
  modified_base (172)..(172): a, c, t, g, unknown or other
  misc_feature (172)..(172): n is a, c, g, or t
  modified_base (196)..(196): a, c, t, g, unknown or other
  misc_feature (196)..(196): n is a, c, g, or t
  modified_base (268)..(268): a, c, t, g, unknown or other
  misc_feature (268)..(268): n is a, c, g, or t
  modified_base (322)..(322): a, c, t, g, unknown or other
  misc_feature (322)..(322): n is a, c, g, or t
  modified_base (380)..(380): a, c, t, g, unknown or other
  misc_feature (380)..(380): n is a, c, g, or t
  modified_base (516)..(516): a, c, t, g, unknown or other
  misc_feature (516)..(516): n is a, c, g, or t
  modified_base (541)..(541): a, c, t, g, unknown or other
  misc_feature (541)..(541): n is a, c, g, or t
tcagcatagtagtgcacgaccggtgctcgatttagctgcgtcacgatctctcttggggagagaagacaggattcaggacaatctccagcatggccggcttccctctcctcctcaccctcctcactcactgtgcagggtcctgggcccagtctgtgctgactcagccaccctnagccgtactcgggaccccccgggnaggacgggtcaccgatcgtctttggttcctgggaagcaggtcctaccaaagttcgtacgggagagattaagngttcgacgtagtacctagcgaggtaccccaggtaacccgccccaaactccgtanactactaataacgtacttagcggaccgtccctacgacgggtcctgaaccgtatctcgngtcctacgtagtcgtacggccaccttcgaactcccgttaccgtcggaccctatccgaacggtccgggtcttacccgggacgtaacgggattcggacgtacgtctaagttacttacgtggtactggataacgtgggntacgcgagtccaggtacgtacgttnttacgtagtccgtaaggtaacggaggtaccgacgtaccgtaccgtcctaacgactaacgacccgaacgcccaaccgtcgtacgtactccg

SEQ ID NO: 325218 - DNA, 415 bp, Homo sapiens
  misc_feature: GZ8MTXP01C9JY9.11.61.F06.1.454.CMB.2.raw
  modified_base (411)..(415): a, c, t, g, unknown or other
  misc_feature (411)..(415): n is a, c, g, or t
tcagcgagagataccacgaccggtgctcgatttagctacgctctaagggaagggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagaggtggctggtcgcatggatttgatctctggggccaggggacaatggtaaccgtctcttcagcctccaccaaggcccatcggtcttccccctggccgccctgctccaggagcacctccgagagcaccagcggccctgggctgcctggtcaaggctactccgtatctctcgctgagcgggctggcaaggcgcatagnnnnn

SEQ ID NO: 325219 - DNA, 416 bp, Homo sapiens
  misc_feature: GZ8MTXP01C717S.11.61.F06.1.454.CMB.2.raw
  modified_base (411)..(416): a, c, t, g, unknown or other
  misc_feature (411)..(416): n is a, c, g, or t
tcagcgagagataccacgaccggtgctcgatttagctacgctctaagggaagggctggtgtgggtctcacgtattgacaatgatgggagtgacacaatccacgcggattctgtgaggggccgattcaccacttcgagagacaacgcaaagaacacggtatatctgcaaatgaacagtctgagaggcgaagacacggctgtttacttctgtgcaagaggtggctggtcgcatggatttgatctctggggccaggggacaatggtaaccgtctcttcagcctccaccaagggcccatcggtcttccccctggcgccctgctccaggagcacctccgagagcaccagcggccctgggctgcctggtcaagggctactccgatctctcgctgagcgggctggcaaggcgcatagnnnnnn

SEQ ID NO: 325220 - DNA, 419 bp, Homo sapiens
  misc_feature: GZ8MTXP01DEJ8D.11.61.F06.1.454.CMB.2.raw
  modified_base (338)..(338): a, c, t, g, unknown or other
  misc_feature (338)..(338): n is a, c, g, or t
  modified_base (415)..(419): a, c, t, g, unknown or other
  misc_feature (415)..(419): n is a, c, g, or t
tcagcgagagataccacgaccggtgctcgatttagctacgctctaagggaaagggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagaggtggctggtcgcatggatttgatctctggggccaggggacaatggtaaccgtctcttcagcctccaccaagggcccatcggtcttccccctggcgccctgctccaggagcacctccgagngcaccagcggccctgggctgcctggtcaagggactactccgtatctctcgctgagcgggctgggcaaggcgcatagnnnnn

SEQ ID NO: 325221 - DNA, 417 bp, Homo sapiens
  misc_feature: GZ8MTXP01ADXEI.11.61.F06.1.454.CMB.2.raw
  modified_base (416)..(417): a, c, t, g, unknown or other
  misc_feature (416)..(417): n is a, c, g, or t
tcagcgagagataccacgaccggtgctcgatttagctacgctctaagggaagggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagaggtggctggtcgcatggatttgatctctggggccaggggacaatggtaaccgtctcttcagcctccaccaaggcccatcggtcttccccctggcgccctgctccaggagcacctccgagagcaccagcggcccctggggctgccctggtcaagggactacttccgtatctctcgctgagcgggctggcagggcgcatagnn

SEQ ID NO: 325222 - DNA, 422 bp, Homo sapiens
  misc_feature: GZ8MTXP01BYT4O.11.61.F06.1.454.CMB.2.raw
  modified_base (417)..(422): a, c, t, g, unknown or other
  misc_feature (417)..(422): n is a, c, g, or t
tcagcgagagataccacgaccggtgctcgatttagctacgctctaagggaaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagaggtggctggtcgcatggatttgatctctgggggccagggggacaatggtaaccgtctcttcagcctccaccaagggcccatcggtcttccccctggcgccctgctccaggagcacctccgagagcaccagcggccctgggctgccctggtcaaggctacttccgtatctctcgctgagcgggctggcaaggcgcatagnnnnnn

SEQ ID NO: 325223 - DNA, 424 bp, Homo sapiens
  misc_feature: GZ8MTXP01CHV0F.11.61.F06.1.454.CMB.2.raw
  modified_base (414)..(414): a, c, t, g, unknown or other
  misc_feature (414)..(414): n is a, c, g, or t
  modified_base (420)..(424): a, c, t, g, unknown or other
  misc_feature (420)..(424): n is a, c, g, or t
tcagcgagagataccacgaccggtgctcgatttagctacgctctaagggaaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagaggtggctggtcgcatggatttgatctcgtggggccagggggacaatggtaaccgtctcttcagcctccaccaagggcccatcggtcttccccctggcgccctgctccaggacgcacctccgagagcaccagcggccctgggctgccctggtcaagggactactccgtatctctcgctgagcgggctggcaagggcncatagnnnnn

SEQ ID NO: 325224 - DNA, 421 bp, Homo sapiens
  misc_feature: GZ8MTXP01C37A1.11.61.F06.1.454.CMB.2.raw
  modified_base (414)..(421): a, c, t, g, unknown or other
  misc_feature (414)..(421): n is a, c, g, or t
tcagcgagagataccacgaccggtgctcgatttagctacgctctaagggaaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagaggtggctggtcgcatggatttgatctctgggggccaggggacaatggtaaccgtctcttcagcctccaccaagggcccatcggtcttcccctggccgccctgctccaggagcacctccgagacacacgcggcctgggctgccctggtcaaggctacttccgtatctctcgctgagcgggctggcaaggcgcatagnnnnnnnn

SEQ ID NO: 325225 - DNA, 444 bp, Homo sapiens
  misc_feature: GZ8MTXP01C9SWP.11.61.F06.1.454.CMB.2.raw
  modified_base (435)..(444): a, c, t, g, unknown or other
  misc_feature (435)..(444): n is a, c, g, or t
tcagcgagagataccacgaccggtgctcgatttagctacgctctaagggaaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttactctgtgcaagaggtggctggtcgcatggatttgatctcgtggggccaggggacaatggtaaccgtctcttcagcctccaccaagggccccatccggtccttccccctggccgcccctgcctccaggagccacctccgagacgccaccgagccggcccgtgggcctgccctgggtcaaagggacttactccgtatctctcgctggacgcgggctgggacaggcgcatagnnnnnnnnnn

SEQ ID NO: 325226 - DNA, 427 bp, Homo sapiens
  misc_feature: GZ8MTXP01D6Y0L.11.61.F06.1.454.CMB.2.raw
  modified_base (404)..(404): a, c, t, g, unknown or other
  misc_feature (404)..(404): n is a, c, g, or t
  modified_base (421)..(427): a, c, t, g, unknown or other
  misc_feature (421)..(427): n is a, c, g, or t
tcagcgagagataccacgaccggtgctcgatttagctacgctctaagggaaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagaggtggctggtcgcatggatttgatctctggggccagggggacaatggtaaccgtctctcagcctccaccaaggcccatcggtcttccccctggccgccctgctccaggacgcacctccgagacgcaccagcggccctgggctgccctggtcaaaggacctacttccgatctctcgctggagcgggntggcaagggcgcatagnnnnnnn

SEQ ID NO: 325227 - DNA, 419 bp, Homo sapiens
  misc_feature: GZ8MTXP01D2YB8.11.61.F06.1.454.CMB.2.raw
  modified_base (402)..(402): a, c, t, g, unknown or other
  misc_feature (402)..(402): n is a, c, g, or t
  modified_base (414)..(414): a, c, t, g, unknown or other
  misc_feature (414)..(414): n is a, c, g, or t
  modified_base (416)..(419): a, c, t, g, unknown or other
  misc_feature (416)..(419): n is a, c, g, or t
tcagcgagagataccacgaccggtgctcgatttagctacgctctaagggaaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagaggtggctggtcgcatggatttgatctctggggccagggggacaatggtaaccgtctcttcagcctccaccaagggccccatcggtcttccccctggcgccctgctccaggagcacctccgagagcacagcggccctgggctgcctggcaagggactacttccgtatctctcgctgagccgggtncgacgagcgcanannnn

SEQ ID NO: 325228 - DNA, 458 bp, Homo sapiens
  misc_feature: GZ8MTXP01BK7BA.11.61.F06.1.454.CMB.2.raw
  modified_base (449)..(458): a, c, t, g, unknown or other
  misc_feature (449)..(458): n is a, c, g, or t
tcagcgagagataccacgaccggtgctcgatttagctacgctctaagggaaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagaggtggctggtcgcatggatttgatctcgtggggccagggggacaagtggtaaccgtctcttcacgcctccaccaacgggccccatccggtccttcccccgtggccgcccctgcctccaggacgccacctccgagacgccaccaggccggcccgtggggcctcgccctgggtcaaagggtaccttacgttccgtatctctcgctggacgcgggctgggacaaggcgcatagnnnnnnnnnn

SEQ ID NO: 325229 - DNA, 427 bp, Homo sapiens
  misc_feature: GZ8MTXP01AS8JA.11.61.F06.1.454.CMB.2.raw
  modified_base (368)..(368): a, c, t, g, unknown or other
  misc_feature (368)..(368): n is a, c, g, or t
  modified_base (424)..(427): a, c, t, g, unknown or other
  misc_feature (424)..(427): n is a, c, g, or t
tcagcgagagataccacgaccggtgctcgatttagctacgctctaagggaaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagaggtggctggtcgcatggatttgatctctggggccagggggacaatggtaaccgtctcttcagcctccaccaagggcccatcggtcttcccccgtggcgccctgcctccaggagccacctccgagagcaccacgcggccctggggcctgcntgggtcaagggactacttccgtatctctcgctgagcgggctggcaaggcgcatagnnnn

SEQ ID NO: 325230 - DNA, 423 bp, Homo sapiens
  misc_feature: GZ8MTXP01BDRHC.11.61.F06.1.454.CMB.2.raw
  modified_base (231)..(231): a, c, t, g, unknown or other
  misc_feature (231)..(231): n is a, c, g, or t
  modified_base (316)..(316): a, c, t, g, unknown or other
  misc_feature (316)..(316): n is a, c, g, or t
  modified_base (417)..(423): a, c, t, g, unknown or other
  misc_feature (417)..(423): n is a, c, g, or t
tcagcgagagataccacgaccggtgctcgatttagctacgctctaagggaaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagaggtggctggtcgnatggatttgatctctggggccaggggacaatggtaaccgtctcttcagcctccaccaagggccccatccggtcttccccctggcnccctgctccaggagcacctccgagacgcaccagcggccctgggctgccctggtcaagggactacttccgtatctctcgctgagcgggctggcaaggcgcannnnnnn

SEQ ID NO: 325231 - DNA, 425 bp, Homo sapiens
  misc_feature: GZ8MTXP01BDWKN.11.61.F06.1.454.CMB.2.raw
  modified_base (316)..(316): a, c, t, g, unknown or other
  misc_feature (316)..(316): n is a, c, g, or t
  modified_base (421)..(425): a, c, t, g, unknown or other
  misc_feature (421)..(425): n is a, c, g, or t
tcagcgagagataccacgaccggtgctcgatttagctacgctctaagggaaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagaggtggctggtcgcatggatttgatctcgtggggccagggggacaatggtaaccgtctcttcagcctccaccaagggcccatcggtctccccctggccnccctgctccaggagcacctccgagagcaccagcggccctgggctgccctggtcaagggcctacttccgtatctctcgctgacgcgggctgggcaaggcgcatagnnnnn

SEQ ID NO: 325232 - DNA, 441 bp, Homo sapiens
  misc_feature: GZ8MTXP01APNHN.11.61.F06.1.454.CMB.2.raw
  modified_base (218)..(218): a, c, t, g, unknown or other
  misc_feature (218)..(218): n is a, c, g, or t
  modified_base (342)..(342): a, c, t, g, unknown or other
  misc_feature (342)..(342): n is a, c, g, or t
  modified_base (427)..(430): a, c, t, g, unknown or other
  misc_feature (427)..(430): n is a, c, g, or t
  modified_base (432)..(441): a, c, t, g, unknown or other
  misc_feature (432)..(441): n is a, c, g, or t
tcagcgagagataccacgaccggtgctcgatttagctacgctctaagggaaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagnggtggctggtcgcatggatttgatctcgtggggccagggggacaagtggtaacccgtctcttcacgcctccaccaagggccccagtccggtccttccccctggccgcccctgcctccgaggacnccacctccgagcgcaccagcgccctgggctgcctggcaaggctactccgtatctctcgctgacgcgggctggcaaggcgcatagnnnngnnnnnnnnnn

SEQ ID NO: 325233 - DNA, 433 bp, Homo sapiens
  misc_feature: GZ8MTXP01DCS1M.11.61.F06.1.454.CMB.2.raw
  modified_base (422)..(433): a, c, t, g, unknown or other
  misc_feature (422)..(433): n is a, c, g, or t
tcagcgagagataccacgaccggtgctcgatttagctacgctctaagggaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagaggtggctggtcgcatggatttgatctctgggggccaggggacaatggtaaccgtctcttcagcctccaccaaggcccatcggtcttccccctggccgccctgctccaggagcacctccgagacgcaccacgcggccctggggcctgccctggcaaagggcctacttccgtatcctctcgctgagcgggctggcaaggcgcatagnnnnnnnnnnnn

SEQ ID NO: 325234 - DNA, 423 bp, Homo sapiens
  misc_feature: GZ8MTXP01AEB6C.11.61.F06.1.454.CMB.2.raw
  modified_base (218)..(218): a, c, t, g, unknown or other
  misc_feature (218)..(218): n is a, c, g, or t
  modified_base (310)..(310): a, c, t, g, unknown or other
  misc_feature (310)..(310): n is a, c, g, or t
  modified_base (327)..(327): a, c, t, g, unknown or other
  misc_feature (327)..(327): n is a, c, g, or t
  modified_base (416)..(423): a, c, t, g, unknown or other
  misc_feature (416)..(423): n is a, c, g, or t
tcagcgagagataccacgaccggtgctcgatttagctacgctctaagggaaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagnggtgctggtcgcatggatttgatctcgtgggggccagggggacaatggtaacccgtctcttcagcctccaccaaggcccatcggtctccccngcgcctgctccaggacncacctccgagacgcaccagcggccctgggctgccctggtcaagggctacttccgtatctctcgctgagcgggctggacaggcgcatagnnnnnnnn

SEQ ID NO: 325235 - DNA, 431 bp, Homo sapiens
  misc_feature: GZ8MTXP01A9IMN.11.61.F06.1.454.CMB.2.raw
  modified_base (421)..(421): a, c, t, g, unknown or other
  misc_feature (421)..(421): n is a, c, g, or t
  modified_base (426)..(431): a, c, t, g, unknown or other
  misc_feature (426)..(431): n is a, c, g, or t
tcagcgagagataccacgaccggtgctcgatttagctacgctctaagggaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagaggtggctggtcgcatggatttgatctcgtggggccagggggacaatggtaaccgtctcttcagcctccaccaacgggcccagtccggtccttccccctggccgcccctgcctccaggacgccacctccgagcgcaccaggcggccctgggctgccctggcaagggactacttccgtatctctcgctgagcgggctggcaaggcncatgnnnnnn

SEQ ID NO: 325236 - DNA, 447 bp, Homo sapiens
  misc_feature: GZ8MTXP01CXBUE.11.61.F06.1.454.CMB.2.raw
  modified_base (433)..(437): a, c, t, g, unknown or other
  misc_feature (433)..(437): n is a, c, g, or t
  modified_base (439)..(447): a, c, t, g, unknown or other
  misc_feature (439)..(447): n is a, c, g, or t
tcagcgagagataccacgaccggtgctcgatttagctacgctctaagggaaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagaggtggctggtcgcatggatttgatctcgtgggggccagggggacaagtggtaaccgtctcttcagcctccaccaaggcccatcggtccttccccctggcccgcccctgctccgagggacgccacccccgagacgcacgacgccggcctgggcctgccctggtcaaaggtcctacttccgtatctctcgctgagcgggctgggcaaggcgcagagnnnnngnnnnnnnnn

SEQ ID NO: 325237 - DNA, 419 bp, Homo sapiens
  misc_feature: GZ8MTXP01AYYW6.11.61.F06.1.454.CMB.2.raw
  modified_base (313)..(313): a, c, t, g, unknown or other
  misc_feature (313)..(313): n is a, c, g, or t
  modified_base (326)..(326): a, c, t, g, unknown or other
  misc_feature (326)..(326): n is a, c, g, or t
  modified_base (335)..(335): a, c, t, g, unknown or other
  misc_feature (335)..(335): n is a, c, g, or t
  modified_base (341)..(341): a, c, t, g, unknown or other
  misc_feature (341)..(341): n is a, c, g, or t
  modified_base (380)..(380): a, c, t, g, unknown or other
  misc_feature (380)..(380): n is a, c, g, or t
  modified_base (392)..(392): a, c, t, g, unknown or other
  misc_feature (392)..(392): n is a, c, g, or t
  modified_base (409)..(419): a, c, t, g, unknown or other
  misc_feature (409)..(419): n is a, c, g, or t
tcagcgagagataccacgaccggtgctcgatttagctacgctctaagggaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagaggtggctggtcgcatggatttgatctcgtggggccagggggacaatggtaaccgtctcttcagcctccaccaaggcccagtcggtcttcccctgcnccctgctccaggncactcgagngcaccngcgcctgggctcgcctggcaagggctactccgtatctcncgctggagcggntggacaaggcgcagagnnnnnnnnnnn

SEQ ID NO: 325238 - DNA, 473 bp, Homo sapiens
  misc_feature: GZ8MTXP01EP36J.11.61.F06.1.454.CMB.2.raw
  modified_base (459)..(473): a, c, t, g, unknown or other
  misc_feature (459)..(473): n is a, c, g, or t
tcagcgagagataccacgaccggtgctcgatttagctacgctctaagggaaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagaggtgtctggtcgcatggatttgatctcgtggggccagggggacaagtggtaaccgtctcttcacgccctccaccaacgggccccatccggtccttccccctggccgcccctgcctccagggacgccacctccgagacgccaccgacggccggcccgtggggcctcgccctggtccaaagggtaccttaccgttccgtatcctcgtcgctggacggcgggcctggacaagggcgacagtagnnnnnnnnnnnnnnn

SEQ ID NO: 325239 - DNA, 427 bp, Homo sapiens
  misc_feature: GZ8MTXP01A0FDS.11.61.F06.1.454.CMB.2.raw
  modified_base (329)..(329): a, c, t, g, unknown or other
  misc_feature (329)..(329): n is a, c, g, or t
  modified_base (422)..(427): a, c, t, g, unknown or other
  misc_feature (422)..(427): n is a, c, g, or t
tcagcgagagataccacgaccggtgctcgatttagctacgctctaagggaaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagaggtggctggtcgcatggatttgatctcgtggggccagggggacaatggtaaccgtctcttcagcctccaccaaggcccatcggtcttccccctggcgcccctgctccaggngcacctccgagagcaccagcggccctgggctgccctggtcaagggcctacttccgtatctctcgctggacgcgggctgggcaaggcgcatagnnnnnn

SEQ ID NO: 325240 - DNA, 446 bp, Homo sapiens
  misc_feature: GZ8MTXP01EG2CO.11.61.F06.1.454.CMB.2.raw
  modified_base (328)..(328): a, c, t, g, unknown or other
  misc_feature (328)..(328): n is a, c, g, or t
  modified_base (364)..(364): a, c, t, g, unknown or other
  misc_feature (364)..(364): n is a, c, g, or t
  modified_base (436)..(446): a, c, t, g, unknown or other
  misc_feature (436)..(446): n is a, c, g, or t
tcagcgagagataccacgaccggtgctcgatttagctacgctctaagggaaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggcttgtttacttctgtgcaagaggtggctggtcgcatggatttgatctcgtggggccaggggacaagtggtaaccgtctcttcacgccctccaccgaagggccccagtccggtccttccccccgtggcccncccctgcctccaggacgccacctccgagacgcaccngcgccctgggctcgcctggtcaagggcctacttccgtatctctcgctggagcgggctggcaaggcgcatagnnnnnnnnnnn

SEQ ID NO: 325241 - DNA, 441 bp, Homo sapiens
  misc_feature: GZ8MTXP01DEYOZ.11.61.F06.1.454.CMB.2.raw
  modified_base (346)..(346): a, c, t, g, unknown or other
  misc_feature (346)..(346): n is a, c, g, or t
  modified_base (432)..(441): a, c, t, g, unknown or other
  misc_feature (432)..(441): n is a, c, g, or t
tcagcgagagataccacgaccggtgctcgatttagctacgctctaagggaaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagaggtggctggtcgcatggatttgatctcgtgggggccaggggacaatggtaaccgtctcttcagcctccaccaaggcccatcggtccttccccctggccgcccctgcctccgaggagccacctccgagngcaccagcggccctggggctgccctggtcaaagggtacctacttccgtatctctcgctggagcgggctgggacaagggcgcatagnnnnnnnnnn

SEQ ID NO: 325242 - DNA, 498 bp, Homo sapiens
  misc_feature: GZ8MTXP01BEL2W.11.61.F06.1.454.CMB.2.raw
  modified_base (221)..(221): a, c, t, g, unknown or other
  misc_feature (221)..(221): n is a, c, g, or t
  modified_base (482)..(485): a, c, t, g, unknown or other
  misc_feature (482)..(485): n is a, c, g, or t
  modified_base (487)..(498): a, c, t, g, unknown or other
  misc_feature (487)..(498): n is a, c, g, or t
tcagcgagagataccacgaccggtgctcgatttagctacgctctaagggaaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggcttgtttacttctgtgacaaggnggtggctggtcgctagtggtatttgatcgtcggtggggccgaggggacaagtcggtaaccgtctcttcacgccctaccgaccgaacgggcccctaagtcccggtcccctttcccccgtggccctcccctgcctacccgaggacgcctaccctccgagacgcaccgcggccggcccgtgggcctcggccctggtacgaaacggtaccttaccgttcgtatcctcgtcgctggacgcgggcgtcgggacgacggcactagagnnnngnnnnnnnnnnnn

SEQ ID NO: 325243 - DNA, 430 bp, Homo sapiens
  misc_feature: GZ8MTXP01BMG9W.11.61.F06.1.454.CMB.2.raw
  modified_base (423)..(430): a, c, t, g, unknown or other
  misc_feature (423)..(430): n is a, c, g, or t
tcagcgagagataccacgaccggtgctcgatttagctacgctctaagggaaaggggatggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagaggtggctggtcgcatggatttgatctctgggggccagggggacaatggtaacccgtctcttcagcctccaccaaggccccatcggtcttccccctggcgccctgctccaggacgcacctccgagagcaccagcggccctgggctgccctggtcaagggactacttccgtatctctcgctggagcgggctgggcaaggcgcatagnnnnnnnn

SEQ ID NO: 325244 - DNA, 414 bp, Homo sapiens
  misc_feature: GZ8MTXP01EM95I.11.61.F06.1.454.CMB.2.raw
  modified_base (326)..(326): a, c, t, g, unknown or other
  misc_feature (326)..(326): n is a, c, g, or t
  modified_base (410)..(414): a, c, t, g, unknown or other
  misc_feature (410)..(414): n is a, c, g, or t
tcagcgagagataccacgaccggtgctcgatttagctacgctctaagggaaagggctggtgtgggtctcacgtattgacaatgatgggagtgacacaatccacgcggattctgtgaggggccaattcaccacttcgagagacaacgccaagaacacggtatatctgcaaatgaacagtctgagaggcgaagacacggctgtttacttctgtgcaagaggtggctggtcgcatggatttgatctctggggccagggggacaatggtaaaccgtctctcagcctccaccaagggcccatcggtcttccccctgcgcctgctccaggancactccgagagcacagcgccctgggctgcctggtcaaaggactacttccgtatctctcgctgagcggctggcaaggcgcatagnnnnn

SEQ ID NO: 325245 - DNA, 439 bp, Homo sapiens
  misc_feature: GZ8MTXP01CYJ53.11.61.F06.1.454.CMB.2.raw
  modified_base (340)..(340): a, c, t, g, unknown or other
  misc_feature (340)..(340): n is a, c, g, or t
  modified_base (353)..(353): a, c, t, g, unknown or other
  misc_feature (353)..(353): n is a, c, g, or t
  modified_base (431)..(431): a, c, t, g, unknown or other
  misc_feature (431)..(431): n is a, c, g, or t
  modified_base (436)..(439): a, c, t, g, unknown or other
  misc_feature (436)..(439): n is a, c, g, or t
tcagcgagagataccacgaccggtgctcgatttagctacgctctaagggaaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaaggaggtggctggtcgcatggatttgatctcgtggggccagggggacaagtggtaaccgtctcttcagcctccaccaagggcccagtccggtccttccccccgtggcccgcccctgcctccaggngccacctccgagngcaccaggcggccctgggctcggccctggtccaaagggaccttacttccgtatctctcgctgagcgggctggcaggcncatgnnnn

SEQ ID NO: 325246 - DNA, 422 bp, Homo sapiens
  misc_feature: GZ8MTXP01ERCQZ.11.61.F06.1.454.CMB.2.raw
  modified_base (317)..(317): a, c, t, g, unknown or other
  misc_feature (317)..(317): n is a, c, g, or t
  modified_base (418)..(422): a, c, t, g, unknown or other
  misc_feature (418)..(422): n is a, c, g, or t
tcagcgagagataccacgaccggtgctcgatttagctacgctctaagggaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaaagacacggctgtttacttctgtgcaagaggtggctggtcgcatggatttgatctctgggggccaggggacaatggtaacccgtctcttcagccctccaccaagggccccatcggtcctcccctggcncccctgctccaggagccacctccgagcgcaccagcggccctggctgcctggtcaaggcctacttcgtatctctcgctgagcgggctggacaggcgcatagnnnnn

SEQ ID NO: 325247 - DNA, 482 bp, Homo sapiens
  misc_feature: GZ8MTXP01AD0HA.11.61.F06.1.454.CMB.2.raw
  modified_base (320)..(320): a, c, t, g, unknown or other
  misc_feature (320)..(320): n is a, c, g, or t
  modified_base (326)..(326): a, c, t, g, unknown or other
  misc_feature (326)..(326): n is a, c, g, or t
  modified_base (470)..(482): a, c, t, g, unknown or other
  misc_feature (470)..(482): n is a, c, g, or t
tcagcgagagataccacgaccggtgctcgatttagctacgctctaagggaaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagaggtggctggtcgcatggatttgatctcgtggggccaggggacaagtggtaacctctcttcacgccctccaccgaacgggccccagtccggtccttcccccgnggcccnccctgcctccgaggacgccacctccgagacgcacccgcggccggcccgtgggtcctcggccccgttggtaccgaaacgggtaccttaccgttccgtatcctcgtcgtcgtaggcggcgggctcgggacaacgggcgacaagtgnnnnnnnnnnnnn

SEQ ID NO: 325248 - DNA, 420 bp, Homo sapiens
  misc_feature: GZ8MTXP01BJC3V.11.61.F06.1.454.CMB.2.raw
  modified_base (407)..(407): a, c, t, g, unknown or other
  misc_feature (407)..(407): n is a, c, g, or t
  modified_base (412)..(420): a, c, t, g, unknown or other
  misc_feature (412)..(420): n is a, c, g, or t
tcagcgagagataccacgaccggtgctcgatttagctacgctctaagggaaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagaggtggctggtcgcatggatttgatctctgggggccaggggacaagtggtaaccgtctcttcagcctccaccaggcccatcgtcttccccctggcgccctgctccaggacgcacctccgagacgcaccagcggccctgggctgcctggcaaggctacttccgatctctcgctgagcgggctgggcaggcncatgnnnnnnnnn

SEQ ID NO: 325249 - DNA, 426 bp, Homo sapiens
  misc_feature: GZ8MTXP01C15SX.11.61.F06.1.454.CMB.2.raw
  modified_base (313)..(313): a, c, t, g, unknown or other
  misc_feature (313)..(313): n is a, c, g, or t
  modified_base (386)..(386): a, c, t, g, unknown or other
  misc_feature (386)..(386): n is a, c, g, or t
  modified_base (413)..(413): a, c, t, g, unknown or other
  misc_feature (413)..(413): n is a, c, g, or t
  modified_base (417)..(417): a, c, t, g, unknown or other
  misc_feature (417)..(417): n is a, c, g, or t
  modified_base (420)..(426): a, c, t, g, unknown or other
  misc_feature (420)..(426): n is a, c, g, or t
tcagcgagagataccacgaccggtgctcgatttagctacgctctaagggaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagaggtggctggtcgcatggatttgatctcgtggggccaggggacaatggtaaccgctctcagcctccaccaacggccatccggtcttccccctggccnccctgctccaggacgcacctccgagagcaccgagcggccctgggctcgccctggtcaaggactactccgatcnctcgctgagcggggctgggcaagggcncaanagnnnnnnn

SEQ ID NO: 325250 - DNA, 475 bp, Homo sapiens
  misc_feature: GZ8MTXP01C30UN.11.61.F06.1.454.CMB.2.raw
  modified_base (466)..(475): a, c, t, g, unknown or other
  misc_feature (466)..(475): n is a, c, g, or t
tcagcgagagataccacgaccggtgctcgatttagctacgctctaagggaaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagaggtggctggtcgcatggatttgatctcgtggggccaggggacaagtcggtaaccgtctcttcacgccctccaccgaacgggcccagtccggtcccttcccccctggcccacccctccctaccaagacgccaccgtcgtcgggggccacgacgccccggcccgtgggcctcgcccgtcgggtacaacggtacctaccgttcccgtatcctctcgctggacggccgggctcggcgaacgggcgacagtgnnnnnnnnnn

SEQ ID NO: 325251 - DNA, 521 bp, Homo sapiens
  misc_feature: GZ8MTXP01CSO9G.11.61.F06.1.454.CMB.2.raw
  modified_base (501)..(504): a, c, t, g, unknown or other
  misc_feature (501)..(504): n is a, c, g, or t
  modified_base (506)..(521): a, c, t, g, unknown or other
  misc_feature (506)..(521): n is a, c, g, or t
tcagcgagagataccacgaccggtgctcgatttagctacgctctaagggaaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaaggaggtggctggtcgcatggatttgatctcgtggggccaggggacaagtcggtaaccgtctcttcacgccctccaccgaacgggccccacgttccggttccctttccccccgtgggccccgtcccctgccctccgagggacgccacccgtccgagcgccacccgacggccggcccgtggggcctcggcccgtgggtaccaaacgggtacccttacgttcccgtacttcctccgtcgacgtggacgggccggggtccgtgggacgaacggggccgacgtaagtagnnnngnnnnnnnnnnnnnnnn

SEQ ID NO: 325252 - DNA, 518 bp, Homo sapiens
  misc_feature: GZ8MTXP01BHWN2.11.61.F06.1.454.CMB.2.raw
  modified_base (233)..(233): a, c, t, g, unknown or other
  misc_feature (233)..(233): n is a, c, g, or t
  modified_base (346)..(346): a, c, t, g, unknown or other
  misc_feature (346)..(346): n is a, c, g, or t
  modified_base (495)..(498): a, c, t, g, unknown or other
  misc_feature (495)..(498): n is a, c, g, or t
  modified_base (500)..(518): a, c, t, g, unknown or other
  misc_feature (500)..(518): n is a, c, g, or t
tcagcgagagataccacgaccggtgctcgatttagctacgctctaagggaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggcttgttttacttctgtgacaagaggtggctggtcgnatggatttgatcgtcgtgggggccagggggacaagtggtaaccgtctcttcagccctccaccaagggccccagtcggtccttcccccgtggccgcccctgcctccgagggacnccaccctccgagacgccacccgacggccggccccgtgggggcctcggcccttgggtaccaaacgggtacccttacccgtttcccggtaatccgttacgttccgcgttgggacgccgggggcttacggggacaacggggccacaagtcgnnnngnnnnnnnnnnnnnnnnnnn

SEQ ID NO: 325253 - DNA, 406 bp, Homo sapiens
  misc_feature: GZ8MTXP01DTP1D.11.61.F06.1.454.CMB.2.raw
  modified_base (312)..(312): a, c, t, g, unknown or other
  misc_feature (312)..(312): n is a, c, g, or t
  modified_base (315)..(315): a, c, t, g, unknown or other
  misc_feature (315)..(315): n is a, c, g, or t
  modified_base (318)..(319): a, c, t, g, unknown or other
  misc_feature (318)..(319): n is a, c, g, or t
  modified_base (323)..(323): a, c, t, g, unknown or other
  misc_feature (323)..(323): n is a, c, g, or t
  modified_base (325)..(325): a, c, t, g, unknown or other
  misc_feature (325)..(325): n is a, c, g, or t
  modified_base (327)..(327): a, c, t, g, unknown or other
  misc_feature (327)..(327): n is a, c, g, or t
  modified_base (332)..(333): a, c, t, g, unknown or other
  misc_feature (332)..(333): n is a, c, g, or t
  modified_base (337)..(337): a, c, t, g, unknown or other
  misc_feature (337)..(337): n is a, c, g, or t
  modified_base (373)..(373): a, c, t, g, unknown or other
  misc_feature (373)..(373): n is a, c, g, or t
  modified_base (381)..(381): a, c, t, g, unknown or other
  misc_feature (381)..(381): n is a, c, g, or t
  modified_base (392)..(392): a, c, t, g, unknown or other
  misc_feature (392)..(392): n is a, c, g, or t
  modified_base (395)..(395): a, c, t, g, unknown or other
  misc_feature (395)..(395): n is a, c, g, or t
  modified_base (398)..(406): a, c, t, g, unknown or other
  misc_feature (398)..(406): n is a, c, g, or t
tcagcgagagataccacgaccggtgctcgatttagctacgctctaagggaaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggcttgtttacttctgtgcaagaggtggctggtcgcatggtatttgattcgtcgtggggccgaggggacaagtggtaaccgtctacttcagcctccaccaggccatcgtctccccngcnccnnctcngncnctcanncacngcgctggctgctggcaggactactcgtatctctcgntgagcggntggacaaggcncanagnnnnnnnnn

SEQ ID NO: 325254 - DNA, 419 bp, Homo sapiens
  misc_feature: GZ8MTXP02F5HT5.11.61.F06.1.454.CMB.2.raw
  modified_base (415)..(419): a, c, t, g, unknown or other
  misc_feature (415)..(419): n is a, c, g, or t
tcagcgagagataccacgaccggtgctcgatttagctacgctctaagggaaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagaggtggctggtcgcatggatttgatctctggggccaggggacaatggtaaccgtctcttcagcctccaccaaggcccatcggtcttccccctggcgccctgctccaggagcacctccgagagcaccagcggccctgggctgcctggtcaaaggactacttccgtatctctcgctgagcgggctggcaaggcgcatagnnnnn

SEQ ID NO: 325255 - DNA, 421 bp, Homo sapiens
  misc_feature: GZ8MTXP02GXKDF.11.61.F06.1.454.CMB.2.raw
  modified_base (328)..(328): a, c, t, g, unknown or other
  misc_feature (328)..(328): n is a, c, g, or t
  modified_base (415)..(421): a, c, t, g, unknown or other
  misc_feature (415)..(421): n is a, c, g, or t
tcagcgagagataccacgaccggtgctcgatttagctacgctctaagggaaagggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagaggtggctggtcgcatggatttgatctctggggccaggggacaatggtaaccgtctcttcagcctccaccaagggcccatcggtcttccccctggccgccctgctccaggancacctccgagagcaccagccgccctggggctgcctggtcaaggcctacttccgtatctctcgctgagcgggctggcaggcgcatagnnnnnnn

SEQ ID NO: 325256 - DNA, 419 bp, Homo sapiens
  misc_feature: GZ8MTXP02F5TGX.11.61.F06.1.454.CMB.2.raw
  modified_base (414)..(419): a, c, t, g, unknown or other
  misc_feature (414)..(419): n is a, c, g, or t
tcagcgagagataccacgaccggtgctcgatttagctacgctctaagggaaagggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagaggtggctggtcgcatggatttgatctctggggccaggggacaatggtaaccgtctcttcagcctccaccaagggccccatcggtcttccccctggcgccctgctccaggacgcacctccgagagcaccagcgcctgggctgcctggtcaaggctacttccgtatctctcgctgagcgggctgggcaaggcgcatagnnnnnn

SEQ ID NO: 325257 - DNA, 410 bp, Homo sapiens
  misc_feature: GZ8MTXP02J5FLE.11.61.F06.1.454.CMB.2.raw
  modified_base (392)..(392): a, c, t, g, unknown or other
  misc_feature (392)..(392): n is a, c, g, or t
  modified_base (399)..(399): a, c, t, g, unknown or other
  misc_feature (399)..(399): n is a, c, g, or t
  modified_base (401)..(401): a, c, t, g, unknown or other
  misc_feature (401)..(401): n is a, c, g, or t
  modified_base (407)..(407): a, c, t, g, unknown or other
  misc_feature (407)..(407): n is a, c, g, or t
  modified_base (409)..(410): a, c, t, g, unknown or other
  misc_feature (409)..(410): n is a, c, g, or t
tcagcgagagataccacgaccggtgctcgatttagctacgctctaagggaagggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagaggtggctggtcgcatggatttgatctcgtggggccaggggacaatggtaaccgtctcttcagcctccaccaaggcccatccggtcttccccctggccgccctgctccaggagcacctccgagagcaccagcgccctgggctgcctggtcaaggctacttccgtatctctcgctagngcggcgngngagcgnann

SEQ ID NO: 325258 - DNA, 424 bp, Homo sapiens
  misc_feature: GZ8MTXP02FT8LI.11.61.F06.1.454.CMB.2.raw
  modified_base (418)..(424): a, c, t, g, unknown or other
  misc_feature (418)..(424): n is a, c, g, or t
tcagcgagagataccacgaccggtgctcgatttagctacgctctaagggaaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagaggtggctggtcgcatggatttgatctctggggccaggggacaagtggtaaccgtctcttcagcctccaccaagggcccatccggtctccccctggccgccctgctccaggacgccacctccgagagcaccagccgccctgggctgcctggtcaaggctacttcccgtatctctcgctgagcgggctggcaggcgcatagnnnnnnn

SEQ ID NO: 325259 - DNA, 413 bp, Homo sapiens
  misc_feature: GZ8MTXP02FSI5F.11.61.F06.1.454.CMB.2.raw
  modified_base (409)..(413): a, c, t, g, unknown or other
  misc_feature (409)..(413): n is a, c, g, or t
tcagcgagagataccacgaccggtgctcgatttagctacgctctaagggaagggctggtgtgggtctcacgtattgacaatgatgggagtgacacaatccacgcggattctgtgaggggccgattcaccacttcgagagacaacgccaagaaaacggtatatctgcaaatgaacagtctgagaggcgaagacacggctgtttactctgtgcaagaggtggctggtcgcatggatttgatctctggggccaggggacaatggtaaccgtctcttcagcctccaccaaggcccatcggtctccccctggcgccctgctccaggagcacctccgagagcacagccggccctgggctgcctggtcaaggctacttccgtatctctcgctgagcgggctggcaaggcgcatagnnnnn

SEQ ID NO: 325260 - DNA, 419 bp, Homo sapiens
  misc_feature: GZ8MTXP02FSX0U.11.61.F06.1.454.CMB.2.raw
  modified_base (313)..(313): a, c, t, g, unknown or other
  misc_feature (313)..(313): n is a, c, g, or t
  modified_base (415)..(419): a, c, t, g, unknown or other
  misc_feature (415)..(419): n is a, c, g, or t
tcagcgagagataccacgaccggtgctcgatttagctacgctctaagggaaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagaggtggctggtcgcatggatttgatctctggggccaggggacaatggtaaccgtctcttcagcctccaccaagggcccatcggtcttcccctggcnccctgctccaggagccacctccgagagcaccagcgccctggggctgcctggtcaaggactacttccgtatctctcgctgagcgggctggcaaggcgcatagnnnnn

SEQ ID NO: 325261 - DNA, 421 bp, Homo sapiens
  misc_feature: GZ8MTXP02F1MFD.11.61.F06.1.454.CMB.2.raw
  modified_base (418)..(421): a, c, t, g, unknown or other
  misc_feature (418)..(421): n is a, c, g, or t
tcagcgagagataccacgaccggtgctcgatttagctacgctctaagggaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagaggtggctggtcgcatggatttgatctctggggccaggggacaatggtaaccgtctcttcagcctccaccaagggccccatcggtcttccccctggcgcccctgctccaggagcacctccgagagcaccagccggccctgggctgcctgggtcaaggcctacttccgtatctctcgctgagcgggctggcaaggcgcatagnnnn

SEQ ID NO: 325262 - DNA, 457 bp, Homo sapiens
  misc_feature: GZ8MTXP02G1O58.11.61.F06.1.454.CMB.2.raw
  modified_base (442)..(457): a, c, t, g, unknown or other
  misc_feature (442)..(457): n is a, c, g, or t
tcagcgagagataccacgaccggtgctcgatttagctacgctctaagggaaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagaggtggctggtcgcatggatttgatctcgtggggccaggggacaagtggtaaccgtctcttcacgccctccaccgaacgggccccagtccggtcctttcccccgtggcccgcccctgcctccgaggacgccaccctccgagacgcaccacgccggccctgggctcgcctggtcaaggtacctacgttccgtatctctcgctggagcgggctggcaggcgcatagnnnnnnnnnnnnnnnn

SEQ ID NO: 325263 - DNA, 429 bp, Homo sapiens
  misc_feature: GZ8MTXP02F861G.11.61.F06.1.454.CMB.2.raw
  modified_base (426)..(429): a, c, t, g, unknown or other
  misc_feature (426)..(429): n is a, c, g, or t
tcagcgagagataccacgaccggtgctcgatttagctacgctctaagggaaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagaggtggctggtcgcatggatttgatctcgtggggccaggggacaatggtaaccgtctcttcagcctccaccaaggccccatccggtccttcccccgtggccgcccctgcctccagggacgccaccctccgagacgcaccagccggccctgggctgcctggtcaaggctacttccgtatctctcgctgagcgggctggcaggcgcatagnnnn

SEQ ID NO: 325264 - DNA, 413 bp, Homo sapiens
  misc_feature: GZ8MTXP02FSMPK.11.61.F06.1.454.CMB.2.raw
  modified_base (403)..(403): a, c, t, g, unknown or other
  misc_feature (403)..(403): n is a, c, g, or t
  modified_base (410)..(413): a, c, t, g, unknown or other
  misc_feature (410)..(413): n is a, c, g, or t
tcagcgagagataccacgaccggtgctcgatttagctacgctctaagggaagggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttactctgtgcaagaggtggctggtcgcatggatttgatctctggggccaggggacaatggtaaccgtctcttcagcctccaccaagggccccatcggtctccccctggcgccctgctccaggagcacctccgagagcaccagcgcctgggctgcctggtcaaggactactccgtatctctcgctgagcgggctggcaaggcncgatagnnnn

SEQ ID NO: 325265 - DNA, 420 bp, Homo sapiens
  misc_feature: GZ8MTXP02I82XL.11.61.F06.1.454.CMB.2.raw
  modified_base (315)..(315): a, c, t, g, unknown or other
  misc_feature (315)..(315): n is a, c, g, or t
  modified_base (330)..(330): a, c, t, g, unknown or other
  misc_feature (330)..(330): n is a, c, g, or t
  modified_base (413)..(420): a, c, t, g, unknown or other
  misc_feature (413)..(420): n is a, c, g, or t
tcagcgagagataccacgaccggtgctcgatttagctacgctctaagggaaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagaggtggctggtcgcatggatttgatctctggggcccaggggacaagtggtaaccgtctcttcagcctccaccaaggccccatcggtcttcccctggcnccctgctccaggacncacctccgagacacagcgccctgggctgcctggtcaaggctacttccgtatctctcgctgagcgggctggcaaggcgcatagnnnnnnnn

SEQ ID NO: 325266 - DNA, 428 bp, Homo sapiens
  misc_feature: GZ8MTXP02G2EJS.11.61.F06.1.454.CMB.2.raw
  modified_base (417)..(428): a, c, t, g, unknown or other
  misc_feature (417)..(428): n is a, c, g, or t
tcagcgagagataccacgaccggtgctcgatttagctacgctctaagggaaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagaggtggctggtcgcatggatttgatctctggggccaggggacaatggtaaccgtctcttcagcctccaccaagggccccatccggtcttccccctggccgccctgctccaggacgcacctccgagagcaccagcgccctgggctgcctggtcaaggactacttccgtatctccgctgagcgggctggcaaggcgcatagnnnnnnnnnnnn

SEQ ID NO: 325267 - DNA, 423 bp, Homo sapiens
  misc_feature: GZ8MTXP02F6PD8.11.61.F06.1.454.CMB.2.raw
  modified_base (417)..(423): a, c, t, g, unknown or other
  misc_feature (417)..(423): n is a, c, g, or t
tcagcgagagataccacgaccggtgctcgatttagctacgctctaagggaaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagaggtggctggtcgcatggatttgatctctggggcccaggggacaatggtaaccgtctcttcagcctccaccaaggcccatcggtcttccccctggcgccctgctccaggacgcacctccgagagcaccagccggccctgggctgcctgggtcaaggctacttccgtatctctcgctgagcgggctggcaaggcgcatagnnnnnnn

SEQ ID NO: 325268 - DNA, 446 bp, Homo sapiens
  misc_feature: GZ8MTXP02IFP9E.11.61.F06.1.454.CMB.2.raw
  modified_base (324)..(324): a, c, t, g, unknown or other
  misc_feature (324)..(324): n is a, c, g, or t
  modified_base (401)..(401): a, c, t, g, unknown or other
  misc_feature (401)..(401): n is a, c, g, or t
  modified_base (410)..(410): a, c, t, g, unknown or other
  misc_feature (410)..(410): n is a, c, g, or t
  modified_base (424)..(424): a, c, t, g, unknown or other
  misc_feature (424)..(424): n is a, c, g, or t
  modified_base (435)..(435): a, c, t, g, unknown or other
  misc_feature (435)..(435): n is a, c, g, or t
  modified_base (438)..(446): a, c, t, g, unknown or other
  misc_feature (438)..(446): n is a, c, g, or t
tcagcgagagataccacgaccggtgctcgatttagctacgctctaagggaaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggcttgtttacttctgtgcaagaggtggctggtcgcatggatttgatctctggggccaggggacaatggtaaccgtctcttcagccctccaccaaggccactcgtccgttccctccgcgccctcgtcncctacgagcaccctaccgacgagcaccacgcggcccgcggcgtcgtcgtcggtcgaagaccgtacctttccgtactntcctcgtcncgtagcggcgtcgngacgaggctanagnnnnnnnnn

SEQ ID NO: 325269 - DNA, 432 bp, Homo sapiens
  misc_feature: GZ8MTXP02IQYXR.11.61.F06.1.454.CMB.2.raw
  modified_base (402)..(402): a, c, t, g, unknown or other
  misc_feature (402)..(402): n is a, c, g, or t
  modified_base (424)..(432): a, c, t, g, unknown or other
  misc_feature (424)..(432): n is a, c, g, or t
tcagcgagagataccacgaccggtgctcgatttagctacgctctaagggaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagaggtggctggtcgcatggatttgatctctggggccaggggacaatggtaaccgtctcttcagcctccaccagggccccatccggtcttccccctggccgccctgctccaggacgccacctccgagagcaccacgccggccctggggcctgcctgggtcaaggacctacttccgtatctctcgctgngcgggctggcaggcgcatacgnnnnnnnnn

SEQ ID NO: 325270 - DNA, 418 bp, Homo sapiens
  misc_feature: GZ8MTXP02IO5JM.11.61.F06.1.454.CMB.2.raw
  modified_base (310)..(310): a, c, t, g, unknown or other
  misc_feature (310)..(310): n is a, c, g, or t
  modified_base (413)..(418): a, c, t, g, unknown or other
  misc_feature (413)..(418): n is a, c, g, or t
tcagcgagagataccacgaccggtgctcgatttagctacgctctaagggaaggggctggtgtgggtctcacgtattgacaatgatgggagtgacacaatccacgcggattctgtgaggggccgattcaccacttcgagagacaacgccaagaaaacggtatatctgcaaatgaacagtctgagaggcgaagacacggctgtttacttctgtgcaagaggtggctggtcgcatggatttgatctctggggccaggggacaatggtaaccgtctcttcagcctccaccaggcccatcggtctcccctggccnccctgctccaggacgcacctccgagagcacacgccggccctgggctgccctggtcaaggctacttccgtatctctcgctgagcgggctggcaaggcgcatagnnnnnn

SEQ ID NO: 325271 - DNA, 436 bp, Homo sapiens
  misc_feature: GZ8MTXP02IWE0B.11.61.F06.1.454.CMB.2.raw
  modified_base (219)..(219): a, c, t, g, unknown or other
  misc_feature (219)..(219): n is a, c, g, or t
  modified_base (427)..(436): a, c, t, g, unknown or other
  misc_feature (427)..(436): n is a, c, g, or t
tcagcgagagataccacgaccggtgctcgatttagctacgctctaagggaaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggcttgtttacttctgtgcaagnggtggctggtcgcatggatttgatctcgtggggccaggggacaatggtaaccgtctcttcagcctccaccaaggccccatccggtcttccccctggccgcccctgctccaggcgcaccctccgagacgccaccacgccgccctgggctcgcctgggtcaaggcctacttccgtatctctcgctgagcgggctggacaaggcgcatagnnnnnnnnnn

SEQ ID NO: 325272 - DNA, 430 bp, Homo sapiens
  misc_feature: GZ8MTXP02ITTU2.11.61.F06.1.454.CMB.2.raw
  modified_base (317)..(317): a, c, t, g, unknown or other
  misc_feature (317)..(317): n is a, c, g, or t
  modified_base (416)..(416): a, c, t, g, unknown or other
  misc_feature (416)..(416): n is a, c, g, or t
  modified_base (422)..(430): a, c, t, g, unknown or other
  misc_feature (422)..(430): n is a, c, g, or t
tcagcgagagataccacgaccggtgctcgatttagctacgctctaagggaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagaggtggctggtcgcatggatttgatctcgtggggccaggggacaagtggtaaccgtctcttcagcctccaccaaggcccatccggtccttccccctggccnccctgctccagacgcacctccgagacgcaccagccggccctggctgcctggtcaaggacctactccgtatctctcgctgacgcgggctgggacagggcncatagnnnnnnnnn

SEQ ID NO: 325273 - DNA, 412 bp, Homo sapiens
  misc_feature: GZ8MTXP02FL6FW.11.61.F06.1.454.CMB.2.raw
  modified_base (324)..(324): a, c, t, g, unknown or other
  misc_feature (324)..(324): n is a, c, g, or t
  modified_base (335)..(335): a, c, t, g, unknown or other
  misc_feature (335)..(335): n is a, c, g, or t
  modified_base (409)..(412): a, c, t, g, unknown or other
  misc_feature (409)..(412): n is a, c, g, or t
tcagcgagagataccacgaccggtgctcgatttagctacgctctaagggaaagggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttactctgtgcaagaggtggctggtcgcatggatttgatctctggggccaggggacaatggtaaccgtctcttcagcctccaccaaggcccatcggtcttccccctggcgccctgctccaggngcacctccganagcaccagcgccctggctgcctggtcaaggctacttccgtatctctcgctgagcgggctggcaaggcgcatagnnnn

SEQ ID NO: 325274 - DNA, 433 bp, Homo sapiens
  misc_feature: GZ8MTXP02GMW8Y.11.61.F06.1.454.CMB.2.raw
  modified_base (366)..(366): a, c, t, g, unknown or other
  misc_feature (366)..(366): n is a, c, g, or t
  modified_base (429)..(433): a, c, t, g, unknown or other
  misc_feature (429)..(433): n is a, c, g, or t
tcagcgagagataccacgaccggtgctcgatttagctacgctctaagggaaaggggctggtgtgggtctcacgtattgacaatgatgggagtgacacaatccacgcggattctgtggaggggccgattcaccacttcgagagacaacgccaagaacacggtatatctgcaaatgaacagtctgagaggcgaagacacggcttgtttacttctgtgcaagaggtggctggtcgcatggatttgatctcgtggggccaggggacaatggtaaccgtctcttcagcctccaccaagggccccatcggtcttccccctggccgccctgctccaggacgcacctccgagacgcaccagccggccctgggcngcctggtcaaaggcctacttccgtatcctctcgctggacgcgggcgtggcaagggcacatagnnnnn

SEQ ID NO: 325275 - DNA, 446 bp, Homo sapiens
  misc_feature: GZ8MTXP02IDOV6.11.61.F06.1.454.CMB.2.raw
  modified_base (341)..(341): a, c, t, g, unknown or other
  misc_feature (341)..(341): n is a, c, g, or t
  modified_base (437)..(446): a, c, t, g, unknown or other
  misc_feature (437)..(446): n is a, c, g, or t
tcagcgagagataccacgaccggtgctcgatttagctacgctctaagggaaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggcttgtttacttctgtgcaaaggaggtggctggtcgcatggatttgatctcgtggggccaggggacaagtggtaaccgtctcttcagcctccaccgaaggccccatccggtccttccccctggccgcccctgcctccagggacncaccctccgagacgcaccagccgccctggggctcgcctggtcaaaggccttacttccgtatctcctcgctgacgcgggctggcaaggcgacatagnnnnnnnnnn

SEQ ID NO: 325276 - DNA, 531 bp, Homo sapiens
  misc_feature: GZ8MTXP02HSG78.11.61.F06.1.454.CMB.2.raw
  modified_base (348)..(348): a, c, t, g, unknown or other
  misc_feature (348)..(348): n is a, c, g, or t
  modified_base (515)..(531): a, c, t, g, unknown or other
  misc_feature (515)..(531): n is a, c, g, or t
tcagcgagagataccacgaccggtgctcgatttagctacgctctaagggaaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggcttgttttacttctgtgcaagaggtggctggtcgcatggtatttgatctcgtggggcaggggacaagtggtaaccgtctcttcacgccctaccaccgaacggccccagtccggtcccttcccccgtggccgcccctgcctccgagggacnccacctccgagacgccacccgacggccggcccgtggggcctcggccgttcgggtaccgaaacgggtacccttacccgtttcccgggtaacttcccttcccgtccggtcgttacggggacgggtcccgggggccgttggggaccgaaacgggggccacctaagtacgnnnnnnnnnnnnnnnnn

SEQ ID NO: 325277 - DNA, 426 bp, Homo sapiens
  misc_feature: GZ8MTXP02I0HU2.11.61.F06.1.454.CMB.2.raw
  modified_base (334)..(334): a, c, t, g, unknown or other
  misc_feature (334)..(334): n is a, c, g, or t
  modified_base (385)..(385): a, c, t, g, unknown or other
  misc_feature (385)..(385): n is a, c, g, or t
  modified_base (409)..(409): a, c, t, g, unknown or other
  misc_feature (409)..(409): n is a, c, g, or t
  modified_base (417)..(426): a, c, t, g, unknown or other
  misc_feature (417)..(426): n is a, c, g, or t
tcagcgagagataccacgaccggtgctcgatttagctacgctctaagggaaagggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagaggtggctggtcgcatggatttgatctcgtggggccaggggacaatggtaacccgtctcttcagcctccaccaaggccccatccggtccttccccctggccgccctgcctccaggacncacctcgagagcacagcgcctggctgctggtcaaggctactccgtatctcncgctgacgcgggctgggcaaggcncagtacgnnnnnnnnnn

SEQ ID NO: 325278 - DNA, 442 bp, Homo sapiens
  misc_feature: GZ8MTXP02HEYZZ.11.61.F06.1.454.CMB.2.raw
  modified_base (311)..(311): a, c, t, g, unknown or other
  misc_feature (311)..(311): n is a, c, g, or t
  modified_base (397)..(397): a, c, t, g, unknown or other
  misc_feature (397)..(397): n is a, c, g, or t
  modified_base (426)..(442): a, c, t, g, unknown or other
  misc_feature (426)..(442): n is a, c, g, or t
tcagcgagagataccacgaccggtgctcgatttagctacgctctaagggaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagaggtggctggtcgcatggatttgatctcgtggggccaggggacaagtggtaaccgtctcttcagcctccaccaaggcccatcggtccttcccccnggccgccctgctccaggcgccacctccgagacgcaccgagccggcccgtgggctcgcctggtacaaggcctaccttccgtatctcncgctgagcgggctgggcaggcgcatacgnnnnnnnnnnnnnnnnn

SEQ ID NO: 325279 - DNA, 418 bp, Homo sapiens
  misc_feature: GZ8MTXP02GP4UM.11.61.F06.1.454.CMB.2.raw
  modified_base (333)..(333): a, c, t, g, unknown or other
  misc_feature (333)..(333): n is a, c, g, or t
  modified_base (343)..(343): a, c, t, g, unknown or other
  misc_feature (343)..(343): n is a, c, g, or t
  modified_base (348)..(348): a, c, t, g, unknown or other
  misc_feature (348)..(348): n is a, c, g, or t
  modified_base (410)..(410): a, c, t, g, unknown or other
  misc_feature (410)..(410): n is a, c, g, or t
  modified_base (413)..(413): a, c, t, g, unknown or other
  misc_feature (413)..(413): n is a, c, g, or t
  modified_base (415)..(418): a, c, t, g, unknown or other
  misc_feature (415)..(418): n is a, c, g, or t
tcagcgagagataccacgaccggtgctcgatttagctacgctctaagggaaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagaggtggctggtcgcatggatttgatctctggggccaggggacaagtggtaaccgtctcttcagcctccaccaagggccccatcggtccttccccctggccgcccctgcctccaggngcacctcgangcacngcgccctggctgctgtcaacggctacttccgtatctctcgctagcgtcgggctggcaaggcncangnnnn

SEQ ID NO: 325280 - DNA, 449 bp, Homo sapiens
  misc_feature: GZ8MTXP02IZ14W.11.61.F06.1.454.CMB.2.raw
  modified_base (429)..(429): a, c, t, g, unknown or other
  misc_feature (429)..(429): n is a, c, g, or t
  modified_base (439)..(439): a, c, t, g, unknown or other
  misc_feature (439)..(439): n is a, c, g, or t
  modified_base (445)..(449): a, c, t, g, unknown or other
  misc_feature (445)..(449): n is a, c, g, or t
tcagcgagagataccacgaccggtgctcgatttagctacgctctaagggaaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaaaggaggtggctgggtcgcatggatttgatctcgtggggcccaggggacaagtggtaaccgtctctcacgcctccaccaacgggccccatccggtccttccccccgtggccgcccctgcctccaggtacgccaccgtccgagagccaccacggccggccctggggctgccctggtcaaaggccttacttcccgtatcctctcgctggagcgggntggcaaggcncatagnnnnn

SEQ ID NO: 325281 - DNA, 425 bp, Homo sapiens
  misc_feature: GZ8MTXP02IZEKB.11.61.F06.1.454.CMB.2.raw
  modified_base (218)..(218): a, c, t, g, unknown or other
  misc_feature (218)..(218): n is a, c, g, or t
  modified_base (274)..(274): a, c, t, g, unknown or other
  misc_feature (274)..(274): n is a, c, g, or t
  modified_base (313)..(313): a, c, t, g, unknown or other
  misc_feature (313)..(313): n is a, c, g, or t
  modified_base (332)..(332): a, c, t, g, unknown or other
  misc_feature (332)..(332): n is a, c, g, or t
  modified_base (343)..(343): a, c, t, g, unknown or other
  misc_feature (343)..(343): n is a, c, g, or t
  modified_base (347)..(347): a, c, t, g, unknown or other
  misc_feature (347)..(347): n is a, c, g, or t
  modified_base (407)..(407): a, c, t, g, unknown or other
  misc_feature (407)..(407): n is a, c, g, or t
  modified_base (413)..(425): a, c, t, g, unknown or other
  misc_feature (413)..(425): n is a, c, g, or t
tcagcgagagataccacgaccggtgctcgatttagctacgctctaagggaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggcttgtttacttctgtgcaagnggtggctggtcgcatggatttgatctcgtggggcccaggggacaatggtaaccgtntcttcagccctccaccagggccccatcggtcttcccccnggccgccctgctccgaggncacctcgagancacngcgcctgggctgcctggtcaaggctacttccgtatctctcgctgagcgggctggcaggcncatagnnnnnnnnnnnnn

SEQ ID NO: 325282 - DNA, 420 bp, Homo sapiens
  misc_feature: GZ8MTXP02G6I3L.11.61.F06.1.454.CMB.2.raw
  modified_base (311)..(311): a, c, t, g, unknown or other
  misc_feature (311)..(311): n is a, c, g, or t
  modified_base (328)..(328): a, c, t, g, unknown or other
  misc_feature (328)..(328): n is a, c, g, or t
  modified_base (410)..(410): a, c, t, g, unknown or other
  misc_feature (410)..(410): n is a, c, g, or t
  modified_base (413)..(413): a, c, t, g, unknown or other
  misc_feature (413)..(413): n is a, c, g, or t
  modified_base (415)..(420): a, c, t, g, unknown or other
  misc_feature (415)..(420): n is a, c, g, or t
tcagcgagagataccacgaccggtgctcgatttagctacgctctaagggaaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgttttacttctgtgcaagaggtggctggtcgcatggtatttgatctcgtggggccaggggacaatggtaaccgtctcttcagcctccacaaggcccatcggtcttcccccnggcgccctgctccaggngcacctcgagacgcaccagccgccctgggctcgcctggtcaacggactactccgtatctctcgctgagtcggctggcaggcncangnnnnnn

SEQ ID NO: 325283 - DNA, 450 bp, Homo sapiens
  misc_feature: GZ8MTXP02HC03D.11.61.F06.1.454.CMB.2.raw
  modified_base (216)..(216): a, c, t, g, unknown or other
  misc_feature (216)..(216): n is a, c, g, or t
  modified_base (434)..(434): a, c, t, g, unknown or other
  misc_feature (434)..(434): n is a, c, g, or t
  modified_base (437)..(450): a, c, t, g, unknown or other
  misc_feature (437)..(450): n is a, c, g, or t
tcagcgagagataccacgaccggtgctcgatttagctacgctctaagggaaaggggctggtgtgggtctcacgtattgacaatgatgggagtgacacaatccacgcggattctgtgagggccgattcaccacttcgagagacaacgccaagaacacggtatatctgcaaatgaacagtctgagaggcgaagacacggctgtttactctgtgcaagnggtggctggtcgcatggatttgatctctggggcccaggggacaatggtaaaccgtctcttcagcctccaccaagggccccatccggtcttccccctggccgccctgctccgaggacgtcaccctccgagacgcacccagccggccctggggctggcctggggtccaaaggtctacttcccgtatcctctccgctggagcgggctgggcaacggcgcanagnnnnnnnnnnnnnn

SEQ ID NO: 325284 - DNA, 489 bp, Homo sapiens
  misc_feature: GZ8MTXP02ITRC1.11.61.F06.1.454.CMB.2.raw
  modified_base (221)..(221): a, c, t, g, unknown or other
  misc_feature (221)..(221): n is a, c, g, or t
  modified_base (233)..(233): a, c, t, g, unknown or other
  misc_feature (233)..(233): n is a, c, g, or t
  modified_base (324)..(324): a, c, t, g, unknown or other
  misc_feature (324)..(324): n is a, c, g, or t
  modified_base (330)..(330): a, c, t, g, unknown or other
  misc_feature (330)..(330): n is a, c, g, or t
  modified_base (347)..(347): a, c, t, g, unknown or other
  misc_feature (347)..(347): n is a, c, g, or t
  modified_base (425)..(425): a, c, t, g, unknown or other
  misc_feature (425)..(425): n is a, c, g, or t
  modified_base (467)..(489): a, c, t, g, unknown or other
  misc_feature (467)..(489): n is a, c, g, or t
tcagcgagagataccacgaccggtgctcgatttagctacgctctaagggaaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggcttgttttacttctgtgcaaggnggtggctggtcncatggtatttgatctcgtggggccaggggacaagtcggtacctctcttcacgccctaccaccgaacggccccagtccggtccttcccccgnggcccnccctgcctccgaggacnccacccgtccgagacgcaccgcgccggcccgtggggctcgccgtggtaccaaaggtccttaccgttccgtatccttcncgtgtacggcggcggggtctcgggacaagggcccagaagtgnnnnnnnnnnnnnnnnnnnnnnn

SEQ ID NO: 325285 - DNA, 483 bp, Homo sapiens
  misc_feature: GZ8MTXP02JW6UT.11.61.F06.1.454.CMB.2.raw
  modified_base (462)..(462): a, c, t, g, unknown or other
  misc_feature (462)..(462): n is a, c, g, or t
  modified_base (467)..(483): a, c, t, g, unknown or other
  misc_feature (467)..(483): n is a, c, g, or t
tcagcgagagataccacgaccggtgctcgatttagctacgctctaagggaaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagaggtggctggtcgcatggatttgatctcgtggggccgaggggacaagtcggtaaccgtctcttcacgcctccaccgaaggccccagtccgtccttcccccgtcggcgcccctgcctaccgacggacgccaacccgtccgaagacgaccaccgacggccgccccgtacggggtctcggccgttcggacgaaacggtacctacttccgtatcctctcgctggacggcggtcgcggacgagggccganatagnnnnnnnnnnnnnnnnn

SEQ ID NO: 325286 - DNA, 463 bp, Homo sapiens
  misc_feature: GZ8MTXP02I9WAL.11.61.F06.1.454.CMB.2.raw
  modified_base (218)..(218): a, c, t, g, unknown or other
  misc_feature (218)..(218): n is a, c, g, or t
  modified_base (230)..(230): a, c, t, g, unknown or other
  misc_feature (230)..(230): n is a, c, g, or t
  modified_base (322)..(322): a, c, t, g, unknown or other
  misc_feature (322)..(322): n is a, c, g, or t
  modified_base (431)..(463): a, c, t, g, unknown or other
  misc_feature (431)..(463): n is a, c, g, or t
tcagcgagagataccacgaccggtgctcgatttagctacgctctaagggaaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagnggtggctggtcncatggatttgatctctggggccaggggacaatggaaccgtctctcagcctccaccaaggccccatccggtccttcccccgtggccgcccctncctccaggacgcacctccgagacgcacccgagcggcccctggggctgccctgggtcaaacggactaccttccgtatctctcgctgagcggctggcaaggcgcatagcannnnnnnnnnnnnnnnnnnnnnnnnnnnnnnnn

SEQ ID NO: 325287 - DNA, 486 bp, Homo sapiens
  misc_feature: GZ8MTXP02IIIOE.11.61.F06.1.454.CMB.2.raw
  modified_base (317)..(317): a, c, t, g, unknown or other
  misc_feature (317)..(317): n is a, c, g, or t
  modified_base (321)..(321): a, c, t, g, unknown or other
  misc_feature (321)..(321): n is a, c, g, or t
  modified_base (470)..(486): a, c, t, g, unknown or other
  misc_feature (470)..(486): n is a, c, g, or t
tcagcgagagataccacgaccggtgctcgatttagctacgctctaagggaaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggcttgtttacttctgtgcaagaggtggctggtcgctagtggtatttgatcgtcgtggggccgaggggaacaagtggtaaccgtctctcagcctccaccgaaggccatccgtcttccccgngccnccctgcctccgagacgcacctccgagacgcaacccgacgccgcccgtgggctcggcccgtcgggtacaaacgggtaccttaccgtttaccgttacgtccttccgtcgcgtggacggcgggtcgtgggacgaaacggggcgtacagtagnnnnnnnnnnnnnnnnn

SEQ ID NO: 325288 - DNA, 442 bp, Homo sapiens
  misc_feature: GZ8MTXP02HDKH6.11.61.F06.1.454.CMB.2.raw
  modified_base (230)..(230): a, c, t, g, unknown or other
  misc_feature (230)..(230): n is a, c, g, or t
  modified_base (360)..(360): a, c, t, g, unknown or other
  misc_feature (360)..(360): n is a, c, g, or t
  modified_base (406)..(406): a, c, t, g, unknown or other
  misc_feature (406)..(406): n is a, c, g, or t
  modified_base (434)..(442): a, c, t, g, unknown or other
  misc_feature (434)..(442): n is a, c, g, or t
tcagcgagagataccacgaccggtgctcgatttagctacgctctaagggaaaggggctggtgtgggtctcacgtattggcaatgatgggagtgacacaatccacgcggattctgtgaggggccgattcaccgacttcgagagacaacgccaagaacacggtatatctgcaaatgaacagtctgagaggcgaagacacggctgtttacttctgtgcaagaggtggctggcncatggatttgatctcgtggggccaggggacagtggtaaccgtctcttcacgccctaccaccgaacgggcccactccgtccttcccccctggccgcccctgcctccaggacgccacctccgagacgcaccngccgcccgtgggctcgctggtccaaggccttacgttccgtatctcncgctgacgcgggctggcaggcgacatgnnnnnnnnn

SEQ ID NO: 325289 - DNA, 507 bp, Homo sapiens
  misc_feature: GZ8MTXP02ITT2V.11.61.F06.1.454.CMB.2.raw
  modified_base (229)..(229): a, c, t, g, unknown or other
  misc_feature (229)..(229): n is a, c, g, or t
  modified_base (280)..(280): a, c, t, g, unknown or other
  misc_feature (280)..(280): n is a, c, g, or t
  modified_base (479)..(479): a, c, t, g, unknown or other
  misc_feature (479)..(479): n is a, c, g, or t
  modified_base (487)..(507): a, c, t, g, unknown or other
  misc_feature (487)..(507): n is a, c, g, or t
tcagcgagagataccacgaccggtgctcgatttagctacgctctaagggaaggggctggtgtgggtctcacgtattgacaatgatgggagtgacacaatccacgcggattctgtgaggggccattcaccattcgagagacaacgccaagaacacggtatatctgcaaatgaacagtctgaggaggcgaagacacggcttgtttacttctgtgcaaggaggtgctggtcncatggtattgatcgtcggtcggggaccgaggggactagtacggtaaccgtntctcacgcctaccacgacggccctagtccggtccctccccgtggcccacccgtcgcctaccgaggtcgccacccgtacgagacgtaccacgacggtcccggccgtcgggctccggacttggggtaaccctaaaggtaaccctttccgttaccgtacgtccttacgtccgcgtaggcgggccgggtgcggacgacggccngaagtcgnnnnnnnnnnnnnnnnnnnnn

SEQ ID NO: 325290 - DNA, 518 bp, Homo sapiens
  misc_feature: GZ8MTXP01DG567.39.11.A11.1.454.CMB.2.raw
  modified_base (320)..(320): a, c, t, g, unknown or other
  misc_feature (320)..(320): n is a, c, g, or t
  modified_base (334)..(334): a, c, t, g, unknown or other
  misc_feature (334)..(334): n is a, c, g, or t
  modified_base (414)..(414): a, c, t, g, unknown or other
  misc_feature (414)..(414): n is a, c, g, or t
tcagtcgcactagtcacgaccggtgctcgatttagctacgactgcagggggggtctcaggaggcagcgctctcaggacatctccaccatggcctgggctctgctgctcctcaccctcctcactcagggcacagggtcctgggcccagtctgccctgactcagcctgcctccgtgtctggtctcctggacagtcgctcaccatctcctgcactggaaccagcagtgacgttggtgttacaactatgtctctggtaccaacaacaccccgcaaagcccccgaagtcatgatttatgacgtcactaatcggccctcaggggtntctaatcgcttccnctggctcaagtctggcaacacggcctccctgaccatctctgggctccaggctgaggacaggctgattattactgcagctnatattcaagcaagtatactgtcctttgggcgtaagggttaccaagttcgtgtacccgttcgttgggttccaagaccccaaggcctcgcccctcggttctaaccc

SEQ ID NO: 325291 - DNA, 506 bp, Homo sapiens
  misc_feature: GZ8MTXP01E0ZKP.39.11.A11.1.454.CMB.2.raw
  modified_base (370)..(370): a, c, t, g, unknown or other
  misc_feature (370)..(370): n is a, c, g, or t
  modified_base (471)..(471): a, c, t, g, unknown or other
  misc_feature (471)..(471): n is a, c, g, or t
  modified_base (501)..(506): a, c, t, g, unknown or other
  misc_feature (501)..(506): n is a, c, g, or t
tcagtcgcactagtcacgaccggtgctcgatttagctacgactgcagggcctctggaggcaccttcaatagttatgtcatcacttgggtgcgacaggcccctggacaagggcttgagtgggtgggagggatcatctctatgtttggaacacccatgtttggtacaccaagttacgcacagaagttccagggcagagtcacgattaccgcggacgaatctacgagcacagcctacatggcgctgagaagtctgagatctgaggacacggccgtctatttctgtgcgagaggacgcggggtatcacttaagtagcgcgggcgactactgggggccaggggaaccctggtccaccggtctcctcagccctccnccaaagggcccatcggtcttccccctggcaccctcctccaagagcacctctgggggcacagcggccctgggctggcctggtcaaggctactccactagtcncgactgagcgggcttggcaaggcgcattgnnnnnn

SEQ ID NO: 325292 - DNA, 543 bp, Homo sapiens
  misc_feature: GZ8MTXP01DUNJD.39.11.A11.1.454.CMB.2.raw
  modified_base (219)..(219): a, c, t, g, unknown or other
  misc_feature (219)..(219): n is a, c, g, or t
  modified_base (240)..(240): a, c, t, g, unknown or other
  misc_feature (240)..(240): n is a, c, g, or t
  modified_base (242)..(242): a, c, t, g, unknown or other
  misc_feature (242)..(242): n is a, c, g, or t
  modified_base (246)..(246): a, c, t, g, unknown or other
  misc_feature (246)..(246): n is a, c, g, or t
  modified_base (275)..(275): a, c, t, g, unknown or other
  misc_feature (275)..(275): n is a, c, g, or t
  modified_base (332)..(332): a, c, t, g, unknown or other
  misc_feature (332)..(332): n is a, c, g, or t
  modified_base (354)..(354): a, c, t, g, unknown or other
  misc_feature (354)..(354): n is a, c, g, or t
tcagtcgcactagtcacgaccggtgctcgatttagctacgactgcagggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcgctcaccatctcctgcactggaaccngcagtgagttggtagtacatntntctntgacacatcacagacaactaccaatgatntattatgagtacacgtaacgcctacgtaggttactatctcttcctctgctacagtcncgcacgaccgcctcctacgacnctctcgtcggctcgagcgaggacggacgagtctactactattatgacgtagtctactataataacaagtactaattatcgtacgttgggttcggtcgggcgggacgggtacccgttacgtacgtaccgttcgttacggttaccgaacgacccgtaacggtcctccggttccccgtcggttccgtaaccg

SEQ ID NO: 325293 - DNA, 525 bp, Homo sapiens
  misc_feature: GZ8MTXP01D4T8I.39.11.A11.1.454.CMB.2.raw
  modified_base (220)..(220): a, c, t, g, unknown or other
  misc_feature (220)..(220): n is a, c, g, or t
  modified_base (296)..(296): a, c, t, g, unknown or other
  misc_feature (296)..(296): n is a, c, g, or t
  modified_base (323)..(323): a, c, t, g, unknown or other
  misc_feature (323)..(323): n is a, c, g, or t
  modified_base (338)..(338): a, c, t, g, unknown or other
  misc_feature (338)..(338): n is a, c, g, or t
tcagtcgcactagtcacgaccggtgctcgatttagctacgactgcagggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgctcaccatctcctgcactggaaccngcagtgacgttggtgttacaactatgtctcctggaccaacaacaccccggcaaacgcccccgaagtcatgatttangacgtcactaatcggccctgaggggtntctaatcgctttccnctggctccaagtctggcaacacggccctccctgacccatctctggctccgaggctgaggacgaggctgattatactgcagctcaatattcaagctaagtaatacttgttcctttgggcggaaggaccaagcgtacgtaccgttccgttaggttcaacgcccaagcctcgcccctcggttcctaaccg

SEQ ID NO: 325294 - DNA, 542 bp, Homo sapiens
  misc_feature: GZ8MTXP01CHUQI.39.11.A11.1.454.CMB.2.raw
  modified_base (218)..(218): a, c, t, g, unknown or other
  misc_feature (218)..(218): n is a, c, g, or t
  modified_base (295)..(295): a, c, t, g, unknown or other
  misc_feature (295)..(295): n is a, c, g, or t
tcagtcgcactagtcacgaccggtgctcgatttagctacgactgcagggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgctcacatctctgcactggaaccngcagtgacgttggtgttacaactatgtctcctgtaccaacaacaccccggacaaacgcccccgaagtcatgatttangacgtcactaatccggccctcgaggggtgtctaatcgtcttcctctggtctccaagtctaggccaaacaccggccctccctacgaccatcctctcgggctccgaggctgacggacgaggctagattagtactgcagctacatattcaagtcaagtatacgtgttccgtttggcggtacggacaagccgtaggtacccgttcgttcggttcaacgcccgaaggtcctccgccccttcggcctaacccg

SEQ ID NO: 325295 - DNA, 531 bp, Homo sapiens
  misc_feature: GZ8MTXP01EALH6.39.11.A11.1.454.CMB.2.raw
  modified_base (191)..(191): a, c, t, g, unknown or other
  misc_feature (191)..(191): n is a, c, g, or t
  modified_base (220)..(220): a, c, t, g, unknown or other
  misc_feature (220)..(220): n is a, c, g, or t
  modified_base (273)..(273): a, c, t, g, unknown or other
  misc_feature (273)..(273): n is a, c, g, or t
  modified_base (298)..(298): a, c, t, g, unknown or other
  misc_feature (298)..(298): n is a, c, g, or t
  modified_base (327)..(327): a, c, t, g, unknown or other
  misc_feature (327)..(327): n is a, c, g, or t
  modified_base (410)..(410): a, c, t, g, unknown or other
  misc_feature (410)..(410): n is a, c, g, or t
  modified_base (493)..(493): a, c, t, g, unknown or other
  misc_feature (493)..(493): n is a, c, g, or t
tcagtcgcactagtcacgaccggtgctcgatttagctacgactgcagggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacngtcgctcaccatctcctgcactggaaccngcagtgacgttggtgttaacaactatgtctcctggaccaacaacaccccgganaaacgcccccgaagtcatgatttangacgtcactaatcggccctcgagggggtntactaatcgcttcctcgtgctcagtctggcacacgcctcctgacatctcgtggctcgagctgaggacgagctgtattattacngcagtctactatattacaagtctaagtaactacgttgttcccgtttgggaacggtagggaccaacgttcgtcgaaccgttcgnggttcaacgcccgaaggcctcgccccttcggttctccg

SEQ ID NO: 325296 - DNA, 547 bp, Homo sapiens
  misc_feature: GZ8MTXP01EW0QF.39.11.A11.1.454.CMB.2.raw
  modified_base (221)..(221): a, c, t, g, unknown or other
  misc_feature (221)..(221): n is a, c, g, or t
  modified_base (244)..(244): a, c, t, g, unknown or other
  misc_feature (244)..(244): n is a, c, g, or t
  modified_base (249)..(249): a, c, t, g, unknown or other
  misc_feature (249)..(249): n is a, c, g, or t
  modified_base (284)..(284): a, c, t, g, unknown or other
  misc_feature (284)..(284): n is a, c, g, or t
  modified_base (313)..(313): a, c, t, g, unknown or other
  misc_feature (313)..(313): n is a, c, g, or t
  modified_base (417)..(417): a, c, t, g, unknown or other
  misc_feature (417)..(417): n is a, c, g, or t
tcagtcgcactagtcacgaccggtgctcgatttagctacgactgcaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgctcaccatctcctgcactggaaccngcagtgacgttgtgttacatatntctcngacaacacacccgacaacgccccagtcatgattangacgtcactaatccggccctcgaggggtntctaagtcgtcttcctctggtacctcctaagtctggccaaacgaccggccctccctgaccatctcgtggctccgaggctggaggacgagtctagtattattacngacagtctatatataccaagtctaaagtaattacgttcgttaccgtttcggaacggaacggaccagttcgtacgtaccgttcgttacggttccaacgcccgaagccctccggcccctcggttctaacccg

SEQ ID NO: 325297 - DNA, 501 bp, Homo sapiens
  misc_feature: GZ8MTXP01C6WUH.39.11.A11.1.454.CMB.2.raw
  modified_base (368)..(368): a, c, t, g, unknown or other
  misc_feature (368)..(368): n is a, c, g, or t
  modified_base (412)..(412): a, c, t, g, unknown or other
  misc_feature (412)..(412): n is a, c, g, or t
  modified_base (470)..(470): a, c, t, g, unknown or other
  misc_feature (470)..(470): n is a, c, g, or t
  modified_base (493)..(501): a, c, t, g, unknown or other
  misc_feature (493)..(501): n is a, c, g, or t
tcagtcgcactagtcacgaccggtgctcgatttagctacgactgcagggcctctggaggcaccttcaatagttatgtcatcacttgggtgcgacaggcccctggacaagggcttgagtgggtgggagggatcatctctatgtttggaacacccatgtttggtacaccaagttacgcacagaagttccagggcagagtcacgattaccgcggacgaatctacgagcacagcctacatggcgctgagaagtctgagatctgaggacacggccgtctatttctgtgcgagaggacgcggggtatcacttaagtagcgcgggcgactactgggggccaggggaaccctggtccaccgtctcctcagccctcnccaagggcccatcgtctcccctgcaccctcctccagacgcaccnctggggcacgagcgccctgggctggcctggtcaaggactactccactagtgcgactgngcgggcttggcaggcgcagttgnnnnnnnnn

SEQ ID NO: 325298 - DNA, 503 bp, Homo sapiens
  misc_feature: GZ8MTXP01CLG9I.39.11.A11.1.454.CMB.2.raw
  modified_base (293)..(293): a, c, t, g, unknown or other
  misc_feature (293)..(293): n is a, c, g, or t
  modified_base (313)..(313): a, c, t, g, unknown or other
  misc_feature (313)..(313): n is a, c, g, or t
  modified_base (321)..(321): a, c, t, g, unknown or other
  misc_feature (321)..(321): n is a, c, g, or t
  modified_base (410)..(410): a, c, t, g, unknown or other
  misc_feature (410)..(410): n is a, c, g, or t
tcagtcgcactagtcacgaccggtgctcgatttagctacgactgcaggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgctcaccatctcctgcactggaaccagcagtgacgttggtgttacaactatgtctcctggtaccaacaacacccggcaaagcccccaagtcatgatttangacgtcactaatcggccctnagggggtntctaatcgcttcctctggctccaagtctggcaacacggcctccctgacccatctctggctccgaggctgaggacgaggctgattatacngcagctcatattcaagcaagtatactgtctttcggcggaggacaagctagccgttccgttgttcaagcccaaggctcgcccctggcctaaccg

SEQ ID NO: 325299 - DNA, 688 bp, Homo sapiens
  misc_feature: GZ8MTXP01C4F9D.39.11.A11.1.454.CMB.2.raw
  modified_base (193)..(193): a, c, t, g, unknown or other
  misc_feature (193)..(193): n is a, c, g, or t
  modified_base (223)..(223): a, c, t, g, unknown or other
  misc_feature (223)..(223): n is a, c, g, or t
  modified_base (337)..(337): a, c, t, g, unknown or other
  misc_feature (337)..(337): n is a, c, g, or t
tcagtcgcactagtcacgaccggtgctcgatttagctacgactgcagggggggtctcaggaggcagcgctctcaggacatctccaccatggcctgggctctgctgctcctccaccctcctcactcgagggcacgagggtcctgggcccagtctgccctgactcagcctgcctcgtgtctggtctccgtggacngtcgctcacatcctctgcacgtaggaaccngcagtgacgttggtacgttaacaactatgtctctgaccaacacacccgacaaacgccccgaagtcatagtatttatgacgtacaactaacgtccggcccttaggacgggggttntacttaaacgtcgtcctttccctcgtcggcctaccgaaagttcctaggccaaaccgacccgggtccccttcccgtcgacctactcctcgtgggcctcgaggtctagggacggacggaggtctaggtatttacgttactcggactaacggtcttacctattaactttaaccgaaaggtacctaaagtttaaacgttaaacccgtttacggtttccccggtttttacggggaacccggggttaacgggaaccccgtaaagttccgttacggtacccggtttaccgttacgggttaccgaaccggacccgaacgggtccgtcccggttacccccgttcgggttcccttaacccg

SEQ ID NO: 325300 - DNA, 524 bp, Homo sapiens
  misc_feature: GZ8MTXP01CIBRJ.39.11.A11.1.454.CMB.2.raw
  modified_base (221)..(221): a, c, t, g, unknown or other
  misc_feature (221)..(221): n is a, c, g, or t
  modified_base (297)..(297): a, c, t, g, unknown or other
  misc_feature (297)..(297): n is a, c, g, or t
  modified_base (323)..(323): a, c, t, g, unknown or other
  misc_feature (323)..(323): n is a, c, g, or t
  modified_base (337)..(337): a, c, t, g, unknown or other
  misc_feature (337)..(337): n is a, c, g, or t
tcagtcgcactagtcacgaccggtgctcgatttagctacgactgcaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgctcaccatctcctgcactggaaccngcagtgacgttggtaggttacactatgtctctggaccaacaacaccccggcaaacgcccccgaagtcatgatttangactcactaatcgccctgagggggtntctaatcgcttccnctgctccaagtctggcacacggcctcctgaccatctctgggcctcaggctggagacgagctgtattatactgcagctcaattatcaagctagtaactactgttccgtttggaacggtacggaccaaaggctacggccgttcgttaggttccaacgcccgaaggtcctccgccccgtcggcctaaccc

SEQ ID NO: 325301 - DNA, 564 bp, Homo sapiens
  misc_feature: GZ8MTXP01EQN29.39.11.A11.1.454.CMB.2.raw
  modified_base (190)..(190): a, c, t, g, unknown or other
  misc_feature (190)..(190): n is a, c, g, or t
  modified_base (194)..(194): a, c, t, g, unknown or other
  misc_feature (194)..(194): n is a, c, g, or t
  modified_base (219)..(219): a, c, t, g, unknown or other
  misc_feature (219)..(219): n is a, c, g, or t
  modified_base (287)..(287): a, c, t, g, unknown or other
  misc_feature (287)..(287): n is a, c, g, or t
  modified_base (313)..(313): a, c, t, g, unknown or other
  misc_feature (313)..(313): n is a, c, g, or t
  modified_base (398)..(398): a, c, t, g, unknown or other
  misc_feature (398)..(398): n is a, c, g, or t
tcagtcgcactagtcacgaccggtgctcgatttagctacgactgcaggggggggtctcaggaggcagcgctctcaggacatctccaccatggcctgggctctgctgctcctcaccctcctcactcagggcacagggtcctgggcccagtctgccctgactcagcctgcctcgtgtctggtctcctggacngtcnctcaccatctcctgcactggaaccngcagtgacgttggtgttacatatgtctctgaccaacaccacccgacaacgccccgagtcatgtattangacgtcaactatccgccctgagggtntactatcgtcttcctctggctacgaacgtctcggccaaaccgcccggtcccctcgacctactactccgtcggcgtacctcggcgngtaggacggacggtgtatagttattactacgtcacggcttactattagtactaacgatagttaacgtacttgttccgtttacgggcgggaacggtacacgtcgttcgtaccgtacacggttcgacgaaccgacgtccgtccgtcccgccgttaacgttcccttccg

SEQ ID NO: 325302 - DNA, 511 bp, Homo sapiens
  misc_feature: GZ8MTXP01AQFI4.39.11.A11.1.454.CMB.2.raw
  modified_base (218)..(218): a, c, t, g, unknown or other
  misc_feature (218)..(218): n is a, c, g, or t
  modified_base (319)..(319): a, c, t, g, unknown or other
  misc_feature (319)..(319): n is a, c, g, or t
  modified_base (415)..(415): a, c, t, g, unknown or other
  misc_feature (415)..(415): n is a, c, g, or t
tcagtcgcactagtcacgaccggtgctcgatttagctacgactgcaggggggtctcaggaggcagcgctctcaggacatctccaccatggcctgggctctgctgctcctcaccctcctcactcaggcacagggtcctgggcccagtctgccctgactcagcctgcctccgtgtctgggtctcctggacagtcgctcaccatctcctgcactggaaccngcagtgacgttggtgttacaactatgtctctgaccaacacacccggcaaacgcccccgaagtcatgatttatgacgtcactaatcggccctcgagggggtntctaatcgcttcctctggctccaagtctggcacacggcctcctgacatctctgggctccgaggctgacggacgaggctgtattatactgcagctanatatacagactaataatcgtcgttccgtttcgggcggacggacacgcgtacgtaccgttcgttcgcgaacgccgaacgctccgcccgtcgttcctc

SEQ ID NO: 325303 - DNA, 593 bp, Homo sapiens
  misc_feature: GZ8MTXP01D6JR6.39.11.A11.1.454.CMB.2.raw
  modified_base (218)..(218): a, c, t, g, unknown or other
  misc_feature (218)..(218): n is a, c, g, or t
  modified_base (293)..(293): a, c, t, g, unknown or other
  misc_feature (293)..(293): n is a, c, g, or t
  modified_base (323)..(323): a, c, t, g, unknown or other
  misc_feature (323)..(323): n is a, c, g, or t
tcagtcgcactagtcacgaccggtgctcgatttagctacgactgcaggggggggtctcaggaggcagcgctctcaggacatctccaccatggcctgggctctgctgctcctcaccctcctcactcagggcacagggtcctgggcccagtctgccctgactcagcctgcctcgtgtctggtctcctggacagtcgctcaccatctctgcactggaaccngcagtgacgttggtgttacaatatgtctctgaccaacaaccaccccgacaaacgcccccgaagtcatgtatttangactcactaactccggccctgagggggttntactaatcgtcttcctcgtggctccaagtctaggcaacaccggtccctccctagaccctatccctcgtcgggcctaccgaggcgtggaacgggacgtaggtactagtaatttacttaacgtcgactaacgtccttactattaacttaccgaagtctaaagttactacgttcgttaccgtttgggaacggtacggaccaacgttcgtacgtaccgttcgttacggttccaacggaccaacggtcccgtccgccccgttggttcctaacccg

SEQ ID NO: 325304 - DNA, 536 bp, Homo sapiens
  misc_feature: GZ8MTXP01AVXQU.39.11.A11.1.454.CMB.2.raw
  modified_base (295)..(295): a, c, t, g, unknown or other
  misc_feature (295)..(295): n is a, c, g, or t
  modified_base (325)..(325): a, c, t, g, unknown or other
  misc_feature (325)..(325): n is a, c, g, or t
  modified_base (362)..(362): a, c, t, g, unknown or other
  misc_feature (362)..(362): n is a, c, g, or t
tcagtcgcactagtcacgaccggtgctcgatttagctacgactgcagggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgctcaccatctcctgcactggaaccagcagtgacgttggtgttacactatgtctctggaccaacaaccaccccggcaaacgcccccgaagtcatgatttangacgtcactaatcggaccctcgagggggtntctaatcgtcttccctctggctccaagtctggcaacncggccctccctgaccatcctctgggcctcgaggctggacggagagctgattatactgcacgctcattatcgaagctaagtaatactcgttccgtttggcggtaacggaccaaagcgttacgaccgttccgttggttccaacggacccaaggcctccggcccctcggttctcccg

SEQ ID NO: 325305 - DNA, 580 bp, Homo sapiens
  misc_feature: GZ8MTXP01ALGCZ.39.11.A11.1.454.CMB.2.raw
  modified_base (220)..(220): a, c, t, g, unknown or other
  misc_feature (220)..(220): n is a, c, g, or t
  modified_base (290)..(290): a, c, t, g, unknown or other
  misc_feature (290)..(290): n is a, c, g, or t
  modified_base (320)..(320): a, c, t, g, unknown or other
  misc_feature (320)..(320): n is a, c, g, or t
  modified_base (334)..(334): a, c, t, g, unknown or other
  misc_feature (334)..(334): n is a, c, g, or t
  modified_base (345)..(345): a, c, t, g, unknown or other
  misc_feature (345)..(345): n is a, c, g, or t
  modified_base (350)..(350): a, c, t, g, unknown or other
  misc_feature (350)..(350): n is a, c, g, or t
  modified_base (358)..(358): a, c, t, g, unknown or other
  misc_feature (358)..(358): n is a, c, g, or t
  modified_base (376)..(376): a, c, t, g, unknown or other
  misc_feature (376)..(376): n is a, c, g, or t
tcagtcgcactagtcacgaccggtgctcgatttagctacgactgcaggggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcgctcaccatctcctgcactggaaccngcagtgacgttggtgttacactatgtctctgaccaacaacacccgcaacgcccccgaagtcatgatttangacgtcactaacgtcggccctcgaggggtntactatcgcttccnctgctcagtcngcacncgcctccngaccatctctcggctcgngctgacggcgagctagtattattactgcgacgtctctaagttacttacaaagtctaaacgttaacttaccgttcgttacccggttttcgggaacgggtaacgggacccgtaaacggttccgttacggtacccgttccgttacggaccgaacggaccccgtaacgggtccctacccgggcccccgttccggttcccttaaccccg

SEQ ID NO: 325306 - DNA, 733 bp, Homo sapiens
  misc_feature: GZ8MTXP01B2EUK.39.11.A11.1.454.CMB.2.raw
  modified_base (220)..(220): a, c, t, g, unknown or other
  misc_feature (220)..(220): n is a, c, g, or t
tcagtcgcactagtcacgaccggtgctcgatttagctacgactgcaggggggggtctcaggaggcagcgctctcaggacatctccaccatggcctgggctctgctgctcctcaccctcctcactcagggcacaggttcctgggcccagtctgccctgactcagcctgcctccgtgtctgggtctcctggacagtcgctcaccatctctgcactggaaccngcagtgacgttggtgtacactatgtctctaggaccaacaacacccggacaaacgcccccgaagtcatgtattatgacgtcaactaactccggaccctgagggggtctacgtaaactcggtcctttcctcgtggtcctacccaaagttccgttacgggccctaaaccgacccgggtccccttaccccgttacgaacccctaacgttcccgttccggttcgggggtcccttacccgggacgggttaccctaggggaaacggggacccggaaagggttccgttaggtaaactttaaactttaacgtcggtaaccgtaacggttccttaacgtaaacgtttaacttaaccgaaacggtacctaaaggtttaaacttaaccgtttcggtttcccgttttacggggaacgggtaaacgggttaccgaaacggttcgttaacccggtaccgttaccggttacgttccgtaacgcccgtaacggtcccgtccggttccccccgtcggttaacccgtccccg

SEQ ID NO: 325307 - DNA, 681 bp, Homo sapiens
  misc_feature: GZ8MTXP01D5096.39.11.A11.1.454.CMB.2.raw
  modified_base (192)..(192): a, c, t, g, unknown or other
  misc_feature (192)..(192): n is a, c, g, or t
  modified_base (196)..(196): a, c, t, g, unknown or other
  misc_feature (196)..(196): n is a, c, g, or t
tcagtcgcactagtcacgaccggtgctcgatttagctacgactgcaggggggggtctcagaaggcagcgctctcaggacatctccaccatggcctgggctctggtgctcctcaccctcctcactcagggcacaggttcctgggcccagtctgccctgactcagcctgcctccgtgtctgggtctcctggacngtcnctcaccatcctcctgcacgtggaaccagcagtgacgttggtagttacaactatgtctctaggtaccaaacaaccaccccggacaaaccgcccccgaagtcatgtatttatgtacgtcaactaactccggccctcgtagggggtctactaactcgtcttctcctcggctaccgaagtccgtagggaccaaccgacggtcccctcccctagaccctatcctcgtcgggcctccgacgggtccgtaggacgggaaccggaggtcttaggactttaacttaacgttgacccgtagggtccttaacgtaactttaactttaacgaaacgtacgttaaaggtttaaaactttaccgtttcggttttccccggttttcgggggaacgggtaaacgggtaccgaaacggtccgttacggtacccgttaccgttaggttccgaaccgcccgaaacggtcccgtcccgccccgttcggtcccttccgtttccccg

SEQ ID NO: 325308 - DNA, 671 bp, Homo sapiens
  misc_feature: GZ8MTXP01CJA8G.39.11.A11.1.454.CMB.2.raw
  modified_base (195)..(195): a, c, t, g, unknown or other
  misc_feature (195)..(195): n is a, c, g, or t
  modified_base (224)..(224): a, c, t, g, unknown or other
  misc_feature (224)..(224): n is a, c, g, or t
tcagtcgcactagtcacgaccggtgctcgatttagctacgactgcagggggggtctcaggaggcagcgctctcaggacatctccaccacccctggcctgggctctgctgctcctcaccctcctcactcagggcacagggtcctgggcccagtctgccctgactcagcctgcctccgtgtctgggtctcctggacngtcgctcaccatctcctgcactggaaccngcagtgacgttggtgttacactatgtctcctggtaccaacaacaccccggcaaacgcccccgaagtcatgatttatgacgtacactaatccggccctcgaggggtgtctaagtcgtcttcctctggctccaagtctggcaacaccggccctccctgaccctatccttctcgggccttccgacgggccgttaggaacggggaccggaagggtccttagggtaactttaactttaccgttacggccgtaacggttccttacgaactttactttacccgaaaggtacctaaaggttaaacttacgttacgtttacccgtttttccggggaacgggtaacgggaaccctaaaggttccgttacggaccccggtttacgttacgggttaccgaaccggaccccgtaaacgggtccccttccggaccccccttccgggttaaccttaaccccg

SEQ ID NO: 325309 - DNA, 508 bp, Homo sapiens
  misc_feature: GZ8MTXP01AW8D8.39.11.A11.1.454.CMB.2.raw
  modified_base (221)..(221): a, c, t, g, unknown or other
  misc_feature (221)..(221): n is a, c, g, or t
  modified_base (269)..(269): a, c, t, g, unknown or other
  misc_feature (269)..(269): n is a, c, g, or t
  modified_base (294)..(294): a, c, t, g, unknown or other
  misc_feature (294)..(294): n is a, c, g, or t
  modified_base (322)..(322): a, c, t, g, unknown or other
  misc_feature (322)..(322): n is a, c, g, or t
tcagtcgcactagtcacgaccggtgctcgatttagctacgactgcagggggggtctcaggaggcagcgctctcaggacatctccaccatggcctgggctctgctgctcctcaccctcctcactcagggcacagggtcctgggcccaagtctgccctgactcagcctgcctccgtgtctgggtctcctggacagtcgctcaccatctcctgcactggaaccngcagtgacgttggtgttacactatgtctctggaccaacacaccccggnaaacgcccccgaagtcatgatttangacgtcactaatcggccctcgaggggtntctaatcgcttctctggctccaagtctggcaacacgcctccctgaccatctctgggctccaggctgaggacgaggctgattatactgcgagctcatattcagcaagtatactgtcctttcggcggtaggaccaagcgtacgccgttcgttagttcaagccgaagcctcgcccctcggttcgtaacc

SEQ ID NO: 325310 - DNA, 614 bp, Homo sapiens
  misc_feature: GZ8MTXP01AMWXM.39.11.A11.1.454.CMB.2.raw
  modified_base (219)..(219): a, c, t, g, unknown or other
  misc_feature (219)..(219): n is a, c, g, or t
  modified_base (260)..(260): a, c, t, g, unknown or other
  misc_feature (260)..(260): n is a, c, g, or t
  modified_base (266)..(266): a, c, t, g, unknown or other
  misc_feature (266)..(266): n is a, c, g, or t
  modified_base (290)..(290): a, c, t, g, unknown or other
  misc_feature (290)..(290): n is a, c, g, or t
  modified_base (296)..(296): a, c, t, g, unknown or other
  misc_feature (296)..(296): n is a, c, g, or t
  modified_base (319)..(319): a, c, t, g, unknown or other
  misc_feature (319)..(319): n is a, c, g, or t
tcagtcgcactagtcacgaccggtgctcgatttagctacgactgcagggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcgctcaccatctcctgcactggaaccngcagtgacgttggtgttacactatgtctctggacaacaacncccggnaaacgccccgaagtcatgatttangacgtnaactaagtcggccctgaggggtntactaatcgcttctctggctcagtctggcaacgaccgcctcccgtgaccatctcgtgggcctcgaggcgtagacgggacgaggtctaggtatttacgtactgaccgagtcctataattaacttccgaaagtacctaaaggttaaacttcgttacggtttcccgttttcggggaacgggtaacggggttaacccgaaaggttccgttaacgggtaaccccgttcccgttaaggggttcccaacggccccgaaagggttccccgccggttaccccccgttcggttaaccccgtcccg

SEQ ID NO: 325311 - DNA, 619 bp, Homo sapiens
  misc_feature: GZ8MTXP01DBZ7Q.39.11.A11.1.454.CMB.2.raw
  modified_base (241)..(241): a, c, t, g, unknown or other
  misc_feature (241)..(241): n is a, c, g, or t
  modified_base (289)..(289): a, c, t, g, unknown or other
  misc_feature (289)..(289): n is a, c, g, or t
  modified_base (316)..(316): a, c, t, g, unknown or other
  misc_feature (316)..(316): n is a, c, g, or t
tcagtcgcactagtcacgaccggtgctcgatttagctacgactgcaggggggggtctcaggaggcagcgctctcaggacatctccaccatggcctgggctctgctgctcctcaccctcctcactcagggcacagggtcctgggcccagtctgccctgactcagcctgcctcgtgtctgggtctccgtggacagtcgctcacatctctgcactggaaccagcagtgacgttggtgttacatntgtctctgaccaacaccacccgacaaacgccccgaagtcatgatttangacgtcactactccggccctgagggtntactaatcgtcttcctctgctcaagtcctaggccaaaccgccggtaccctccctacgacctactctcgtgggcctcgaggcctaggacgggacgaggtctagtactttaagtacgttgacgtacgtctactaattactaccaagtcctaaaggttaacttccgttacggtttcccggtttacgggaaccgggtaaacgggacctaaacggttccgttacggtacccgttacggttacgggttacccgaaccggacccgtaaccggtcccgtcccggttcccccgtaacggttccttaaccccg

SEQ ID NO: 325312 - DNA, 629 bp, Homo sapiens
  misc_feature: GZ8MTXP01CYHXD.39.11.A11.1.454.CMB.2.raw
  modified_base (221)..(221): a, c, t, g, unknown or other
  misc_feature (221)..(221): n is a, c, g, or t
  modified_base (285)..(285): a, c, t, g, unknown or other
  misc_feature (285)..(285): n is a, c, g, or t
  modified_base (292)..(292): a, c, t, g, unknown or other
  misc_feature (292)..(292): n is a, c, g, or t
  modified_base (321)..(321): a, c, t, g, unknown or other
  misc_feature (321)..(321): n is a, c, g, or t
tcagtcgcactagtcacgaccggtgctcgatttagctacgactgcaggggggggtctcaggaggcagcgctctcaggacatctccaccatggcctgggctctgctgctcctcaccctcctcactcaggcacaggttcctgggcccagtctgccctgactcagcctgcctccgtgtctggtcctccgtggacagtcgctcaccatcctctgccactgaaccngcagtgacgttggtgtacactatgtctctgaccaacaccgacccgacaacgccccgaagtcatntatttangacgtcaactaagtccgccctgaggggtntactactcgtcttcctcgtcgctaccgaagtcgtgaaccacgtaccgggcccttcccgtacgaccctactccgtctcgggccctacccgtagggcttcgggaacgggccgtaagggtccttaggtacgtttaacgtacgtggtacacgttcctactaattacgttaccaaacggtactaaacgttaactaccgtttacggttccgttttacggggaaccgggtaaacggttactaaacgcgtacgtacccgttacgttacgttcgaacacccgaagtccctaccgttcccccgtgttccttaacccgg

SEQ ID NO: 325313 - DNA, 623 bp, Homo sapiens
  misc_feature: GZ8MTXP01AYXSM.39.11.A11.1.454.CMB.2.raw
  modified_base (274)..(274): a, c, t, g, unknown or other
  misc_feature (274)..(274): n is a, c, g, or t
  modified_base (297)..(297): a, c, t, g, unknown or other
  misc_feature (297)..(297): n is a, c, g, or t
tcagtcgcactagtcacgaccggtgctcgatttagctacgactgcaggggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcgctcaccatcctcctgcactggaaccagctaagtgtacgttggtagttacaactatgtctctgaccaacaaccacccganaaacgccccaagtcatgatttangacgtcaactaatccggccctagagggggtctactaagtcgtctttccgtctgctcgaagtctcggctaaccgaccggtccctacccgtcgacctatccgtcgtcgggtcctaccgaggtactgggaacggacgtagggtcctaggtatttaacgttacgtcgacgtaacgtcctactaacttacttaaccgaagtacctaaagttaactacgtttcgttccgtttgggaacggtaacgggttaccaaggttccgtacggaccgttacgttcggttaccaacggacccgtaacggtcctcccgccccgttaacggttcccgtcccg

SEQ ID NO: 325314 - DNA, 506 bp, Homo sapiens
  misc_feature: GZ8MTXP02H6IIB.39.11.A11.1.454.CMB.2.raw
  modified_base (432)..(432): a, c, t, g, unknown or other
  misc_feature (432)..(432): n is a, c, g, or t
  modified_base (474)..(474): a, c, t, g, unknown or other
  misc_feature (474)..(474): n is a, c, g, or t
tcagtcgcactagtcacgaccggtgctcgatttagctacgactgcagggggtctcaggaggcagcgctctcaggacatctccaccatggcctgggctctgctgctcctcaccctcctcactcagggcacagggtcctgggcccagtctgccctgactcagcctgcctccatgtctgggtctcctggacagtcgatcaccatctcctgcactggaaccagcagtgacgttggtggttataactatgtctcttggtaccaacatcacccaggcaaagtccccaaaactgatgatttatgaggtcactaaacggcctcaggggtttcaatcgctctctggctccaagtctggcaacaccggcctccctgaccatcctctgggctcaggctgaggacgaggctctctattattgcagctcatatacagtcatttanctacgttgggtcgttcggacggtagggaccgactgaccgttntaggtcacgcccaaggcctcgccccctggtcc

SEQ ID NO: 325315 - DNA, 507 bp, Homo sapiens
  misc_feature: GZ8MTXP02IRSHO.39.11.A11.1.454.CMB.2.raw
  modified_base (298)..(298): a, c, t, g, unknown or other
  misc_feature (298)..(298): n is a, c, g, or t
  modified_base (324)..(324): a, c, t, g, unknown or other
  misc_feature (324)..(324): n is a, c, g, or t
  modified_base (358)..(358): a, c, t, g, unknown or other
  misc_feature (358)..(358): n is a, c, g, or t
tcagtcgcactagtcacgaccggtgctcgatttagctacgactgcagggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgctcaccatctcctgcactggaaccagcagtgacgttggtggttacaactatgtctcctggtaccaacaacaccccggacaaacgcccccgaagtccatgatttangacgtcactaatcggccctgagggtntctaatcgcttctctggctccaagtctggcaacncggccctccctgaccatctctggcctcagctgagcgagctgatatactgcagctcatatcaagcagtaaatctgtcctttcggacggtaggaccaaggtctcgacctcgtaggtacaacgccccgaagcctcgccccctcggtctaccg

SEQ ID NO: 325316 - DNA, 674 bp, Homo sapiens
  misc_feature: GZ8MTXP02FXNBX.39.11.A11.1.454.CMB.2.raw
  modified_base (194)..(194): a, c, t, g, unknown or other
  misc_feature (194)..(194): n is a, c, g, or t
  modified_base (293)..(293): a, c, t, g, unknown or other
  misc_feature (293)..(293): n is a, c, g, or t
tcagtcgcactagtcacgaccggtgctcgatttagctacgactgcagggggggtctcaggaggcagcgctctcaggacatctccaccatggcctgggctctgctgctcctcaccctcctcactcagggcacagggtcctgggcccagtctgccctgactcagcctgcctccgtgtctggtctcctggacagtcnctcaccatcctcctgcactggaaccagcagtgacgttggtagttacaatatgtctctgtaccaacaccacccgacaaacgccccgaagtcatgtattangactacactactccggcctgagggttctactatcgtcttcctcgtcgctaccgtaagtccgtcggacctaaccgaccggtccctaccccgtacgaaccctacgttcctccggttcgggtcccttacccgtaacggttccgtaggaaacggggtaccgtaagggtctttaggtaaactttatttaaccgtgactaacgtccttaactaattaacttaccaaagtactaagtttaaactacgttacgtttcccggtttacgggaacggtaacgggaaaccaacggtccgttacgggtaaccccgtttaccgaggggttaacccaaccggtacccgtaaacgggtccctaccccggtcccccgttacggtaccctttaccccgg

SEQ ID NO: 325317 - DNA, 563 bp, Homo sapiens
  misc_feature: GZ8MTXP02I93Y3.39.11.A11.1.454.CMB.2.raw
  modified_base (297)..(297): a, c, t, g, unknown or other
  misc_feature (297)..(297): n is a, c, g, or t
  modified_base (317)..(317): a, c, t, g, unknown or other
  misc_feature (317)..(317): n is a, c, g, or t
  modified_base (323)..(323): a, c, t, g, unknown or other
  misc_feature (323)..(323): n is a, c, g, or t
tcagtcgcactagtcacgaccggtgctcgatttagctacgactgcagggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgctcaccatctcctgcactggaaccagcagtgacgttggtgttacaactatgtctctggtaccaacaacaccccggcaaacgcccccgaagtccatgatttangacgtcactaatcggccctnagggtntctaatcgcttcctctggctccaagtctggcaacacggccctccgtcgaccatcctcgtggggccttcccgaggctaggaggtaccgagggctgatttattacgtgcagtctactatattcaagtcaagtaactcgtagttcccgtttacgggacggtacgggtaaccaaggtccttacggacccgttaccgtaggtccaacggcccgaaggtccgtaccgccccccgtggtacctcccg

SEQ ID NO: 325318 - DNA, 518 bp, Homo sapiens
  misc_feature: GZ8MTXP02IW9W9.39.11.A11.1.454.CMB.2.raw
  modified_base (221)..(221): a, c, t, g, unknown or other
  misc_feature (221)..(221): n is a, c, g, or t
  modified_base (298)..(298): a, c, t, g, unknown or other
  misc_feature (298)..(298): n is a, c, g, or t
  modified_base (310)..(310): a, c, t, g, unknown or other
  misc_feature (310)..(310): n is a, c, g, or t
  modified_base (324)..(324): a, c, t, g, unknown or other
  misc_feature (324)..(324): n is a, c, g, or t
tcagtcgcactagtcacgaccggtgctcgatttagctacgactgcagggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgctcaccatcctcctgcactggaaccngcagtgacgttggtgttacaactatgtctctggtaccaacaacaccccggcaaacgcccccgaagtccatgatttangacgtcactaancggccctgagggtntctaatcgcttcctctgctcaatctggcaacacggcctccctgaccatctcgtggcctccaggctgaggacgaggctagattattactgcagctcattatacaagcagtaatctagttctttcggcggtaggtaccaacgtctacgtaccgtactaggtaccaacgcccaaggcctcgccccctcggtctaccg

SEQ ID NO: 325319 - DNA, 516 bp, Homo sapiens
  misc_feature: GZ8MTXP02G7UPB.39.11.A11.1.454.CMB.2.raw
  modified_base (296)..(296): a, c, t, g, unknown or other
  misc_feature (296)..(296): n is a, c, g, or t
  modified_base (322)..(322): a, c, t, g, unknown or other
  misc_feature (322)..(322): n is a, c, g, or t
tcagtcgcactagtcacgaccggtgctcgatttagctacgactgcaggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgctcaccatctcctgcactggaaccagcagtgacgttggtgttacaactatgtctcctggtaccaacaacaccccggcaaacgcccccgaagtcatgatttangacgtcactaatcggccctgagggtntctaatcgcttcctctgctccaagtctggcaacacggcctcctgaccatctctggctccaggctgagacgagctgattatactgcagctacatattacaagcaagtaatactagtctttcgggacgtagggaccaagctacgaccgtccgtaggtccaaggcccaaacggacccaacccgactcgtacctaacc

SEQ ID NO: 325320 - DNA, 640 bp, Homo sapiens
  misc_feature: GZ8MTXP02F7GAJ.39.11.A11.1.454.CMB.2.raw
  modified_base (192)..(192): a, c, t, g, unknown or other
  misc_feature (192)..(192): n is a, c, g, or t
  modified_base (196)..(196): a, c, t, g, unknown or other
  misc_feature (196)..(196): n is a, c, g, or t
  modified_base (296)..(296): a, c, t, g, unknown or other
  misc_feature (296)..(296): n is a, c, g, or t
  modified_base (322)..(322): a, c, t, g, unknown or other
  misc_feature (322)..(322): n is a, c, g, or t
tcagtcgcactagtcacgaccggtgctcgatttagctacgactgcgagggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacngtcnctcaccatctcctgcactggaaccagcagtgacgttggtgttacaactatgtctctggtaccaacaccacccgacaaacgcccccgaagtcatgatttangacgtcactaatccgccctgagggtntactaagtcgtctttccgtactcggtcctaccgtaagtccgtagggaccaaaccgtacccgggtccccttaccccgtacgaaccctattcccgtccgtcggggtcctacccgaaggtcctagggaacggaccgaacgggtcttaggtaaactttacgtttaaccgtgacgtacgtcttactaatactttaacaaaggactaagttaaacttcgttacgttccgttttcgggacgggtacggaccgtaaacgcgtacgtacccgttaccgtaggtaccgaacgacccgaacggccctaccgccccgtcggtacctaccg

SEQ ID NO: 325321 - DNA, 607 bp, Homo sapiens
  misc_feature: GZ8MTXP02JK6DK.39.11.A11.1.454.CMB.2.raw
  modified_base (300)..(300): a, c, t, g, unknown or other
  misc_feature (300)..(300): n is a, c, g, or t
tcagtcgcactagtcacgaccggtgctcgatttagctacgactgcagggggggtctcagaaggcagcgctctcaggacatctccaccatggcctgggctctgctgctcctcaccctcctcactcagggcacaggttcctgggcccagtctgccctgactcagcctgcctccgtgtctgggtctcctggacagtcgctcaccatctcctgcactggaaccagcagtgacgttggtgttacaactatgtctcctggtaccaacaaccaccccggacaaacgcccccgaagtccatgtattancgactacaactacgtccggtccctggagggtctactacgtcgtcttcctcgtcgtcctacgtacgtcgtcggaccaaccgaccggtccctcccgtacgaacctacttccgtccggtcgggtccctaccggacggtcgtagggacggacggaggtctagtaactttacttacgtcgcgtacgtcctactaattactaacgaagtacgtaagttaactacgttcgtttccgttcgggacggacggacacgtcgtacgtaccgtacgtagtcgaacgtaccgacgtccgtccgtccccgtcgtacctccg

SEQ ID NO: 325322 - DNA, 514 bp, Homo sapiens
  misc_feature: GZ8MTXP02JD305.39.11.A11.1.454.CMB.2.raw
  modified_base (365)..(365): a, c, t, g, unknown or other
  misc_feature (365)..(365): n is a, c, g, or t
  modified_base (417)..(417): a, c, t, g, unknown or other
  misc_feature (417)..(417): n is a, c, g, or t
tcagtcgcactagtcacgaccggtgctcgatttagctacgactgcagggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgctcaccatctcctgcactggaaccagcagtgacgttggtgttacaactatgtctctggtaccaacaacaccccggcaaacgcccccgaagtcatgatttatgacgtcactaatcggccctcagggtgtctaatcgtcttcctctgctcaagtctgcaacacggcctcccngaccatctctggcctccgaggctgagacgaggctgattattactgcagctanatattcaagcaagtaactactcgtaccgtttcggacggtagggaccaagtctacgaccgtctaggtcaacgccaacggctcgcccctcggactaccg

SEQ ID NO: 325323 - DNA, 562 bp, Homo sapiens
  misc_feature: GZ8MTXP02JUHTX.39.11.A11.1.454.CMB.2.raw
  modified_base (290)..(290): a, c, t, g, unknown or other
  misc_feature (290)..(290): n is a, c, g, or t
tcagtcgcactagtcacgaccggtgctcgatttagctacgactgcagggggggtctcagaaggcagcgctctcaggacatctccaccatggcctgggctctgctgctcctcaccctcctcactcagggcacaggttcctgggcccagtctgccctgactcagcctgcctccgtgtctgggtctcctggacagtcgctcaccatctcctgcactggaaccagcagtgacgttggtgttacaactatgtctctggtaccaacacacccgcaacgccccgagtcatgatttangacgtcactaatcggccctgaggggtgtctaatcgtcttccctctggctccaagtctggccaacacggtcctccctgacctatcctcgtcgggcctccaggctggaggaccgaggctagatttacttacgcgtacacgtctactatttgacctaaattcgaagttggaacggtctttaagtggtttaccgttagggaaaggttcggggaaccctaaaggtcacgtacgtcgttaacgtcgtacgacgaacccgaccggaacccacccgtacg

SEQ ID NO: 325324 - DNA, 581 bp, Homo sapiens
  misc_feature: GZ8MTXP02JOWMG.39.11.A11.1.454.CMB.2.raw
  modified_base (244)..(244): a, c, t, g, unknown or other
  misc_feature (244)..(244): n is a, c, g, or t
  modified_base (298)..(298): a, c, t, g, unknown or other
  misc_feature (298)..(298): n is a, c, g, or t
  modified_base (324)..(324): a, c, t, g, unknown or other
  misc_feature (324)..(324): n is a, c, g, or t
tcagtcgcactagtcacgaccggtgctcgatttagctacgactgcagggggggtctcaggaggcagcgctctcaggacatctccaccatggcctgggctctgctgctcctcaccctcctcactcagggcacaggttcctgggcccagtctgccctgactcagcctgcctccgtgtctgggtctcctggacagtcgctcaccatctcctgcactggaaccagcagtgacgttggtgttacaactntgtctctggtaccaacaaccaccccggacaaacgcccccgaagtcatgatttangactcactaatccggccctgagggtntctaatcgtcttctctgctcagtctgcaacgcggcctccctgaccatctcgtggctccgaggctggagacggagctgattatactgacagtctactagttattacgaacgtactaaggttaacttaacgttcgtttaccggttttaccgggacggggtaacgggtaccgaacggtacgttacggacccgttaccgtaacggtcgaaccgacccgtaaacggccgtacccggtcccccgttacggtacccttacccgg

SEQ ID NO: 325325 - DNA, 518 bp, Homo sapiens
  misc_feature: GZ8MTXP02FSKNN.39.11.A11.1.454.CMB.2.raw
  modified_base (390)..(390): a, c, t, g, unknown or other
  misc_feature (390)..(390): n is a, c, g, or t
tcagtcgcactagtcacgaccggtgctcgatttagctacgactgcaggggggtctcaggaggcagcgctctcaggacatctccaccatggcctgggctctgctgctcctcaccctcctcactcagggcacagggtcctgggcccagtctgccctgactcagcctgcctccatgtctgggtctcctggacagtcgatcaccatctcctgcactggaaccagcagtgacgttggtggttataactatgtctcttggtaccaacatcacccaggcaaagtccccaaactgatgatttatgaggtcactaaacggcctcgaggggtttctaatcgccttctctggctcaagtctgcaacacggcctccctgaccatctctgggctccaggctgnggacgaggctctctattattgcagctcatatacaagctattatctacgttgggtacgttcggcgggtacgggaccgacgtcgaccgtcgttaggtcgtacgcccaacggcctacgccccctcggtccc

SEQ ID NO: 325326 - DNA, 559 bp, Homo sapiens
  misc_feature: GZ8MTXP02FZW3A.39.11.A11.1.454.CMB.2.raw
  modified_base (190)..(190): a, c, t, g, unknown or other
  misc_feature (190)..(190): n is a, c, g, or t
  modified_base (325)..(325): a, c, t, g, unknown or other
  misc_feature (325)..(325): n is a, c, g, or t
tcagtcgcactagtcacgaccggtgctcgatttagctacgactgcagggggggtctcaggaggcagcgctctcaggacatctccaccatggcctgggctctgctgctcctcaccctcctcactcagggcacagggtcctgggcccagtctgccctgactcagcctgcctccgtgtctgggtctctggacngtcgctcacatctcctgcactggaaccagcagtgacgttggtagttacaactatgtctctgtaccaacaacaccccgacaaacgccccgaagtcatagatttatcgacgtcactaactcggccctcgaggggttntctaatcgtcttcctcgtgctaccaagtctggcaaccgcggacctccctagaccatctcgtcggcctacgaggctaggacggacgaggctagtattattactgctagctacatatacagctaagtaactcgtacgttccgtttcgggacggagggacctaacggcctcggtaacccgttcgtacggtccgaacgacccgaacggtccgaccgtcccccgttacggtcctacccg

SEQ ID NO: 325327 - DNA, 606 bp, Homo sapiens
  misc_feature: GZ8MTXP02INRIG.39.11.A11.1.454.CMB.2.raw
  modified_base (191)..(191): a, c, t, g, unknown or other
  misc_feature (191)..(191): n is a, c, g, or t
  modified_base (195)..(195): a, c, t, g, unknown or other
  misc_feature (195)..(195): n is a, c, g, or t
  modified_base (233)..(233): a, c, t, g, unknown or other
  misc_feature (233)..(233): n is a, c, g, or t
  modified_base (243)..(243): a, c, t, g, unknown or other
  misc_feature (243)..(243): n is a, c, g, or t
  modified_base (295)..(295): a, c, t, g, unknown or other
  misc_feature (295)..(295): n is a, c, g, or t
  modified_base (325)..(325): a, c, t, g, unknown or other
  misc_feature (325)..(325): n is a, c, g, or t
tcagtcgcactagtcacgaccggtgctcgatttagctacgactgcagggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacngtcnctcacatctcctgcactggaaccagcagtgacgttggngttacaactntgtctctgtaaccaacacaccccgacaaacgcccccgaagtcatgtatttangacgtcactaactccggccctgaggggttntactaatcgtcttcctcgtggctaccgtaagtctacggccaaaccgaccggccccttcccgtacgaccctacttcctcgtcgggccctccgaggtcctaggacggaccgaaggtctagtattacgttacgtgacagtctactaattagttaccaaagctaaagttaacttacttcgtttacccgtttcgggacgggtaacggaacctaagtcctacggtacccgtacgttagaccgaacggaccccaacggtcctacccggcccccgttcgtacctacccg

SEQ ID NO: 325328 - DNA, 569 bp, Homo sapiens
  misc_feature: GZ8MTXP02GXI6T.39.11.A11.1.454.CMB.2.raw
  modified_base (273)..(273): a, c, t, g, unknown or other
  misc_feature (273)..(273): n is a, c, g, or t
  modified_base (300)..(300): a, c, t, g, unknown or other
  misc_feature (300)..(300): n is a, c, g, or t
  modified_base (329)..(329): a, c, t, g, unknown or other
  misc_feature (329)..(329): n is a, c, g, or t
  modified_base (336)..(336): a, c, t, g, unknown or other
  misc_feature (336)..(336): n is a, c, g, or t
  modified_base (369)..(369): a, c, t, g, unknown or other
  misc_feature (369)..(369): n is a, c, g, or t
tcagtcgcactagtcacgaccggtgctcgatttagctacgactgcagggggggtctcaggaggcagcgctctcaggacatctccaccatggcctgggctctgctgctcctcaccctcctcactcagggcacagggtcctgggcccagtctgccctgactcagcctgcctccgtgtctggtctcctggacagtcgctcaccatctcctgcactggaaccagcagtgacgttggtagttacaactatgtctctgtaaccaacaaccaccccgganaaaccgcccccgaagtcatagatttancgactacactaatccggccctgaggggtntactaanccgtcttcctctcgctacaagtctaggccaacncggtccctcctacgacatcctcgtggcctcgaggctaggacggaccgaggtactagtatttaattactgacagtctacattatacaaagtactaagtaactacttcgttaccgtttcggacggtacggacaacgcgtacgaccgtcgtacggtacgaacgacccgaaggtcccgtaccgtcccccgtacgtaccctaccg

SEQ ID NO: 325329 - DNA, 544 bp, Homo sapiens
  misc_feature: GZ8MTXP02FWMUM.39.11.A11.1.454.CMB.2.raw
  modified_base (269)..(269): a, c, t, g, unknown or other
  misc_feature (269)..(269): n is a, c, g, or t
  modified_base (287)..(287): a, c, t, g, unknown or other
  misc_feature (287)..(287): n is a, c, g, or t
  modified_base (292)..(292): a, c, t, g, unknown or other
  misc_feature (292)..(292): n is a, c, g, or t
  modified_base (317)..(317): a, c, t, g, unknown or other
  misc_feature (317)..(317): n is a, c, g, or t
  modified_base (325)..(325): a, c, t, g, unknown or other
  misc_feature (325)..(325): n is a, c, g, or t
  modified_base (358)..(358): a, c, t, g, unknown or other
  misc_feature (358)..(358): n is a, c, g, or t
  modified_base (363)..(363): a, c, t, g, unknown or other
  misc_feature (363)..(363): n is a, c, g, or t
  modified_base (367)..(367): a, c, t, g, unknown or other
  misc_feature (367)..(367): n is a, c, g, or t
  modified_base (372)..(372): a, c, t, g, unknown or other
  misc_feature (372)..(372): n is a, c, g, or t
  modified_base (381)..(381): a, c, t, g, unknown or other
  misc_feature (381)..(381): n is a, c, g, or t
  modified_base (393)..(393): a, c, t, g, unknown or other
  misc_feature (393)..(393): n is a, c, g, or t
tcagtcgcactagtcacgaccggtgctcgatttagctacgactgcagggggggtctcaggaggcagtgctctcaggacatctccaccatggcctgggctctgctgctcctcaccctcctcactcagggcacagggtcctgggcccagtctgccctgactcagcctgcctccgtgtctgggtctcctggacagtcgctcaccatctcctgcactggaaccagcagtgacgttggtgttacaactatgtctctgtaccaacaacaccccgnaaacgccccgaagtcatnattangacgtcactatccgcctgaggggtntctaatcncggttctcgtgctacagtctgcacacgcctccngacanctgngctcngctgagcgngctgattattangtacagctacattatacaagtcaagttaactatcgttaccgttttcgggacggtacgggtaacccaaggtcctaacggtacccgtacggtaacggttccgaacggaccccaaaggggtccctcccggtaccccgtcgggtacctttacccg

SEQ ID NO: 325330 - DNA, 697 bp, Homo sapiens
  misc_feature: GZ8MTXP02H3E2A.39.11.A11.1.454.CMB.2.raw
  modified_base (307)..(307): a, c, t, g, unknown or other
  misc_feature (307)..(307): n is a, c, g, or t
  modified_base (331)..(331): a, c, t, g, unknown or other
  misc_feature (331)..(331): n is a, c, g, or t
tcagtcgcactagtcacgaccggtgctcgatttagctacgactgcagggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgctcaccatctcctgcactggaaccagcagtgtacgttggtagttacaactatgtctctggtaccaaacaaccacccgacaaacgcccccgaagtcatgtatttatgacgtanactaagtccggccctcgaggggtntactaatcgtcttcctcgtggcctaccgtaagtcgtcggccaaaccgtaccggtccccttaccccgtacgaacccctatttcccgtccgttcgggggcccttacccgaacggggtccttaggggaacggggtaaaccggaggggtaccttaggtaatttaacgttaccgttaggcctaaggtccttacaagttaactttaccgaaaagtaccttaaaggtaaacttaccgttggtttaccccgttttacggggcggggttaaaacggggaccaaaacgtccggtaacggtacccgttaccgtaagggttaccaaccggacccgaaacggccccgttaccgccccccggttacggtttaccaccccg

SEQ ID NO: 325331 - DNA, 604 bp, Homo sapiens
  misc_feature: GZ8MTXP02JZQ3T.39.11.A11.1.454.CMB.2.raw
  modified_base (302)..(302): a, c, t, g, unknown or other
  misc_feature (302)..(302): n is a, c, g, or t
  modified_base (330)..(330): a, c, t, g, unknown or other
  misc_feature (330)..(330): n is a, c, g, or t
tcagtcgcactagtcacgaccggtgctcgatttagctacgactgcaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgctcaccatctcctgcactggaaccagcagtgacgttggtggttacaactatgtctcctggtaccaacaaccaccccggacaaacgcccccgaagtcatgtatttangactacactaatccggccctgaggggtntactaatcgtcttcctctgctacagtctaggccaaccgaccggtccctccgtcgacctatccgtcgtcgggctccgaggctgaggacgaggtctagtattatacgtgactacgtctacgtattacttacgaaacgtacgtaagttaacttacgtttcgtacccgttttacgggacggggtaaccgggaaaccacggtaccgtacggtacccgtacgtacggttacgaaccggtaacccgaacggtcctacccggcccccgttcggtacctcccg

SEQ ID NO: 325332 - DNA, 626 bp, Homo sapiens
  misc_feature: GZ8MTXP02GYNIG.39.11.A11.1.454.CMB.2.raw
  modified_base (221)..(221): a, c, t, g, unknown or other
  misc_feature (221)..(221): n is a, c, g, or t
  modified_base (297)..(297): a, c, t, g, unknown or other
  misc_feature (297)..(297): n is a, c, g, or t
tcagtcgcactagtcacgaccggtgctcgatttagctacgactgcagggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgctcaccatcctcctgcactggaaccngcagtgacgttggtgtacactatgtctctgtaccaacaaccaccccggacaaacgcccccgaagtccatgatttangacgtcactaagtccggccctcgaggggtgtactaatcgtcttcctctggctaccgaagtccgtggcctaaaccgaccgggtccccctcgaccgtaactctccgtcgggtcgtcccgacggcgtacgacggggacggacggtacgtcgtaagttacgtttacgtcgtagaacgtccgttacgtacttaacgtttacaacgagtacgtaaagtacttacgtttccgtttacggttacgggacggtaacgaacgtacgtaccggtaccgtacccgtacgtaccgtacgaaccgaccgacgtcccgtccccgtaccggtccgtaccttcccg

SEQ ID NO: 325333 - DNA, 583 bp, Homo sapiens
  misc_feature: GZ8MTXP02F98J9.39.11.A11.1.454.CMB.2.raw
  modified_base (298)..(298): a, c, t, g, unknown or other
  misc_feature (298)..(298): n is a, c, g, or t
  modified_base (326)..(326): a, c, t, g, unknown or other
  misc_feature (326)..(326): n is a, c, g, or t
  modified_base (435)..(435): a, c, t, g, unknown or other
  misc_feature (435)..(435): n is a, c, g, or t
tcagtcgcactagtcacgaccggtgctcgatttagctacgactgcagggggggtctcaggaggcagcgctctcaggacatctccaccatggcctgggctctgctgctcctcaccctcctcactcagggcacaggttcctgggcccagtctgccctgactcagcctgcctccgtgtctgggtctcctggacagtcgctcaccatcctcctgcactggaaccagcagtgacgttggtgttacaactatgtctctggtaccaacaccaccccggacaaacgcccccgaagtcatgatttangacgtcactaatccggccctgaggggtntactaagtccgtcttcctcgtggctaccgaagtccgtgccaacgaccggccctccctagaccatctcgtcggcctccgaggctggaggacgaggtctagtattagtacngcgtacgtctacattatacgaagctaagtaactcgtacgttcccgtttacgggacggtaacggaccaacgtcgtacggtacccgtaccgtaggtaccaacggacccgtaacgggtccctacccggtcccccgttacggtccttacccg

SEQ ID NO: 325334 - DNA, 513 bp, Homo sapiens
  misc_feature: GZ8MTXP02I67T7.39.11.A11.1.454.CMB.2.raw
  modified_base (294)..(294): a, c, t, g, unknown or other
  misc_feature (294)..(294): n is a, c, g, or t
  modified_base (314)..(314): a, c, t, g, unknown or other
  misc_feature (314)..(314): n is a, c, g, or t
  modified_base (321)..(321): a, c, t, g, unknown or other
  misc_feature (321)..(321): n is a, c, g, or t
  modified_base (354)..(354): a, c, t, g, unknown or other
  misc_feature (354)..(354): n is a, c, g, or t
  modified_base (398)..(398): a, c, t, g, unknown or other
  misc_feature (398)..(398): n is a, c, g, or t
  modified_base (402)..(403): a, c, t, g, unknown or other
  misc_feature (402)..(403): n is a, c, g, or t
  modified_base (405)..(405): a, c, t, g, unknown or other
  misc_feature (405)..(405): n is a, c, g, or t
  modified_base (410)..(410): a, c, t, g, unknown or other
  misc_feature (410)..(410): n is a, c, g, or t
tcagtcgcactagtcacgaccggtgctcgatttagctacgactgcagggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgctcaccatctcctgcactggaaccagcagtgacgttggtggttacaactatgtctctggtaccaacacaccccgcaaacgcccccaagtcatgatttangacgtcactaatcggccctnaggggtntctaatcgtcttcctctgctccagtctgcaacncggcctccctgaccatctcgtggctcaggctgagcgagctgatntacnncngtctnatatcaagtcagtaaatctgttccgtttcggcggtacggaccaagctacgaccgtaccgtaggtcaacggcccaaggtcctacgtcccccgtcggtcctaccg

SEQ ID NO: 325335 - DNA, 682 bp, Homo sapiens
  misc_feature: GZ8MTXP02HQ4K5.39.11.A11.1.454.CMB.2.raw
  modified_base (218)..(218): a, c, t, g, unknown or other
  misc_feature (218)..(218): n is a, c, g, or t
  modified_base (291)..(291): a, c, t, g, unknown or other
  misc_feature (291)..(291): n is a, c, g, or t
tcagtcgcactagtcacgaccggtgctcgatttagctacgactgcagggggggtctcagaaggcagcgctctcaggacatctccaccatggcctgggctctgctgctcctcaccctcctcactcagggcacaggttcctgggcccagtctgccctgactcagcctgcctcgtgtctggtcctcgtggacagtcgctcacatctcctgcactggaaccngcagtgtacgttggtagttacatatgtctctgtaccaacaccacccgcaaacgcccccgaagtcatgtattanacgtactacaactacgtccgtccgtacggtaggtctactacgtcgtcttccgtcgtcgtacctaccgtagttccgaggaccaaaccgtcccggtccccttacccgacgtaccctactttcccgtcgtccggacctcggacgtccgtagggacggaccggagttacgtagttaacttacttaacgtcgtaacgcgttctactattactacgaacgtacgtaaagttaacgttacgtttaccggtttaccggtttaccggggaacgggtaaccgggtaaaccgtaaacgggttcccgttaaaccggttacccggtaccggtttaccggaaccggtaaccccgtaccggaaacgtccccggtacccgttacccccggtccgtttacctaccccg

SEQ ID NO: 325336 - DNA, 594 bp, Homo sapiens
  misc_feature: GZ8MTXP02GPFR2.39.11.A11.1.454.CMB.2.raw
  modified_base (217)..(217): a, c, t, g, unknown or other
  misc_feature (217)..(217): n is a, c, g, or t
  modified_base (290)..(290): a, c, t, g, unknown or other
  misc_feature (290)..(290): n is a, c, g, or t
  modified_base (439)..(439): a, c, t, g, unknown or other
  misc_feature (439)..(439): n is a, c, g, or t
tcagtcgcactagtcacgaccggtgctcgatttagctacgactgcaggggggtctcagaaggcagcgctctcaggacatctccaccatggcctgggctctgctgctcctcaccctcctcactcagggcacaggttcctgggcccagtctgccctgactcagcctgcctcgtgtctgggtctctggacagtcgctcaccatctcctgcactggaaccngcagtgacgttggtgtacaactatgtctctgtaccaacaacacccggcaaacgcccccgaagtcatgtattancgtacgtactactaacgtccgcctcggaggggtctactacgtcgtcttcctcgtcgtctacgtaacgtcgtcgaccaacgccggtcctccgtacgactactctcgtcggtctcgaggtcaggacggacgaggtctagtattacttacgngacgactctactattactacgaagtactaaagttaaactacgttacgtttccgttacgggacggtacggaaaccgacggtaccgtacgtacccgttaccgtacgtaccgaaccgacccgaacgtcccgtcccgtacccggttacgtccttacccg

SEQ ID NO: 325337 - DNA, 568 bp, Homo sapiens
  misc_feature: GZ8MTXP02FPT6Y.39.11.A11.1.454.CMB.2.raw
  modified_base (323)..(323): a, c, t, g, unknown or other
  misc_feature (323)..(323): n is a, c, g, or t
  modified_base (406)..(406): a, c, t, g, unknown or other
  misc_feature (406)..(406): n is a, c, g, or t
tcagtcgcactagtcacgaccggtgctcgatttagctacgactgcagggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgctcaccatctcctgcactggaaccagcagtgacgttggtgttacaactatgtctctgtaccaacaacaccccgcaaacgcccccgaagtcatcgatttatgacgtcactaatccggccctgaggggtntctaatcgtcttcctcgtgctccaagtctggcaacacggcctccctgaccctatctcgtggcctcgagctgacggcgaggctnagttattactgcacgctacattactacgagtctaagtaacttctacggtttccgtttcgggacggtaacgggtaacccaaaggtccgtacgaccccgggttacgtaacgggttccaacgggtacccccgaaggtcccgtccgtcccccgtcggtacctcccg

SEQ ID NO: 325338 - DNA, 575 bp, Homo sapiens
  misc_feature: GZ8MTXP02IYU0V.39.11.A11.1.454.CMB.2.raw
  modified_base (221)..(221): a, c, t, g, unknown or other
  misc_feature (221)..(221): n is a, c, g, or t
  modified_base (297)..(297): a, c, t, g, unknown or other
  misc_feature (297)..(297): n is a, c, g, or t
  modified_base (423)..(423): a, c, t, g, unknown or other
  misc_feature (423)..(423): n is a, c, g, or t
tcagtcgcactagtcacgaccggtgctcgatttagctacgactgcaggggggggtctcaggaggcagcgctctcaggacatctccaccatggcctgggctctgctgctcctcaccctcctcactcagggcacaggttcctgggcccagtctgccctgactcagcctgcctccgtgtctgggtctcctggacagtcgctcaccatctcctgcactggaaccngcagtgacgttggtagtacaatatgtctcctgtaccaaacaccacccgacaaaccgccccgaagtcatgtatttancgactcaactacgtccgcctgagggtctactaatcgtcttctcgtcgctacaagtcgtgccaacaccggcctccctgaccatctcgtcggctccgaggctggacggacgagctagtattattacgngacagtctatacttacgttacaacgtacgtaagtaaacttacgtagtacgttacgtttacgggacgggtaaacggtacccaagtaccgtacgtaccgtcgttaacggaacgaaccgtacccgaacgcccgtccgtaccccgtccggttaccc

SEQ ID NO: 325339 - DNA, 704 bp, Homo sapiens
  misc_feature: GZ8MTXP02I54IF.39.11.A11.1.454.CMB.2.raw
  modified_base (220)..(220): a, c, t, g, unknown or other
  misc_feature (220)..(220): n is a, c, g, or t
tcagtcgcactagtcacgaccggtgctcgatttagctacgactgcaggggggggtctcaggaggcagcgctctcaggacatctccaccatggcctgggctctgctgctcctcaccctcctcactcagggcacagggtcctgggcccagtctgccctgactcagcctgcctccgtgtctgggtctctggacagtcgctcaccatctcctgcactggaaccngcagtgtacgttggtagttacaactatgtctcctagtaccaacaaccaccccggacaaacgcccccgaagtcatgtatttatgacgtacactaagtccggaccctcgaggggttctactaagtcgtcttcctcgtcggtctaccgtaagtcgtacgggaccaaccgtaccgggtcccctacccgtacggaaccctacttcccgttaccgtcggggaccctacccggagggtccgtaggggaacgggtaacccggagggtccgttaggtaactttaacttaccgtaggacctaacggtccttacctaaatttacttaacgaaacggtacctaaaggttaaacttaccgtttcggtttaccccgttttacggggaccgggtaacggggaaacctacggtaccgttacggtaaccccggttacgttacgggacctaaccggacccgtaacgggtcctacccgtacccccggttcggacctttacccg

SEQ ID NO: 325340 - DNA, 592 bp, Homo sapiens
  misc_feature: GZ8MTXP02J196E.39.11.A11.1.454.CMB.2.raw
  modified_base (191)..(191): a, c, t, g, unknown or other
  misc_feature (191)..(191): n is a, c, g, or t
  modified_base (220)..(220): a, c, t, g, unknown or other
  misc_feature (220)..(220): n is a, c, g, or t
  modified_base (290)..(290): a, c, t, g, unknown or other
  misc_feature (290)..(290): n is a, c, g, or t
tcagtcgcactagtcacgaccggtgctcgatttagctacgactgcagggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacngtcgctcaccatctcctgcactggaaccngcagtgacgttggtgttacactatgtctctgtaccaacacacccggcaacgccccgaagtcatgatttangacgtcactaatccgccctgagggtctactaatcgtcttcctcgtgcctaccgaagtctagggccaaacgaccggccctccgtacgacccattcctcgttgggcctcccgaggctcggacgggacgagggtctagtactttacttaccgtgccagtctacattatacaacgtataacgtaattacgtcgtttacccgtttacgggacggacggtaccaacgtccgtacgtacccgtaccgttacggtaccaaccggaacccgtaacggcccttaccggaccccccgttacggtacttccccg

SEQ ID NO: 325341 - DNA, 561 bp, Homo sapiens
  misc_feature: GZ8MTXP02HQCSS.39.11.A11.1.454.CMB.2.raw
  modified_base (303)..(303): a, c, t, g, unknown or other
  misc_feature (303)..(303): n is a, c, g, or t
  modified_base (313)..(313): a, c, t, g, unknown or other
  misc_feature (313)..(313): n is a, c, g, or t
  modified_base (325)..(325): a, c, t, g, unknown or other
  misc_feature (325)..(325): n is a, c, g, or t
  modified_base (350)..(350): a, c, t, g, unknown or other
  misc_feature (350)..(350): n is a, c, g, or t
  modified_base (366)..(366): a, c, t, g, unknown or other
  misc_feature (366)..(366): n is a, c, g, or t
  modified_base (371)..(371): a, c, t, g, unknown or other
  misc_feature (371)..(371): n is a, c, g, or t
  modified_base (396)..(396): a, c, t, g, unknown or other
  misc_feature (396)..(396): n is a, c, g, or t
tcagtcgcactagtcacgaccggtgctcgatttagctacgactgcaggggggggtctcaggaggcagcgctctcaggacatctccaccatggcctgggctctgtttctgctcctcaccctcctcactcagggcacagggtcctgggcccagtctgccctgactcagcctgcctccgtgtctgggtctcctggacagtcgctcaccatcctcctgcactggaaccagcagtgacgttggtgttacaactatgtctctgtaaccaacaaccgaccccgacaaacgcccccgaagtcatgatttangacgtcatanccgcctgaggtntactaatcgcttctctgctcagtcngccacaccgcctcccngaccntctcgtggctcgagctggacgaggngctgtaattattacgtgacacgtctactaattatacgaagtcgtaaattacgttacgttcggtttacgttacggggacggtacggtaaccgacgtcgtaccgtaccgtacgttacgaccgtaacgaccgtacggtcccgtaccgtccccgtcgtaccgttacccg

SEQ ID NO: 325342 - DNA, 713 bp, Homo sapiens
  misc_feature: GZ8MTXP02I1Y9H.39.11.A11.1.454.CMB.2.raw
  modified_base (190)..(190): a, c, t, g, unknown or other
  misc_feature (190)..(190): n is a, c, g, or t
  modified_base (194)..(194): a, c, t, g, unknown or other
  misc_feature (194)..(194): n is a, c, g, or t
  modified_base (317)..(317): a, c, t, g, unknown or other
  misc_feature (317)..(317): n is a, c, g, or t
tcagtcgcactagtcacgaccggtgctcgatttagctacgactgcaggggggggtctcaggaggcagcgctctcaggacatctccaccatggcctgggctctgctgctcctcaccctcctcactcagggcacaggttcctgggcccagtctcgccctgactcagcctgcctcgtgtctggtctctggacngtcnctcacatctcctgcactggaaccagcagtgtacgttgggtacgttaacaacttatgtcctccgtacggtaacccaaccaacccgaacccccggacaaaccgcccccgaatccatagtatttancgactcactaagccgtcctggagggttctactaatcgtctccctgtcgctacgtagtcgtacggcaaccgccgaccccttccgacgtaccctattccctccgtcgggtaccctacggtacggtcgtacgggaacgggtccgaggttccgtaggttaactttacgttaacgtggtaaacccgtacgtactattaacgttaacgtaacgtaacgtaacttaaacgggtttaacctttaccggtttacccggttttaccgggttaccgggggtaaccggggtaaccggaaccgttaacggtccggttaacccggtacccgttaccgtaccggtacccggaacccgtaaccggtaccggtaccccgttacccccggtcccccgttacgttacccctcccg

SEQ ID NO: 325343 - DNA, 552 bp, Homo sapiens
  misc_feature: GZ8MTXP01BCSJ2.52.57.F02.1.454.CMB.2.raw
  modified_base (242)..(242): a, c, t, g, unknown or other
  misc_feature (242)..(242): n is a, c, g, or t
  modified_base (411)..(411): a, c, t, g, unknown or other
  misc_feature (411)..(411): n is a, c, g, or t
  modified_base (441)..(441): a, c, t, g, unknown or other
  misc_feature (441)..(441): n is a, c, g, or t
tcagcgcagtacgacacgaccggtgctcgatttagctcgatatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggatccagcagtgacgttggtnctttatgactttgtctcctggtaccaacaccaccctggcaaacgcccccaaactcatcatttttgaggtcactaagcggcctcgacggggtccctgatcgcttctcctggctcgaagtctggcaacacggccctcccgtgaccgtctcgtcgggcctcgaggctgaggntgaggctagattactactgcacgtcattancgcaggcacgaacgtaaggtttgggggtttacgcgggaggaaccgaaggttcgaaccgttcgtacgtcgcgcccgaggcctcgccccgtcggtccactccgttcgttcccc

SEQ ID NO: 325344 - DNA, 546 bp, Homo sapiens
  misc_feature: GZ8MTXP01D0A6E.52.57.F02.1.454.CMB.2.raw
  modified_base (207)..(207): a, c, t, g, unknown or other
  misc_feature (207)..(207): n is a, c, g, or t
  modified_base (238)..(238): a, c, t, g, unknown or other
  misc_feature (238)..(238): n is a, c, g, or t
tcagcgcagtacgacacgaccggtgctcgatttagctcgatatagttgggtttgggggggtctcaggaggcagcgctctcaggacgtcaccaccatggcctgggctctgctcctcctcaccctcctcactcagggcacagggtcctgggcccagtctgccctgactcagcctccctcgcgtccggtctcctggacagtcagtcaccntctctgcactggatccagcagtgacgttggncttatgactttgtctctggtaccaacaccacctggacaaacgcccccaaatcatctatttttgagtcaactaagcgccctcgagggtcctgatcgcttctcctggctcgaagtcgtacggcaacgacggccctccctgacccgtctcgtggctcaggctgagatgagctgattacactgctactctatactgcaggcgaacgtaaacgtaaggtttcgggggtttacgcggggtaggaacgaaggttcgaccgttcgtacgtcacgttccaacggctccgccccgtggtccacgttcttccgttcccc

SEQ ID NO: 325345 - DNA, 568 bp, Homo sapiens
  misc_feature: GZ8MTXP01DT8LD.52.57.F02.1.454.CMB.2.raw
tcagcgcagtacgacacgaccggtgctcgatttagctcgatatagttgggtttggggtggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggatccagcagtgacgttggtgcttatgactttgtctctggtaccaacaccacctggcaaacgcccccaaatcatctattttgagtcactaagcgccctcacggggtccctgactcgtcttcctctggctcgaagtctgcaacacgccctccctcgaccgtctcgtcgggcctaccgacggctgaggtactgaggtctgattactactcgctacctctaatagtgacagggacaactaacgtaaggttttcgggggttacgcgggaacggacgaaggtcgaacccgtcgtacgttaccgcgcccgaaggtccttccgcccctcggttcctaaccttcgttaacccg

SEQ ID NO: 325346 - DNA, 566 bp, Homo sapiens
  misc_feature: GZ8MTXP01DSR12.52.57.F02.1.454.CMB.2.raw
  modified_base (346)..(346): a, c, t, g, unknown or other
  misc_feature (346)..(346): n is a, c, g, or t
  modified_base (360)..(360): a, c, t, g, unknown or other
  misc_feature (360)..(360): n is a, c, g, or t
tcagcgcagtacgacacgaccggtgctcgatttagctcgatatagttgggtttggggtggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggatccagcagtgacgttggtgctttatgtactttgtctctggaccaacaccacctgacaaacgccccaaatcatctattttgagtcactacgcgccctcgacgggtcctgactcgtcttccnctggctcgaagtcnggcaacaccggcctccctcgaccgtctcgtgggctccgagctgaggatgaggtctagacttactactcgactactcattacgcgcgaggcaaacgtaagttaagggtttcgggggttacgcggggtaacggtacgaagggtcgaaccgtcgttaacgcgacgacccgaaggcctccgaccccgtcggttacctccgttcttccccg

SEQ ID NO: 325347 - DNA, 547 bp, Homo sapiens
  misc_feature: GZ8MTXP01AT9ZI.52.57.F02.1.454.CMB.2.raw
  modified_base (416)..(417): a, c, t, g, unknown or other
  misc_feature (416)..(417): n is a, c, g, or t
  modified_base (419)..(419): a, c, t, g, unknown or other
  misc_feature (419)..(419): n is a, c, g, or t
  modified_base (422)..(422): a, c, t, g, unknown or other
  misc_feature (422)..(422): n is a, c, g, or t
  modified_base (426)..(426): a, c, t, g, unknown or other
  misc_feature (426)..(426): n is a, c, g, or t
tcagcgcagtacgacacgaccggtgctcgatttagctcgatatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggatccagcagtgacgttggtgcttatgactttgtctctggtaccaacaccaccctggcaaagccccaaactcatcattttgagtcactaagcggccctcagggtccctgatcgcttctcctggctcgaatctgggccaacacggccctccctgaccgtctctgggctcaggctgaggatgaggctgattactacnncnctnatangcgagacgaacaacgtaaggtttggggtttcgggtcggacgggaacgtaacggttacgtaccgttaccgtacgtacgacgccgacgcgtccgccccgtccgtcgttacctcgttccgtccc

SEQ ID NO: 325348 - DNA, 581 bp, Homo sapiens
  misc_feature: GZ8MTXP01AVLB3.52.57.F02.1.454.CMB.2.raw
  modified_base (243)..(243): a, c, t, g, unknown or other
  misc_feature (243)..(243): n is a, c, g, or t
  modified_base (413)..(413): a, c, t, g, unknown or other
  misc_feature (413)..(413): n is a, c, g, or t
tcagcgcagtacgacacgaccggtgctcgatttagctcgatatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggatccagcagtgacgttggtncttatgtactttgtctctggtaccaacaccacctgacaaacgcccccaaatcatctattttgagtcactacgcgcctcgagggtccctgactcgtcttctccgtggctcgaagtctaggaccaacgccggccctcccgtgaccgtctcgtcgggctccgaggtctggagntaggaggtcagtacttactacgtgaccacgtacatacgtcgacgacggacgtaacgtaaaccgttagggtttcgggggttacgacggggtacggaacgtaggttccgaccgttcgtacgtcgacgttccgagtcctccgcccctggtcacgtccgttccgtaaccccg

SEQ ID NO: 325349 - DNA, 614 bp, Homo sapiens
  misc_feature: GZ8MTXP01A7IWS.52.57.F02.1.454.CMB.2.raw
  modified_base (445)..(445): a, c, t, g, unknown or other
  misc_feature (445)..(445): n is a, c, g, or t
  modified_base (453)..(453): a, c, t, g, unknown or other
  misc_feature (453)..(453): n is a, c, g, or t
  modified_base (477)..(477): a, c, t, g, unknown or other
  misc_feature (477)..(477): n is a, c, g, or t
tcagcgcagtacgacacgaccggtgctcgatttagctcgatatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggatccagcagtgtacgttggtgtctttagtcgtactttgtctccgtacggtaaccaaccaccaccctcggacaaacgcccccaaactcattctattttgaggtcactaacgccggcctcgtacggggtcctgactcgtcttctccgtcggtactacgtaagtcgtacgggaccaaccgcggtccctcccgtacgaccgtctcgtcggctccgaggcgtgaggngtagcgtntagtacttactactcgactacgtntatcgcgacgacgacgtaacgtaacggttcgggtttcggggtacggacgggtaacggtaacgtacggttccgtaccgttcgtacgtacgacgttccgacgtccgtccgtcccgtcgtccttacctccgttccgtccc

SEQ ID NO: 325350 - DNA, 580 bp, Homo sapiens
  misc_feature: GZ8MTXP01B7UGJ.52.57.F02.1.454.CMB.2.raw
  modified_base (243)..(243): a, c, t, g, unknown or other
  misc_feature (243)..(243): n is a, c, g, or t
tcagcgcagtacgacacgaccggtgctcgatttagctcgatatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggatccagcagtgacgttggtncttatgactttgtctctggtaccaacaccacctgacaaacgccccaatcatctattttgagtcactaagcgcctcgagggtcctgactcgcttctcctggctcgaagtcgtaggaccaaccgaccggtccctccctcgtacccgtctcgtcgggctccgaggctgagatggaggtctgacttactactgaccaccgtcattactgacgacggacgaacgtaaaccgtaaggtttcggggggtttacgcgggtaacgggaacccgtaaggttcggtaccgttccgtacgtacacgttccacggtcctccgtcccctggtccacgtccgttcgttcccc

SEQ ID NO: 325351 - DNA, 626 bp, Homo sapiens
  misc_feature: GZ8MTXP01ED94O.52.57.F02.1.454.CMB.2.raw
  modified_base (244)..(244): a, c, t, g, unknown or other
  misc_feature (244)..(244): n is a, c, g, or t
  modified_base (342)..(342): a, c, t, g, unknown or other
  misc_feature (342)..(342): n is a, c, g, or t
tcagcgcagtacgacacgaccggtgctcgatttagctcgatatagttgggtttggggtggggtctcaggaggcagcgctctcaggacgtcaccaccatggcctgggctctgctcctcctcaccctcctcactcaggcacagggtcctgggcccagtctgccctgactcagccctccctccgcgtcccgggtctcctggacagtcagtcaccatctcctgcactggatccagcagtgacgttggncttatgtcttgtctctgaccaacaccacctgaccaaacgcccccaaatcatctattttgagtacatacgcgccctcgacgggtcctgactcgcttccncgtgctcgaacgtctgcaacgaccggtccctacccgtcgacccgtcgtcgtcgggtcctaccgacggcgttaggacgtagttacggaacggtctagtacttacgtaactccgactaaccttacattaacgcgtaccgacggtaccgtaaactaacggtttaaagggttttcgggggtttaccgggcgggtaacgggtaaccgttaagggtccgttaccgtaccgtacgttcgacgacccgaacgtccgtccgtccccgtcggttcctaaccgttccgttccccg

SEQ ID NO: 325352 - DNA, 633 bp, Homo sapiens
  misc_feature: GZ8MTXP01B2KPV.52.57.F02.1.454.CMB.2.raw
  modified_base (243)..(243): a, c, t, g, unknown or other
  misc_feature (243)..(243): n is a, c, g, or t
  modified_base (429)..(429): a, c, t, g, unknown or other
  misc_feature (429)..(429): n is a, c, g, or t
tcagcgcagtacgacacgaccggtgctcgatttagctcgatatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggatccagcagtgacgttggtnctttatgtactttgtctcgtcggtaccaacaccaccctggaccaaaccgaccccaaactcatctattttgagtcactaacgccgcctcgacgggtcctgactcgtcttctccgtggctacgtagtcgtacggacaacgaccgtccctcccgtacgtccgtctcgtcgggcctcgaggtctggacgngtaggacgtctagtacttacacgttacgcctacgtctaagttacgacgcgaacggaccgtaaacgtaaacggtttacgggtttcgggggtttaccgggacggggtaacgggaaccggtaagggttcgtacccgttcgtaccgtcgaccgccgaacggtccctcccgtccccgttcggtccttaccttccgttccgttaaccccc

SEQ ID NO: 325353 - DNA, 590 bp, Homo sapiens
  misc_feature: GZ8MTXP01ESCS1.52.57.F02.1.454.CMB.2.raw
  modified_base (227)..(227): a, c, t, g, unknown or other
  misc_feature (227)..(227): n is a, c, g, or t
  modified_base (375)..(375): a, c, t, g, unknown or other
  misc_feature (375)..(375): n is a, c, g, or t
tcagcgcagtacgacacgaccggtgctcgatttagctcgatatagttggggggagccttccaacacccgggggggtccctgagactcacctgtgaagcctctggatttagatttagcagccatgccatgacctgggtccgccaggctccaggtcaggggctggagtgggtctcaggtattagcggaactggtgataccacgtactacgcggactctgtgaagggccncttcaccatctctagggacagttccaagacacgctgtatctgcaaatgaaatagcctgagagtcgaggacacggccgtttattactgtgcgaaagatcgaggtcgcatgactagttttggagtcggaccaaagacggcaggttcccgngtaacggggttggacgtcgtggggccaacggggaccacgggtcaccgtcgcctcacgccctaccaccgaacgggcccatccggtccttccccgtcggccaccctcctaccaacgacgccacctcggtggggccaacgcgccggcccgtggcgttcgccgttggtaccaaaggccttaccttcctaatcgaacttccgcttcggaacggcgggccg

SEQ ID NO: 325354 - DNA, 651 bp, Homo sapiens
  misc_feature: GZ8MTXP01AXCR2.52.57.F02.1.454.CMB.2.raw
  modified_base (244)..(244): a, c, t, g, unknown or other
  misc_feature (244)..(244): n is a, c, g, or t
  modified_base (466)..(466): a, c, t, g, unknown or other
  misc_feature (466)..(466): n is a, c, g, or t
tcagcgcagtacgacacgaccggtgctcgatttagctcgatatagttgggtttggggtggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggatccagcagtgacgttggntcttatgtactttgtctcctgaccaacaccacctggaccaaacgaccccaaactcactctattttgagtcacgtacgccgcctcgacgggtcctgactcgtcttcctcgtcgctacgacgtcgtggcctaaacgccggtccctcccgtgtacccgttctcgtcgggtctccgaggtctaggacggtagtggaggtcctagtacttacgtactcgcctacgtntattacgcgacgacgaccgtaaacctaacggttaaggggtttttcgggggttaccggacggggtaacgggtaaccggttaaagggttccggttaacccggttcccgtaacggttccgacggttaccccggtaacggcccgtccccggtacccccgttccgggttacctccgttcccgtttccccg

SEQ ID NO: 325355 - DNA, 673 bp, Homo sapiens
  misc_feature: GZ8MTXP01EO8N7.52.57.F02.1.454.CMB.2.raw
  modified_base (199)..(199): a, c, t, g, unknown or other
  misc_feature (199)..(199): n is a, c, g, or t
  modified_base (243)..(243): a, c, t, g, unknown or other
  misc_feature (243)..(243): n is a, c, g, or t
tcagcgcagtacgacacgaccggtgctcgatttagctcgatatagttggggtttggggggggtctcaggaggcagcgctctcaggacgtcaccaccatggcctgggctctgctcctcctcaccctcctcactcagggcacagggtcctgggcccagtctgccctgactcagcctccctcgcgtccgggtctcctggacngtcagtcaccatctcctgcactggatccagcagtgacgttggtncttatgtactttgtctccgtggtaccaacaccacctgacaaacgcccccaaatcatctattttgagtacactaaggccgtccctacggacgggtccctgactcgtcttcgtcctggtctacggtaacgtcgtacggaccaacgaccggtccctcccgtcgtacccgtcgtcgtcgggcctacgaggctgaggtatggacggtctagtacttactacttcgaccctaccggtataagtacgtcggcgaacggtaccgaaacgtaaacggtttaacgggttttcgggggtttaccgggtacggggaacgggtaaaccgtaacgggttccggacccgttaccgtaaccggtaccgaccggttccccggaaacgggtcccgtacccgtcccccgtttacgggcccttaccgttcccttcccggtttaacccccc

SEQ ID NO: 325356 - DNA, 548 bp, Homo sapiens
  misc_feature: GZ8MTXP01ESVS6.52.57.F02.1.454.CMB.2.raw
  modified_base (241)..(241): a, c, t, g, unknown or other
  misc_feature (241)..(241): n is a, c, g, or t
  modified_base (415)..(415): a, c, t, g, unknown or other
  misc_feature (415)..(415): n is a, c, g, or t
  modified_base (441)..(441): a, c, t, g, unknown or other
  misc_feature (441)..(441): n is a, c, g, or t
tcagcgcagtacgacacgaccggtgctcgatttagctcgatatagttgggtttggggggggtctcaggaggcagcgctctcaggacgtcaccaccatggcctgggctctgctcctcctcaccctcctcactcagggcacagggtcctgggcccagtctgccctgactcagcctcctccgcgtccgggtctcctggacagtcagtcaccatctcctgcactggatccagcagtgacgttggncttatgactttgtctctggtaccaacaccaccctggacaaacgcccccaaatcatctattttgacggtcactaacgcgcctcaggggtccctgactcgtcttctcctggctcgaactcgtacggacaacgtacggccctcccgtgaccgtcgtcgtcgggctcgaggctcgagntgagtctagtattactatcgcacctnatatgcagcgactaagtagtttggggttcgacggagggaacaaggttcgaacgttcgtacgtcacgccacggcctacgccccgtggtccactccgttcgttaacccc

SEQ ID NO: 325357 - DNA, 733 bp, Homo sapiens
  misc_feature: GZ8MTXP01C24TF.52.57.F02.1.454.CMB.2.raw
  modified_base (242)..(242): a, c, t, g, unknown or other
  misc_feature (242)..(242): n is a, c, g, or t
  modified_base (549)..(549): a, c, t, g, unknown or other
  misc_feature (549)..(549): n is a, c, g, or t
tcagcgcagtacgacacgaccggtgctcgatttagctcgatatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggatccagcagtgtacgttggtntctttatgtactttgtctcgtacggtaccaacaccacccgtggaccaaacgacccccaaactctacttactagtttttgacggttacaacgttaacgcccggtccctacggtacgggggtcccctagtactccgtctttccgtccgttcggtcttacgtaaacgtccgtaacgggaccctaacccgaccgggtccccttacccgtacgtaccccgtcgttcgtcggggtcccttaccgacggtcgttagggaaggtagtggtaacgggtcttaaggtaacttaccgtactacgtacctaaccggttntaacgttacgacgacgtaacggacgtaaacgtaaacggtttagggttttcgggggttaccggacgggtacgggaaaccgtaagggttccgtacccgttccgttaaacgtccgaacggttcccgaacgggtccctacccggtccccgttcggtaccttccgttcccgttcccgtttaaccccccg

SEQ ID NO: 325358 - DNA, 605 bp, Homo sapiens
  misc_feature: GZ8MTXP01D8C2F.52.57.F02.1.454.CMB.2.raw
  modified_base (240)..(240): a, c, t, g, unknown or other
  misc_feature (240)..(240): n is a, c, g, or t
tcagcgcagtacgacacgaccggtgctcgatttagctcgatatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctctgcactggatccagcagtgacgttggtnctttatgactttgtctcctggtaccaacaccaccctggacaaacgcccccaaactcatctatttttgagtcactaagcgcctcgagggtcctgactcgcttctctggctacgatctaggacaacgacggtccctaccctcgacccgttctcgtcgggctccgaggctgaggattggaggctagtacttactactgcctacggtcaagtatgacgaggacaacgtaaacgttaggttttcgggggtttacggacggggtaacgggaaccgtaacgggttcggtacccgttccgtaccgttacaccggttacccgaagggtccctcccggcccccgttagggtcccacttccgttccgtttcccccg

SEQ ID NO: 325359 - DNA, 639 bp, Homo sapiens
  misc_feature: GZ8MTXP01BEIZ8.52.57.F02.1.454.CMB.2.raw
  modified_base (242)..(242): a, c, t, g, unknown or other
  misc_feature (242)..(242): n is a, c, g, or t
  modified_base (427)..(427): a, c, t, g, unknown or other
  misc_feature (427)..(427): n is a, c, g, or t
tcagcgcagtacgacacgaccggtgctcgatttagctcgatatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcacatctcctgcactggatccagcagtgacgttggtncttatgtactttgtctccgtgtaccaacaccaccctggacaaacgcccccaaatcatctattttgagtcactaacgcgccctcgacgggtcctgactcgcttctctggctacgagtctaggaccaacgaccggccctcccgtcgaccgtctcgtcgggctccgaggcgtggaggtatggacggtntacgaacttacactcgacctacgtactatacgtcgacacgggtaccaaacgttaaacgttaagggttttcggggggtttaccggacggggtaaggggtaaacccgtaggggttaccgtacccgtttccgaacgttccgttaaccggcccgaaacgggtccctcccggtcccccgttagggtcccttaccgttccgttccccggtttcccccg

SEQ ID NO: 325360 - DNA, 676 bp, Homo sapiens
  misc_feature: GZ8MTXP01BI2VQ.52.57.F02.1.454.CMB.2.raw
  modified_base (243)..(243): a, c, t, g, unknown or other
  misc_feature (243)..(243): n is a, c, g, or t
tcagcgcagtacgacacgaccggtgctcgatttagctcgatatagttgggtttggggggggtctcaggaggcagcgctctcaggacgtcaccaccatggcctgggctctgctcctcctcaccctcctcactcagggcacagggtcctgggcccagtctgccctgactcagcctccctcgcgtccggtctcctggacagtcagtcaccatcctctgcactggactccagcagtgtacgttggtncttatgtactttgtctcgtcggtaccaacaccacctggaccaaaccgccccctaaactcatacttagttttcgacggttccaacgtaacggccggtaccctacggtacgggggtccctagtactccgtcttcgtccgtcggtactacggtaagttccgtaacgggacctaaccgaccggtcccttccctacggtacccgttcgtcgtccgggaccttcgaggcgtaggaacggtagtaggagtcttagtacttaccgtacgtacgtaccctaacgttactaagtacgtacgaccggtacggaaccgtaacgtaaacggtttacgggtttcgggggttacggacggaacgggtaacgtaacgggttcgtacccgttacgtacggtcacgccgttacggcctcccgcccgtacgtccacttcccgttcgtccccg

SEQ ID NO: 325361 - DNA, 647 bp, Homo sapiens
  misc_feature: GZ8MTXP01CQATS.52.57.F02.1.454.CMB.2.raw
  modified_base (244)..(244): a, c, t, g, unknown or other
  misc_feature (244)..(244): n is a, c, g, or t
tcagcgcagtacgacacgaccggtgctcgatttagctcgatatagttgggtttgggggggggtctcaggaggcagcgctctcaggacgtcaccaccatggcctgggctctgctcctcctcaccctcctcactcagggcacagggtcctgggcccagtctgccctgactcagcctccctcgcgtccgggtctcctggacagtcagtcaccatctctgcactggactccagcagtgacggttggtntcttatgtactttgtctccgtagtaccaacaccacctggaacaaccgccccaaatctatcttattttgagtcacgtacgccgtcctcggtacgggtcctgactccgtcttcgtccgtcggtctaggtaacgtcgtacggaccaacgtcccgtccctcccgtgtaccgtctcggcggcctacgcgcgtgacggtagtggagtctagtacttactactcgacctacggtactaagttcgacgacgtaacgacgtaacgtaaacgggtttaggggtttcgggggttaccggagggtaacgggtaacgtaacgggttccgtaccggtttacgaccggtacgaaccggttcccgacggtcccgtacccgttcccggtcggtccaccgttcccgttcccgttaaccccc

SEQ ID NO: 325362 - DNA, 654 bp, Homo sapiens
  misc_feature: GZ8MTXP01ELVZZ.52.57.F02.1.454.CMB.2.raw
  modified_base (227)..(227): a, c, t, g, unknown or other
  misc_feature (227)..(227): n is a, c, g, or t
  modified_base (326)..(326): a, c, t, g, unknown or other
  misc_feature (326)..(326): n is a, c, g, or t
tcagcgcagtacgacacgaccggtgctcgatttagctcgatatagttggggggagccttccaacacccgggggggtccctgagactcacctgtgaagcctctggatttagatttagcagccatgccatgacctgggtccgccaggctccaggtcaggggctggagtgggtctcaggtattagcggaactggtgataccacgtactacgcggactctgtgaagggccncttcaccatctctaagggacagttccaaagaacacgctgtatctgacaaatgaatagcctgagagtcgaggacacggtcctttatactgtgacgaaagntcgaggtcgcagtgacttaggttttggagtcggaccaaaggccggctacggttcccgcgttaacgggggttggaccgtcggtcgggggacccgaacggggacctacgggtcgacccgtcggcctcgacgccctacccaaccgaacggcccacgtcccggtcccttccccgcgacccgacccctcccgtaccaacgcgcccgaccgtcggtcgggggctaccgacggcccgggcccggtcgggtccgttcggtcccgttacggtaccgtaacgttaccgtttacccttcgtaacgtacgaacgttccgcgttcggaacggcgggtccgg

SEQ ID NO: 325363 - DNA, 649 bp, Homo sapiens
  misc_feature: GZ8MTXP01B9PKU.52.57.F02.1.454.CMB.2.raw
  modified_base (210)..(210): a, c, t, g, unknown or other
  misc_feature (210)..(210): n is a, c, g, or t
  modified_base (216)..(216): a, c, t, g, unknown or other
  misc_feature (216)..(216): n is a, c, g, or t
  modified_base (243)..(243): a, c, t, g, unknown or other
  misc_feature (243)..(243): n is a, c, g, or t
tcagcgcagtacgacacgaccggtgctcgatttagctcgatatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccntctccngcactggatccagcagtgacgttggtnctttatgtactttgtctctgtaccaacaccaccctggacaaaccgacccccaaactcatactattttgagtacactaacggccgccctcgagggtcctgactcgtcttctccgtgctcgtaacgtcgtacggaccaaccgaccgggtccccttccctcggaccccgttctccgtcggggtcctcgacggtcgtaggaggtagtacggacggtctagtacttaactactcgacctactacgtatactcgacgacggaccgtaagtaaccgttagggtttcgggggtttacggacggggtagggaacccgtaagggttaccgtaccgttcccgtaacggtccgaccggttccgaacggtcccgtacgtccccgttccggtccgttacctccgttcccgttaacccccg

SEQ ID NO: 325364 - DNA, 710 bp, Homo sapiens
  misc_feature: GZ8MTXP01CRNIC.52.57.F02.1.454.CMB.2.raw
  modified_base (198)..(198): a, c, t, g, unknown or other
  misc_feature (198)..(198): n is a, c, g, or t
  modified_base (243)..(243): a, c, t, g, unknown or other
  misc_feature (243)..(243): n is a, c, g, or t
tcagcgcagtacgacacgaccggtgctcgatttagctcgatatagttgggtttggggggggtctcaggaggcagcgctctcaggacgtcaccaccatggcctgggctctgctcctcctcaccctcctcactcagggcacgagggtcctgggcccagtctgccctgactcagcctccctcgcgtccggtctcctggacngtcagtcaccatcctctgcactggatccagcagtgacgtttggtnctttagtcgtactttgtctccgtagtaccaacaccacctgaccaaccgaccccaaatcatctagttttgacgtcaacgtacgccgtcccgtgtacgggtcctggattcgactttctccgtcgcttacgacgtcgtacgggaccaacgtcccggtcccttcccgtacgcccgtcgttcgacgggcccttccggaggcgtaggaggtagtgggaaccgttgtactaacttactaacggtctacccttaccgtatacgttagacggacggaacgtaccgtaaacggttaaacgggttttacggggttttcggggggttaccggaacggggtaaccgggtaaccggtaaagggttcccggttaaacccggttcgttaaaccggccgttaaacccggttcccggaacggttccccggtcccggttccccggtaccggtttaccccttcccgtttcccgttccccgtaacccc

SEQ ID NO: 325365 - DNA, 721 bp, Homo sapiens
  misc_feature: GZ8MTXP01AQX6C.52.57.F02.1.454.CMB.2.raw
  modified_base (227)..(227): a, c, t, g, unknown or other
  misc_feature (227)..(227): n is a, c, g, or t
  modified_base (281)..(281): a, c, t, g, unknown or other
  misc_feature (281)..(281): n is a, c, g, or t
  modified_base (338)..(338): a, c, t, g, unknown or other
  misc_feature (338)..(338): n is a, c, g, or t
tcagcgcagtacgacacgaccggtgctcgatttagctcgatatagttggggggagccttccaacacccgggggggtccctgagactcacctgtgaagcctctggatttagatttagcagccatgccatgacctgggtccgccaggctccaggtcaggggctggagtgggtctcaggtattagcggaactggtgataccacgtactacgcggactctgtgaagggccncttcaccatctctagggacagttccaaagaacacgctgtatctgacaaatgaanagcctagagagtcgaggacacggtccgtttatactgtagacgaaagatcggaggtcnctatgacgtagttttaggagtaccggaccaaaggcggcgtacggtccgacgttaacggggtggaccgtcggtcggggaccgaacgggacccgacggtacccgaccgtcgccctcgaccgtccctacccgaaccgaacgggccccacgttcccgggttccccttcccccgtcgggtaccccgtaccccttaccccgtacccgaacggaccgtacccgtaccccgttccgggtacggggggaccctaaccggaccgggccccgggcccggttaacggggccttacgggccccgttcgggttaaaccgaacgggttacccgttaccgttacccgttaacggtacgtaaccgtccggacccgttagggccgggttcggggtcccggg

SEQ ID NO: 325366 - DNA, 631 bp, Homo sapiens
  misc_feature: GZ8MTXP01BMA0F.52.57.F02.1.454.CMB.2.raw
  modified_base (213)..(213): a, c, t, g, unknown or other
  misc_feature (213)..(213): n is a, c, g, or t
  modified_base (248)..(248): a, c, t, g, unknown or other
  misc_feature (248)..(248): n is a, c, g, or t
tcagcgcagtacgacacgaccggtgctcgatttagctcgatatagttgggtttggggtggggtctcaggaggcagcgctctcaggacgtcaccaccatggcctgggctctgctcctcctcaccctcctcactcagggcacagggccccgggcccagtctgccctgactcagcctccctcgcgtccgggtctcctggacagtcagtcaccatcncctgcactggatccagcagtgacttggtgctttangactttgtctctggtaccaacaccacctggacaaacgcccccaaatcatcatttttcgagtcactaagccggcctcgaagggggttcccctgtactcgtcttctccgtcggctacgtacgtcgtaacggaccaaccgccgtccctcccgtacgtaccgtcgtcgtcgggtcctaccgacggcgtggaggagtagacgtacgtagtacttactacgtacgtacctaccgtactactacgtacgacgacggacgtaacgtaaacgttaagggtttacgggggtttacgggtacgggacgggaacggtaacggttacgtaccgttaccgtaccgtacgacgccgacgtccgtccgtcccgtccgtcttaccgtccgttccgtcccg

SEQ ID NO: 325367 - DNA, 737 bp, Homo sapiens
  misc_feature: GZ8MTXP01A41YH.52.57.F02.1.454.CMB.2.raw
  modified_base (246)..(246): a, c, t, g, unknown or other
  misc_feature (246)..(246): n is a, c, g, or t
tcagcgcagtacgacacgaccggtgctcgatttagctcgatatagttgggtttggggtggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggactccagcaggtgacgttggngtctttatgtactttcgtctccgtacggtacccaacaccctacccgtggaccaaaaccgcccccaaactctactacttattttgacggtacaacgtaacggccggtacccgtcggtacggggtccctagtactccgtacctttcccgtcgtcggtaccgtacggtaacgtcccgtacggccctaaaccgtacccgggtccccttccccgtacggtacccgttccgtcgtcgggtaccttccggaggtccgtagggacggtagtacggacggtccgtaggtaactttacctacgtaccgccgtaaacccttcgtaacttacgtacggaaccgtacgggaaccgtaaacgttaaccgggttaaggggttttccgggggtttaccgggacggggtaacggggtaacccggttaagggtcccgttacccggtcctaacggttcgccgttaccgaacgtccgtcccgtccccgtgacccttccgttccgttccccg

SEQ ID NO: 325368 - DNA, 633 bp, Homo sapiens
  misc_feature: GZ8MTXP01AXIOK.52.57.F02.1.454.CMB.2.raw
  modified_base (241)..(241): a, c, t, g, unknown or other
  misc_feature (241)..(241): n is a, c, g, or t
  modified_base (248)..(248): a, c, t, g, unknown or other
  misc_feature (248)..(248): n is a, c, g, or t
  modified_base (283)..(283): a, c, t, g, unknown or other
  misc_feature (283)..(283): n is a, c, g, or t
  modified_base (365)..(365): a, c, t, g, unknown or other
  misc_feature (365)..(365): n is a, c, g, or t
  modified_base (416)..(416): a, c, t, g, unknown or other
  misc_feature (416)..(416): n is a, c, g, or t
  modified_base (430)..(430): a, c, t, g, unknown or other
  misc_feature (430)..(430): n is a, c, g, or t
tcagcgcagtacgacacgaccggtgctcgatttagctcgatatagttgggtttggggtggggtctcaggaggcagcgctctcaggacgtcaccaccatggcctgggctctgctcctcctcaccctcctcactcaggcacagggtcctgggcccagtctgccctgactcagcctccctccgcgtccggtctcctggacagtcagtcaccatctcctgcactggatccagcagtgacgttggntcttatntactttgtctctgaccaactaccacctgacaaacnccccaaatctatctatttgacgtacacgtacgccgaccctcgacgggtcctgactcgtcttcctctggtctacgtagtaccnggaaccaccgaccggtcccctcccgtcgtaccgtctcgtcgggctaccggngcgtagacggtagngacggtctaggtacttacgtactcgacccacttagtatacgtcgacgacgggtaccgtaaaccgtaaaggttaacgggggtttttcgggggttaccggggaacgggaaccgggtacgaacggggttccgaccgtttaccgacggttaccgcgttacccggtaacgccgtcccggccctacggttcctaacgttccgttcccgg

SEQ ID NO: 325369 - DNA, 629 bp, Homo sapiens
  misc_feature: GZ8MTXP01BHVF7.52.57.F02.1.454.CMB.2.raw
  modified_base (208)..(208): a, c, t, g, unknown or other
  misc_feature (208)..(208): n is a, c, g, or t
  modified_base (244)..(244): a, c, t, g, unknown or other
  misc_feature (244)..(244): n is a, c, g, or t
  modified_base (482)..(482): a, c, t, g, unknown or other
  misc_feature (482)..(482): n is a, c, g, or t
  modified_base (500)..(500): a, c, t, g, unknown or other
  misc_feature (500)..(500): n is a, c, g, or t
tcagcgcagtacgacacgaccggtgctcgatttagctcgatatagttgggtttggggggggtctcaggaggcagcgctctcaggacgtcaccaccatggcctgggctctgctcctcctcaccctcctcactcagggcacagggtcctgggcccagtctgccctgactcagcctccctcgcgtccggtctcctggacagtcagtcaccntcctctgcactggactccagctagtgtacgttggtntctttagtgtactttcggtccttccgtacggtaacccaaccaccaccctggaccaaaccgacccccaaatctatcttattttgacgtacacgtaacgccgtcctcgacgggtcctagtctcgtcttcgtccgtcggtctacgtacgtcgtacggaaccaaccgccgtccctacccgtccgtacccgttcgtcgttcgggcctcgacggtcgtggacgatcggagtctagtacttactntcgactacgtacattacncgacgacgacgtaacgtaaggttcggggtttcggggtacgggaccggaagggtaacctaaggttcgtaaccgttcgtacgcacgcgacgtccgtccgcccgttacgtcttaccgtccttccgtaacccc

SEQ ID NO: 325370 - DNA, 815 bp, Homo sapiens
  misc_feature: GZ8MTXP01CAFJC.52.57.F02.1.454.CMB.2.raw
  modified_base (221)..(221): a, c, t, g, unknown or other
  misc_feature (221)..(221): n is a, c, g, or t
  modified_base (244)..(244): a, c, t, g, unknown or other
  misc_feature (244)..(244): n is a, c, g, or t
  modified_base (291)..(291): a, c, t, g, unknown or other
  misc_feature (291)..(291): n is a, c, g, or t
tcagcgcagtacgacacgaccggtgctcgatttagctcgatatagttgggtttgggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatcctcctgcntggatccagcagtgacgttggtncttatgtctttgtctactcggtaaccaacaccacctaggaccaaacncccccaaaactcatctattttagcggtcactaagcggcctcgacgggtcctgactcgcttcgtcctggtctcgtaagtcagggtccaaccgtaccgggtcccctacccgtcggaccccgttcgttaccgcggggtccctacccggtaacgggtccgttagggacggtaacggtcgggtaacgggtccttaggtaaccttaacgtttaaccgttcggtaacccggtaacccgttctaaacgttaacgtaccggttagacccgggtaaacccggtaaaccgtaaaccggtttaaacgggggtttttaccggggggggttttccggggtaaccgggggtaaccgggggttaaacccgggtaacgggggtttaaaccgggtaacccccggttacccggttaaacccgggtttccggaaacccggggttccccgttaaaaccggggtccccgttccccggggtcccccccgtttaccgggggtaacccttacccgggttccccgtttccggttttaacccccccccggg

SEQ ID NO: 325371 - DNA, 501 bp, Homo sapiens
  misc_feature: GZ8MTXP02F3RN3.52.57.F02.1.454.CMB.2.raw
  modified_base (239)..(239): a, c, t, g, unknown or other
  misc_feature (239)..(239): n is a, c, g, or t
  modified_base (416)..(416): a, c, t, g, unknown or other
  misc_feature (416)..(416): n is a, c, g, or t
  modified_base (419)..(419): a, c, t, g, unknown or other
  misc_feature (419)..(419): n is a, c, g, or t
tcagcgcagtacgacacgaccggtgctcgatttagctcgatatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggatccagcagtgacgttggncttatgactttgtctcctgtaccaacaccacctgcaaagccccaaatcatcattttgagtcactaagcggcctcagggtccctgactcgcttctcctgctcgaagtctggcacacggcctcctgaccgtctctgggctccaggctgaggatcgaggctgattacactgcactcatancgnagcactaacgtagtttggggttcgacggacggacgaggtcgaccgtcgtacgcacgccaggctcgccctcgcactctcgtcc

SEQ ID NO: 325372 - DNA, 531 bp, Homo sapiens
  misc_feature: GZ8MTXP02HEDZM.52.57.F02.1.454.CMB.2.raw
  modified_base (361)..(361): a, c, t, g, unknown or other
  misc_feature (361)..(361): n is a, c, g, or t
tcagcgcagtacgacacgaccggtgctcgatttagctcgatatagttgggtttggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggatccagcagtgacgttggtgcttatgactttgtctcctggtaccaacaccaccctggcaaacgcccccaaactaatcattttgagtcactaagcgcctcgacgggtcctgatcgcttctctcgctcgaagtctggcaacncgcctcctgacctctctggctccagctgagatgaggctgattactactgcacctcatatcgcaggcgaacaacgtaagtttcgggggtttcgacgggtagggaaccaggtcgaccgtctacgtcacgcccaaggcctcgcccccgtcggtccactcctcgttccctaccc

SEQ ID NO: 325373 - DNA, 593 bp, Homo sapiens
  misc_feature: GZ8MTXP02GS8QF.52.57.F02.1.454.CMB.2.raw
  modified_base (240)..(240): a, c, t, g, unknown or other
  misc_feature (240)..(240): n is a, c, g, or t
tcagcgcagtacgacacgaccggtgctcgatttagctcgatatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggatccagcagtgacgttggtncttatgtactttgtctctggtaccaacaccacctgacaaacgcccccaaactcatctattttgagtcactagcggcctcgacgggtccctgactcgcttctccgtcgctacgaagtcgtcggacaccgaccggcctccgtcgaccgtctcgtcgggctcgagctgagagtgacgctgtattactactgccacctctatatcgacgaggcgaactaacgtaaggttttgggggtttacggacgggtaacgggaacgtaacgggtacgtacccggttaccgtaccgttaccgacgaccccgaaagggccttacccggcccccgtacggtaccaccttccgttccgtttacccccc

SEQ ID NO: 325374 - DNA, 554 bp, Homo sapiens
  misc_feature: GZ8MTXP02F0B08.52.57.F02.1.454.CMB.2.raw
  modified_base (240)..(240): a, c, t, g, unknown or other
  misc_feature (240)..(240): n is a, c, g, or t
  modified_base (246)..(246): a, c, t, g, unknown or other
  misc_feature (246)..(246): n is a, c, g, or t
  modified_base (404)..(404): a, c, t, g, unknown or other
  misc_feature (404)..(404): n is a, c, g, or t
  modified_base (415)..(415): a, c, t, g, unknown or other
  misc_feature (415)..(415): n is a, c, g, or t
tcagcgcagtacgacacgaccggtgctcgatttagctcgatatagttgggtttgggggtcgtcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggatccagcagtgacgttggngcttangactttgtctcctggtaccaacaccaccctggcaaagcccccaaatcatcattttgaggtcactaagcggccctcaggggtccctgatcgcttctcctggctcgaagtctggcacacggcctcctgaccgtctctgggctccaggctgagatgagcgngatactactcncactactatatcgacgacgacgacgaacgtaacgttagggttacgggtacggtacggacggtacggtacggtaccgtaccgtacgtacgacgaccgacgaaccgtccgtcccgtccgtaccgtacctccgtccgtcccg

SEQ ID NO: 325375 - DNA, 529 bp, Homo sapiens
  misc_feature: GZ8MTXP02HNI2U.52.57.F02.1.454.CMB.2.raw
  modified_base (330)..(330): a, c, t, g, unknown or other
  misc_feature (330)..(330): n is a, c, g, or t
tcagcgcagtacgacacgaccggtgctcgatttagctcgatatagttgggtttggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggatccagcagtgacgttggtgcttatgactttgtctcctggtaccaacaccaccctggcaaacgcccccaaactcatcattttgaggtcactaagcgcctcgagggtccngatcgcttctcctgctcgaagtctggcacacggcctccctgaccgtctctgggctccgagctgaggatgaggctgattacactgcactcatatgcagcgaacaacgtaagtttgggggtttcggcggacggacctaagggtcgaccgtcgtacgtcacgcccaaggccgtcgccccgtggccacgtcctcgttcccccg

SEQ ID NO: 325376 - DNA, 532 bp, Homo sapiens
  misc_feature: GZ8MTXP02H4RYZ.52.57.F02.1.454.CMB.2.raw
  modified_base (247)..(247): a, c, t, g, unknown or other
  misc_feature (247)..(247): n is a, c, g, or t
tcagcgcagtacgacacgaccggtgctcgatttagctcgatatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggatccagcagtgacgttggtgcttangactttgtctctggtaccaacaccaccctggcaaagcccccaaaactcatcattttgagtcactaagcgcctcagggtccctgatcgcttctcctgctcgaagtctggcacacggctccctgaccgtctctcgggcctccgagctgaggatgaggctgattactactgcacctcatactgcaggcgaactaaacaagttttgggggttttcgacgggtaggggaaccaagggtcgaaccgtctaacggtcacgaccaaggctcgcccctcggtcactctacgtcc

SEQ ID NO: 325377 - DNA, 532 bp, Homo sapiens
  misc_feature: GZ8MTXP02FPOVK.52.57.F02.1.454.CMB.2.raw
  modified_base (240)..(240): a, c, t, g, unknown or other
  misc_feature (240)..(240): n is a, c, g, or t
  modified_base (245)..(245): a, c, t, g, unknown or other
  misc_feature (245)..(245): n is a, c, g, or t
tcagcgcagtacgacacgaccggtgctcgatttagctcgatatagttgggtttggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggatccagcagtgacgttggncttangactttgtctcctggtaccaacaccaccctgcaaacgcccccaaactcatcattttgaggtcactaagcgccctcgacgggtccctgactcgcttctcctgctcgaagtctggcacacggcctcctgacctctctgggctcgagctgagatgaggctgattacactgccacctcagtatgcagcgaacacgtaagtttggggtttacgcggacgggaccaaggtcgaccgtccgtacgcgacgcccgaaggccttcgcccccgttcggcctactcctcgtttccccc

SEQ ID NO: 325378 - DNA, 521 bp, Homo sapiens
  misc_feature: GZ8MTXP02JK6SP.52.57.F02.1.454.CMB.2.raw
  modified_base (240)..(240): a, c, t, g, unknown or other
  misc_feature (240)..(240): n is a, c, g, or t
tcagcgcagtacgacacgaccggtgctcgatttagctcgatatagttgggtttggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggatccagcagtgacgttggngcttatgactttgtctcctggtaccaacaccaccctggcaaagcccccaaactcatcattttgaggtcactaagcgccctcaggggtcctgatcgcttctcctggctcgaagtctggcacacggcctccctgaccgtctctgggctccaggctgaggatgaggctgattacactgctactcatactgcaggcacactaagtttggggttcgacgggaggaccaaggtgaccgtctacgtcacgccgaaggctcgccccgtcggtcacctctcggttccccg

SEQ ID NO: 325379 - DNA, 572 bp, Homo sapiens
  misc_feature: GZ8MTXP02G5NAO.52.57.F02.1.454.CMB.2.raw
tcagcgcagtacgacacgaccggtgctcgatttagctcgatatagttgggggagccttccaacacccggggggtccctgagactcacctgtgaagcctctggatttagatttagcagccatgccatgacctgggtccgccaggctccaggtcaggggctggagtgggtctcaggtattagcggaactggtgataccacgtactacgcggactctgtgaagggccgcttcaccatctctagggacagttccaagaacacgctgtatctgcaaatgaatagcctgagagtcgaggacacggccgtttatactgtgcgaaaagatcgaggtcgcatgactagttttggagtcggaccaaagacggcaggttccgcgtacggggttgacgtcgtggggccaagggccacggtcaccgtcgcctcagccctccaccacgggcccagtccggtccttcccccgtggccaccccgtcctaccaagacgccaccgtcgtcgggggcacgacgccggccccgtgggcctgccgtggtccaaacggcctacgttcctaagtacgacttcgctgacggcggcg

SEQ ID NO: 325380 - DNA, 530 bp, Homo sapiens
  misc_feature: GZ8MTXP02GRTXG.52.57.F02.1.454.CMB.2.raw
tcagcgcagtacgacacgaccggtgctcgatttagctcgatatagttgggtttggggtggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggatccagcagtgacgttggtgcttatgactttgtctctgtaccaacaccaccctggcaaacgccccaaactcatctattttgaggtcactaacgcggccctcgacggggtccctgatcgtcttcctctgctcgagtctggcaacacggcctccctgaccgtctcgtcgggctccgagtctggagatggagctgacttactactgccacctcatatgccaggcaacaacgtaggtttgggggtttacgacgggtaggaccgaaggtcgaccgtctacgcacgccaaggctcgcccctgtcactctccg

SEQ ID NO: 325381 - DNA, 671 bp, Homo sapiens
  misc_feature: GZ8MTXP02GVKLB.52.57.F02.1.454.CMB.2.raw
  modified_base (242)..(242): a, c, t, g, unknown or other
  misc_feature (242)..(242): n is a, c, g, or t
tcagcgcagtacgacacgaccggtgctcgatttagctcgatatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggatccagcagtgacgttggtncttatgtacttgtctcgtcgtaccaacaccaccgtcgaccaaccgaccccaactcatctagttttgacgtacaacgtaacgccgccctcgtacgggtcctgactcgtcttctccgtcgtctacgtacgtcgtacggacaccgccgtccctccgtcgtcccgtcgtcgtcggtcctccgacggtcgtacggaggtacgtacggacggtcgtacgtaacgttaccgtacgtcgtacctaccgttactagtacgtacggaccgacggtaccgtaaacgttaaacggttaaggggttttcgggggttacgggacggggtaacggtaaccggtaacgggtaccgtacccgttaccgtaccggtaccgaaccgtacccgtaacggtcccgtcccggtaccccgtcgtaccgtaccgttccgttacccgtaccccg

SEQ ID NO: 325382 - DNA, 552 bp, Homo sapiens
  misc_feature: GZ8MTXP02GGUBS.52.57.F02.1.454.CMB.2.raw
  modified_base (214)..(214): a, c, t, g, unknown or other
  misc_feature (214)..(214): n is a, c, g, or t
  modified_base (238)..(238): a, c, t, g, unknown or other
  misc_feature (238)..(238): n is a, c, g, or t
  modified_base (364)..(364): a, c, t, g, unknown or other
  misc_feature (364)..(364): n is a, c, g, or t
  modified_base (385)..(385): a, c, t, g, unknown or other
  misc_feature (385)..(385): n is a, c, g, or t
  modified_base (535)..(535): a, c, t, g, unknown or other
  misc_feature (535)..(535): n is a, c, g, or t
tcagcgcagtacgacacgaccggtgctcgatttagctcgatatagttgggtttggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcacatctcctnactggatccagcagtgacgttggnctttatgtactttgtctcctggtaccaacaccacctggacaaacgaccccaaactcatctattttgagtcactaagcgcctcgacgggtccctgactcgcttctctcggctcgaatctggacaacnccggcctcctgaccgtctcgnggctccgagctgacgatgagctgtattacacgtgaccactcatatgacaggaccgactaaacgttaaggtttcgggggtttacgacggggtacgaaccgtaaggtcgaccgtccgtaacgtcacgaccacggctccgccccgtcgtaccncgttcctccgtccctcc

SEQ ID NO: 325383 - DNA, 617 bp, Homo sapiens
  misc_feature: GZ8MTXP02HIFQ1.52.57.F02.1.454.CMB.2.raw
  modified_base (212)..(212): a, c, t, g, unknown or other
  misc_feature (212)..(212): n is a, c, g, or t
  modified_base (241)..(241): a, c, t, g, unknown or other
  misc_feature (241)..(241): n is a, c, g, or t
  modified_base (381)..(381): a, c, t, g, unknown or other
  misc_feature (381)..(381): n is a, c, g, or t
tcagcgcagtacgacacgaccggtgctcgatttagctcgatatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatcncctgcactggatccagcagtgacgttggncttatgtactttgtctcctggtaccaacaccacctggacaaacgcccccaaactcatctattttgagtcactaagcgcctcgacgggtcctgatcgcttctccgtgctcgaagtctggacacgcgccctcctgaccgtcncgtgggctacgcggctggagagtgaggctagtacttacacgttcgacctaacctctattacgtcgaccgacggaccaacgtaaacggttacggggttttcgggggttaccgggacggggtaacgggtaccggtaacgggtaccgtacccgttaccgtaaccgaccgaaccggtacccgtaaccggcccgtacccggtcccccgtcggtaccctaccgttcccgttaccgttccccc

SEQ ID NO: 325384 - DNA, 721 bp, Homo sapiens
  misc_feature: GZ8MTXP02IB35H.52.57.F02.1.454.CMB.2.raw
  modified_base (241)..(241): a, c, t, g, unknown or other
  misc_feature (241)..(241): n is a, c, g, or t
  modified_base (246)..(246): a, c, t, g, unknown or other
  misc_feature (246)..(246): n is a, c, g, or t
  modified_base (337)..(337): a, c, t, g, unknown or other
  misc_feature (337)..(337): n is a, c, g, or t
tcagcgcagtacgacacgaccggtgctcgatttagctcgatatagttgggtttgggggggtctcaggaggcagcgctctcaggacgtcaccaccatggcctgggctctgctcctcctcaccctcctcactcagggcacagggtcctgggcccagtctgccctgactcagcctccctcgcgtccgggtctcctggacagtcagtcaccatctcctgcactggatccagcagtgacgttggtncttangtactttgtctctgtaccacaccacctgcaaacgccccaatcatctattttgagtcactaagccgcctcgacggggtcctgactcgcttcncctgcctcgaatcgtggaccacgaccggtccctcccgtaccgtaccgtcgtcgttcggcccgttacgacggtccgtaggacggtagtcggtacggtcgttaacgtacttaccgttacgtaccgtcctaacccgttactaatttacgtccggaccggtaacgggaaccgtaaaacccgttaaagggtttaacgggggttttttccggggggttaccggggtacgggggaaacggggtaaccggtaaaacggggtttcccggtaaacccgtttcccgggtaaaccgttaccgaacccggttaaaccccggacgggttccccggtaccccgtacccccggttacccggttaccgtcccctttcccggttttacccggtccccccccg

SEQ ID NO: 325385 - DNA, 608 bp, Homo sapiens
  misc_feature: GZ8MTXP02GWAJ3.52.57.F02.1.454.CMB.2.raw
  modified_base (242)..(242): a, c, t, g, unknown or other
  misc_feature (242)..(242): n is a, c, g, or t
  modified_base (271)..(271): a, c, t, g, unknown or other
  misc_feature (271)..(271): n is a, c, g, or t
tcagcgcagtacgacacgaccggtgctcgatttagctcgatatagttgggtttgggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggatccagcagtgacgttggncttatgtactttgtctcctagtaccaacnccacctgacaaacgccccaaatcatctattttgacgtcactagccgcctcgacggggtcctggactcgtcttctccgtggtcctacgaagttcgacggaccacgacccggtcccttcccgtacgtcccgtcgtcgtcggggtacctcccgtagttcgaggaggatggacggtctagtacttacactgaccactctatatcggacacggacgaactaaacgttgggttttacgggggttcggacggaagggacccgtaaagggtcgtacccgtacgtacggtacacgacccaacggtccgtcccgccccgtcggtccacctttccgtccgttcccccg

SEQ ID NO: 325386 - DNA, 664 bp, Homo sapiens
  misc_feature: GZ8MTXP02I4ZR3.52.57.F02.1.454.CMB.2.raw
  modified_base (208)..(208): a, c, t, g, unknown or other
  misc_feature (208)..(208): n is a, c, g, or t
  modified_base (240)..(240): a, c, t, g, unknown or other
  misc_feature (240)..(240): n is a, c, g, or t
tcagcgcagtacgacacgaccggtgctcgatttagctcgatatagttgggtttgggggggtctcaggaggcagcgctctcaggacgtcaccaccatggcctgggctctgctcctcctcaccctcctcactcagggcacagggtcctgggcccagtctgccctgactcagcctccctcgcgtccgggtctcctggacagtcagtcaccntctcctgcactggatccagcagtgacgttggncttatgtactttgtctcctggtaccaacaccacctggacaaacgcccccaaatcatctattttgagtcactagcgcctcgacgggtcctgatcgcttctcctggcctacgagtctcggacacgaccggcctcccgtcgacccgtctcgtcgggcctcgaggctaggacggagtaggacggctaggtacttacgtacgttcggcctacctactaattacgtacggaccgacgggaccgaaactaaacggttaaacgggttttcgggggtttaccgggacggggtaacgggaacccgtaaggggtaccggtaaccccggttaccgtaaccggttaccgaaccggtcccgaaaaccgggtcccgtaacccgtacccccggtttcggaaccccggttacccgttcctttaccccggtttaaccccccg

SEQ ID NO: 325387 - DNA, 553 bp, Homo sapiens
  misc_feature: GZ8MTXP02FWKOI.52.57.F02.1.454.CMB.2.raw
  modified_base (214)..(214): a, c, t, g, unknown or other
  misc_feature (214)..(214): n is a, c, g, or t
  modified_base (239)..(239): a, c, t, g, unknown or other
  misc_feature (239)..(239): n is a, c, g, or t
  modified_base (245)..(245): a, c, t, g, unknown or other
  misc_feature (245)..(245): n is a, c, g, or t
  modified_base (402)..(402): a, c, t, g, unknown or other
  misc_feature (402)..(402): n is a, c, g, or t
  modified_base (420)..(420): a, c, t, g, unknown or other
  misc_feature (420)..(420): n is a, c, g, or t
tcagcgcagtacgacacgaccggtgctcgatttagctcgatatagttgggtttggggggtctcaggaggcagcgctctcaggacgtcaccaccatggcctgggctctgctcctcctcaccctcctcactcagggcacagggtcctgggcccagtctgtcctgactcagcctccctccgcgtccgggtctcctggacagtcagtcaccatctccngcactggatccagcagtgacgttgngcttangactttgtctcctggtaccaacaccaccctggcaaacgcccccaaactcatcattttgaggtcactaagcggccctcacggggtccctgatcgcttctcctgctcgaagtctggcacgcgccctcctcgacccgtctcgtgggctccgaggctgagngtgaggctagacttaacncttgccactcatactgcagcgaactaagtaagtttgggggtttacgacgggtaggacctaagggtcgaccgtcgtaacgtcacgacccgtaagccgtaccgtccccgtacggtacctcgtccgttctaccccc

SEQ ID NO: 325388 - DNA, 718 bp, Homo sapiens
  misc_feature: GZ8MTXP02HMIUB.52.57.F02.1.454.CMB.2.raw
  modified_base (322)..(322): a, c, t, g, unknown or other
  misc_feature (322)..(322): n is a, c, g, or t
  modified_base (522)..(522): a, c, t, g, unknown or other
  misc_feature (522)..(522): n is a, c, g, or t
tcagcgcagtacgacacgaccggtgctcgatttagctcgatatagttgggggagccttccaacacccggggggtccctgagactcacctgtgaagcctctggatttagatttagcagccatgccatgacctgggtccgccaggctccaggtcaggggctggagtgggtctcaggtattagcggaactggtgataccacgtactacgcggactctgtgaagggccgcttcaccatctctagggacagttccaagaacacgctgtatctgcaaatgaatagcctgagagtcgaggacacggccgtttatactgtgacgaaaagntcgaggtcgcatgactagtttcgtaggacgtcgaccgaaaggcggacgtacgggttccgccgggttacggggttaggaccgtgggtcggggaaccgaaacggggtaccccgacggttacccacccggtccgccgtacgaccgcccctacccgaaccggtaaccggggccctacggttcccggttccccctttcccccggnggaccccctacccccgttccaacccgaaacggccaccccgtaccgttcggggtacgggggacccaaccgggccggccccggtcccggtcggggtccttaaccggtcccggttacgggaacccgtaaacggttacccctttacccggttaaccctaaagtacccgtacttccggaccgtaggggaccgggcccgggg

SEQ ID NO: 325389 - DNA, 603 bp, Homo sapiens
  misc_feature: GZ8MTXP02JPV9M.52.57.F02.1.454.CMB.2.raw
  modified_base (209)..(209): a, c, t, g, unknown or other
  misc_feature (209)..(209): n is a, c, g, or t
  modified_base (248)..(248): a, c, t, g, unknown or other
  misc_feature (248)..(248): n is a, c, g, or t
  modified_base (335)..(335): a, c, t, g, unknown or other
  misc_feature (335)..(335): n is a, c, g, or t
tcagcgcagtacgacacgaccggtgctcgatttagctcgatatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccntcctcctgcactggatccagcagtgacgttggtgcttangtactttgtctcctggtaccacaccacctggacaaacgccccaaatcatctattttgacgtcactacgccggccctcgacgggtccngactcgcttctctgctcgagtctggacacgccggtcctcccgtcgaccgtctcgtcgggacctcgaggtctaggagtacgtaggacgtctagtacttaccgtactcgcctactacattacgcggacacgggactaacgtaacggttacgggttttacgggggtttacggcgggaacgggtacgtaacgggtcgtaacccgtccgttacgccgacgtacccgaaggtccgtccggccccgttcggtcctaccgttcctccgttaccccc

SEQ ID NO: 325390 - DNA, 554 bp, Homo sapiens
  misc_feature: GZ8MTXP02JAM1H.52.57.F02.1.454.CMB.2.raw
  modified_base (343)..(343): a, c, t, g, unknown or other
  misc_feature (343)..(343): n is a, c, g, or t
tcagcgcagtacgacacgaccggtgctcgatttagctcgatatagttgggtttggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggatccagcagtgacgttggtgcttatgactttgtctcctggtaccaacaccaccctggacaaacgcccccaaactcatcattttgaggtcactaagcgccctcgacgggtcctgatcgcttcncctgctcgatctggcacacggccctcctcgaccgtctcgtcggctccgaggctgaggatgaggctagtacttactactgactacctctatatcgcacggacgaactaacgtaaggtttggggtttacggcggtacgggacgaaggtacgaccgtaccgacgtacgacgcccgaaggccgtcgccccgtcggtcctactccgtcgttccccc

SEQ ID NO: 325391 - DNA, 622 bp, Homo sapiens
  misc_feature: GZ8MTXP02HOE20.52.57.F02.1.454.CMB.2.raw
  modified_base (242)..(242): a, c, t, g, unknown or other
  misc_feature (242)..(242): n is a, c, g, or t
tcagcgcagtacgacacgaccggtgctcgatttagctcgatatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggatccagcagtgacgttggtncttatgtactttgtcttcctggtaccaacaccaccctggacaaacgccccaaactcatctattttgagtcactaagcgcctcgacgggtcctgactcgtcttctctgctcgaacgtcgtaggcaccgacggcctccgtcgtaccgtctcgtcgggctccgaggtctaggagtagtggaggtcttagtacttactacgtcgacctacctctattatgacgaacggaccgaaacgtaaacgtaagggttttcgggggtttcggacgggtaacggggtaaccgtagggttaccggtacccggttaccgtacgttaccgacggaccccgtaaaggccgtcccgtcccccgttcggcccttaccgttccgttccgtttacccccc

SEQ ID NO: 325392 - DNA, 599 bp, Homo sapiens
  misc_feature: GZ8MTXP02JKEJG.52.57.F02.1.454.CMB.2.raw
tcagcgcagtacgacacgaccggtgctcgatttagctcgatatagttgggggagccttccaacacccggggggtccctgagactcacctgtgaagcctctggatttagatttagcagccatgccatgacctgggtccgccaggctccaggtcaggggctggagtgggtctcaggtattagcggaactggtgataccacgtactacgcggactctgtgaagggccgcttcaccatctctagggacagttccaagacacgctgtatctgcaaatgaatagcctgagagtcgaggacacggccgtttatactgtgcgaaagatcgaggtcgctatgactaggtttttggagtggaccaaaagacggcagggttccgcgttacgggggttggacggtcgtcgggggccaaacggggaccgacgggtccgaccgtccggccctcgacgccctacccacccgaacggggccccacgtccgggtcctttcccccgtcggcccacccccgttccctcccgaacgacgccaccgtcgtcgggggcacgacgcgcccgtcgggctgcctgtacgacgactactcgtaatacgactcgctgacgcggtcg

SEQ ID NO: 325393 - DNA, 548 bp, Homo sapiens
  misc_feature: GZ8MTXP02F6C9Y.52.57.F02.1.454.CMB.2.raw
  modified_base (361)..(361): a, c, t, g, unknown or other
  misc_feature (361)..(361): n is a, c, g, or t
  modified_base (426)..(426): a, c, t, g, unknown or other
  misc_feature (426)..(426): n is a, c, g, or t
tcagcgcagtacgacacgaccggtgctcgatttagctcgatatagttgggtttggggtggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggatccagcagtgacgttggtgcttatgactttgtctcctggtaccaacaccacctggacaaacgcccccaaactcatcattttgagtcataagcgccctcaggggtccctgatcgcttcctctgctcgaatctgcaacncggcctcccgtgaccgtctctcgggctccgaggctgaggatggagtctgattacactgcaccctnactatcgcaggcgaactaacgtaagtttcgggggtttcggacgggtacggaacgaggtacgaccgtaccgtccgtacgacgtcccgaaggcctcggtcccccgtcggtccacgtcctcccgg

SEQ ID NO: 325394 - DNA, 600 bp, Homo sapiens
  misc_feature: GZ8MTXP02GZ15D.52.57.F02.1.454.CMB.2.raw
  modified_base (227)..(227): a, c, t, g, unknown or other
  misc_feature (227)..(227): n is a, c, g, or t
  modified_base (589)..(589): a, c, t, g, unknown or other
  misc_feature (589)..(589): n is a, c, g, or t
tcagcgcagtacgacacgaccggtgctcgatttagctcgatatagttggggggagccttccaacacccgggggggtccctgagactcacctgtgaagcctctggatttagatttagcagccatgccatgacctgggtccgccaggctccaggtcaggggctggagtgggtctcaggtattagcggaactggtgataccacgtactacgcggactctgtgaagggccncttcaccatctctagggacagttccaagacacgctgtatctgcaaatgaatagcctgagagtcgaggacacggtccgtttatactgtgacgaaaagatcgaggtcgcatgactagtttttggagtcggaccaaagacggctacggttccgcgtcggggttggacgttcgtcgggggaccaaggggaccgacggtcgaccgtccgcctacacgccctccgaccgaaacgggccccaagtccggtcccttcccccgtggccctaccctccctacccaagacgccaccttcggcgggggcacgacggccgcccgtcgggctcggcccgtggtacaacggtactacttaccgtaatcgactcgcgngacggcggcgg

SEQ ID NO: 325395 - DNA, 578 bp, Homo sapiens
  misc_feature: GZ8MTXP02GO3UE.52.57.F02.1.454.CMB.2.raw
  modified_base (243)..(243): a, c, t, g, unknown or other
  misc_feature (243)..(243): n is a, c, g, or t
  modified_base (443)..(443): a, c, t, g, unknown or other
  misc_feature (443)..(443): n is a, c, g, or t
tcagcgcagtacgacacgaccggtgctcgatttagctcgatatagttgggtttggggtggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggatccagcagtgacgttggngcttatgtactttgtctcctggtaccaacaccaccctggacaaacgccccaaactcatctattttgagtcactaagcgccctcgacgggtccctgactcgtcttcctctgctcgaagtcgtggcaacacggcctcctcgaccgtctcgtcgggctccgagctgacgatcgaggctgtacttactactgacctaacccttnatagcgacgacggactaacgtaacgttagggtttcgggggttacgacgggtaacgggaccgtaacgggtcgtaccgtacgtacgtacgacgaccgaacggtcctaccggccccgtacgtacctaccttccgtccg

SEQ ID NO: 325396 - DNA, 559 bp, Homo sapiens
  misc_feature: GZ8MTXP02GQGTH.52.57.F02.1.454.CMB.2.raw
  modified_base (437)..(437): a, c, t, g, unknown or other
  misc_feature (437)..(437): n is a, c, g, or t
  modified_base (443)..(443): a, c, t, g, unknown or other
  misc_feature (443)..(443): n is a, c, g, or t
tcagcgcagtacgacacgaccggtgctcgatttagctcgatatagttgggtttgggggggtctcaggaggcagcgctctcaggacgtcaccaccatggcctgggctctgctcctcctcaccctcctcactcagggcacagggtcctgggcctagtctgccctgactcagcctccctccgcgtccgggtctcctggacagtcagtcaccatctcctgcactggatccagcagtgacgttggtgcttatgactttgtctcctggtaccaacaccaccctggacaaacgcccccaaactcatcattttgagtcactaagccgccctcgacggggtcctgatcgcttctcctgctcgagtctgcacacggcctccgtcgaccgtctcgtgggcctcgaggctggacgagtgacggtctagtacttacgtactcgcaccgtntatagngacgacgacgaacgtaacgttaggtttggggttacggacggacggacgtacggtcgtaccgtccgtacgtacgacgaccgacgtcgtcccgcccgtcgtcctacctcctccgtccc

SEQ ID NO: 325397 - DNA, 608 bp, Homo sapiens
  misc_feature: GZ8MTXP02JA7XT.52.57.F02.1.454.CMB.2.raw
  modified_base (241)..(241): a, c, t, g, unknown or other
  misc_feature (241)..(241): n is a, c, g, or t
tcagcgcagtacgacacgaccggtgctcgatttagctcgatatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggatccagcagtgacgttggtncttatgtactttgtctctacggtaccaacaccacctggacaaacgaccccaaatcatctattttgacggtacactaacgcggccctacgacgggtcctgactcgtcgttctccgtcggctcgacgtctcggacacgccgcctccgtcgaccgtctcgtcgggcctaccgaggcctaggagtagtaggacgtctaggtaacttacctacgttcaccctacctcgaattacgacgtacgacggacgtaaacgtaacggtttaaggggtttcggggttacgggacggtacgggaacgtacgggcgtaccgtacgtacgaccgacgaccgtacggccgtcccgtcccgtcggctccttaccgtcgtccccg

SEQ ID NO: 325398 - DNA, 661 bp, Homo sapiens
  misc_feature: GZ8MTXP02IEAKP.52.57.F02.1.454.CMB.2.raw
  modified_base (243)..(243): a, c, t, g, unknown or other
  misc_feature (243)..(243): n is a, c, g, or t
tcagcgcagtacgacacgaccggtgctcgatttagctcgatatagttgggtttgggggggtctcaggaggcagcgctctcaggacgtcaccaccatggcctgggctctgctcctcctcacccctcctcactcagggcacagggtcctgggcccagtctgccctgactcagcctccctccgcgtccgggtctcctggacagtcagtcaccatctcctgcactggatccagcagtgacgttggtntcttatgtactttgtcctctcggtaccaacaccacctggacaaacgacccccaaatctatctattttgacgtcactaagccgccctcgtacgggtccctgactcgtcttctccgtcggtctacgtaagtcgtaggacaccgacgtccctcccgtcgtacccgttctccgtcggggccctccggaggtcgtaggaggtacgtggacggtctaagtacgttacgtaactcgacctaccgtactaatagtcgaccgacggacgtaaactaaacggtttaacgggttttcggggggtttaccgacgggggaaacggtaccgtaacgggttccgtaacccgttaccggttaccgtacgaacccgtaccgaacggccgttcccggccccgttacggtacctaccgttccgttcccgttaccccc

SEQ ID NO: 325399 - DNA, 571 bp, Homo sapiens
  misc_feature: GZ8MTXP02JP0TQ.52.57.F02.1.454.CMB.2.raw
  modified_base (382)..(382): a, c, t, g, unknown or other
  misc_feature (382)..(382): n is a, c, g, or t
tcagcgcagtacgacacgaccggtgctcgatttagctcgatatagttgggtttggggtggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggatccagcagtgacgttggtgcttatgactttgtctcctggtaccaacaccaccctggacaaacgcccccaaactcatctattttgaggtcactaacgcggccctcgacggggtccctgactcgtcttcctctggctcgagtctgcaacacggcctccngacccgtctctcggctccgagctgaggatgaggctagtattactactgcactcatatgcgaggaccgaactaaacgtaaaggttttcgggggttttacggacgggtaacggggaccgaaagggtcgacccggtacctacgtcgacgacccgaaggccttaccgccccgtcggtaccacgtccgttcccg

SEQ ID NO: 325400 - DNA, 617 bp, Homo sapiens
  misc_feature: GZ8MTXP02IOPY9.52.57.F02.1.454.CMB.2.raw
  modified_base (242)..(242): a, c, t, g, unknown or other
  misc_feature (242)..(242): n is a, c, g, or t
tcagcgcagtacgacacgaccggtgctcgatttagctcgatatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggatccagcagtgacgttggtncttatgactttgtctcctggtaccaacaccaccctggacaaacgccccaaactcatcattttgaggtcactaagcgccctcgaggggtcctgatcgtcttctcctggctcgatctcgctaccgcgcctcccgtgacctctcgtaggggcctccgaggtctaggacggtaagtggacggtcgtagtaactttactactcgtaccaacctcaattagtgaccgacggacgaactaaacgttaaggttttcgggggtttaccggacggggtaacggaaccgtaagggtccgtaccggtacctaacggttccaaacggtcccaaacgggtccgtacccggtcccccgtacggtacctccgttccgtacgtttccccccg

SEQ ID NO: 325401 - DNA, 664 bp, Homo sapiens
  misc_feature: GZ8MTXP02GA3JV.52.57.F02.1.454.CMB.2.raw
  modified_base (241)..(241): a, c, t, g, unknown or other
  misc_feature (241)..(241): n is a, c, g, or t
  modified_base (320)..(320): a, c, t, g, unknown or other
  misc_feature (320)..(320): n is a, c, g, or t
  modified_base (427)..(427): a, c, t, g, unknown or other
  misc_feature (427)..(427): n is a, c, g, or t
  modified_base (471)..(471): a, c, t, g, unknown or other
  misc_feature (471)..(471): n is a, c, g, or t
tcagcgcagtacgacacgaccggtgctcgatttagctcgatatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggatccagcagtgacgttggntcttatgtactttgtctctgtaccaacaccacctggacaaacgccccaaatcatctattttgacgtcactacggggccncctcgacgggtcctgactcgcttctccgtacggctacgaagttcgtcggacaccgccggtcccttccgtacgtacccgtctcgtcgggcctccgaggctaggaggtntacggacggtctagtaacttaccgtacgtcgtacctaacccttntaagtacgtacgaccgaacggtaccgtaaacggttaacggtttaacggggtttcgggggttacgggaacgggtaacgggtaaccgtacgggtaccggtacccgttccgtaaccggtaccgaccggtacccggtaacggtccccgtccccggtccccgttacggtaccctaccgttcccgttccccgttacccc

SEQ ID NO: 325402 - DNA, 652 bp, Homo sapiens
  misc_feature: GZ8MTXP02JWAVC.52.57.F02.1.454.CMB.2.raw
  modified_base (242)..(242): a, c, t, g, unknown or other
  misc_feature (242)..(242): n is a, c, g, or t
  modified_base (247)..(247): a, c, t, g, unknown or other
  misc_feature (247)..(247): n is a, c, g, or t
  modified_base (332)..(332): a, c, t, g, unknown or other
  misc_feature (332)..(332): n is a, c, g, or t
  modified_base (424)..(424): a, c, t, g, unknown or other
  misc_feature (424)..(424): n is a, c, g, or t
tcagcgcagtacgacacgaccggtgctcgatttagctcgatatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggatccagcagtgacgttggtncttangtactttgtctctggtaccaacaccacctgaccaaccgcccccaaactcatctattttgagtcaactagcgcctcgacgggtccngactcgtcttctcgtgtctacgacgtcgtcggacacgtccggtccctcccgtacgtccctcgtcgtcgggtcctccgaggtcctaggacggngtaggacggtctagtactttactacgttcgacctaccttacaagttacgtcgacgaacggaccgtaaaccgtaaagtttaacggggttttcggggggtttaccgacggggtaaacgggtaaccgtaaaggggttccgtacccggttaccgtacggtaccgacggtaccccgtaacggtcccgtcccggtcccccgtcggtacctccgtttccgtccgtttaacccccg

SEQ ID NO: 325403 - DNA, 754 bp, Homo sapiens
  misc_feature: GZ8MTXP02F3A2W.52.57.F02.1.454.CMB.2.raw
  modified_base (341)..(341): a, c, t, g, unknown or other
  misc_feature (341)..(341): n is a, c, g, or t
  modified_base (373)..(373): a, c, t, g, unknown or other
  misc_feature (373)..(373): n is a, c, g, or t
tcagcgcagtacgacacgaccggtgctcgatttagctcgatatagttgggtttggggtggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggatccagcagtgacgttggtgcttatgtactttgtctcctcggtaaccaaacaccaccctggcaaacgcccccaaatcatctattttgagtcactaagcgccctcgacggggtcccngactcgtcttcctcgtgctcgatctggcaacncggcctccctgacctctcgtcgggtcctccgaggcgtaggacgggtatggaacgggtcttaggtaactttaccgttaaccgttcggaccctaacccgttacgaactttaaacgtccggtaccgaacgggggaccgtaaaccgttaaaaacgggtttaaacggggtttttacggggggggtttttacccggggaacccgggggttaacgggggaaaaccccggtaaaagggggtttcccgggtaaacccggtttaccccggttaaaacccggttacccggaaacccggttaccccgggaaaaacccggggtcccgttaccccggggtaccccccccggtttacgggtacccttaccccggtttacccttttaacccccccgg

SEQ ID NO: 325404 - DNA, 638 bp, Homo sapiens
  misc_feature: GZ8MTXP02GYZ2J.52.57.F02.1.454.CMB.2.raw
tcagcgcagtacgacacgaccggtgctcgatttagctcgatatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggactccagcagtgacgttggtgcttatgtactttgtctctggtaccaacaccacctgacaaacgccccaactcatctattttgagtcactagcgcctcgacggtcctgactcgcttctccgtcgctacgagtctggacacgaccgcctccgtcgaccgtctcgtcgggctccgaggtctaggacggtagtggacggtctacgtacttacgtactcgacctaacctctatacgtcgacgacggacgaaacgttaaacggttaacgggtttttcgggggtttacggacggggtaacgggtaaaccgtaacggggttacgtaacccggttacgtaccggttaccgaaccggacccggttaaacggccgttaccccggaccccgttccgggtacctaccgttccgtttcccgtttcccccg

SEQ ID NO: 325405 - DNA, 582 bp, Homo sapiens
  misc_feature: GZ8MTXP02HNDQG.52.57.F02.1.454.CMB.2.raw
  modified_base (241)..(241): a, c, t, g, unknown or other
  misc_feature (241)..(241): n is a, c, g, or t
  modified_base (246)..(246): a, c, t, g, unknown or other
  misc_feature (246)..(246): n is a, c, g, or t
  modified_base (346)..(346): a, c, t, g, unknown or other
  misc_feature (346)..(346): n is a, c, g, or t
  modified_base (415)..(415): a, c, t, g, unknown or other
  misc_feature (415)..(415): n is a, c, g, or t
  modified_base (449)..(449): a, c, t, g, unknown or other
  misc_feature (449)..(449): n is a, c, g, or t
tcagcgcagtacgacacgaccggtgctcgatttagctcgatatagttgggtttgggggggtctcaggaggcagcgctctcaggacgtcaccaccatggcctgggctctgctcctcctcaccctcctcactcagggcacagggtcctgggcccagtctgccctgactcagcctccctcgcgtccgggtctcctggacagtcagtcaccatctcctgcactggatccagcagtgacgttggtncttangtactttgtctcctggtaccaacgacccaccctggacaaacgcccccaaatcatctattttgagtcactacgcgcctcgacgggtccctgactcgcttcncgtgctcgatcgtacggacaccgcggtaccctccgtacgaccgtctcgtcgggctccgaggctagagtncgagctgtacttacacgtgccctaactctatacncgaacgacggacaactaacgtacggttttacgggggttacgcgggaaccggtacgtagggtacgtaccgtcctaacgtcgacgtacccgaagccgtaccggcccctcggtacctccgtcgtttaccgtccccc

SEQ ID NO: 325406 - DNA, 653 bp, Homo sapiens
  misc_feature: GZ8MTXP02HLEYO.52.57.F02.1.454.CMB.2.raw
  modified_base (242)..(242): a, c, t, g, unknown or other
  misc_feature (242)..(242): n is a, c, g, or t
tcagcgcagtacgacacgaccggtgctcgatttagctcgatatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggatccagcagtgacgttggtncttatgtactttgtctcctggtaccaacaccacctggacaaacgcccccaaactcatctattttgagtcaatacgcgccctcgacgggtccctgactcgcttctccgtgctcgaacgtcgtaggacacgccgcctcctcgaccgtctcgtcggctccgaggctggagatgaggctagtacttactacgtcgacctaccttactatactcgacgaggaccaaacgtaaacgttaagggtttttacgggggtttaccggacggggtaaacgggtaaccgtaacgggttccggtaaccccgttaccggtaaccgttaccgaaacccggtaccccgtaaacggtccccgttaccccggtcccccccggttacggtacccttaaccccgttcccggtttacccgtttcccccccgg

SEQ ID NO: 325407 - DNA, 654 bp, Homo sapiens
  misc_feature: GZ8MTXP02IAW3Q.52.57.F02.1.454.CMB.2.raw
  modified_base (275)..(275): a, c, t, g, unknown or other
  misc_feature (275)..(275): n is a, c, g, or t
  modified_base (300)..(300): a, c, t, g, unknown or other
  misc_feature (300)..(300): n is a, c, g, or t
  modified_base (304)..(304): a, c, t, g, unknown or other
  misc_feature (304)..(304): n is a, c, g, or t
  modified_base (336)..(336): a, c, t, g, unknown or other
  misc_feature (336)..(336): n is a, c, g, or t
  modified_base (474)..(474): a, c, t, g, unknown or other
  misc_feature (474)..(474): n is a, c, g, or t
tcagcgcagtacgacacgaccggtgctcgatttagctcgatatagttgggtttggggtggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgactccagcagtgacgtttggtgcttatgtactttgtctcctggtaaccaacnccaccctggacaaacgccccaaatnactntatttgagtcactaacgcgcctcgagggtccngactcgtctcctcgtgtctcgagttcgtcgccaacgaccggtccctcccgtacgtacccgtcgtccgtccggggcctccgagggctaggaggtactggacggtctagtacttactacgtcgacccacttactattacncggacgaacggacgtaaacgtaaaccggtttaaggttttcggggggtttaccggacgggggttaaaccggggaccggttaaacggggtccgttaacccggtaccttacggacgaacccggtacccgaacgggcccttacccggtcccccgttagggtacccaccgtttaccgttcccccg

SEQ ID NO: 325408 - DNA, 650 bp, Homo sapiens
  misc_feature: GZ8MTXP02IWD7F.52.57.F02.1.454.CMB.2.raw
  modified_base (227)..(227): a, c, t, g, unknown or other
  misc_feature (227)..(227): n is a, c, g, or t
tcagcgcagtacgacacgaccggtgctcgatttagctcgatatagttggggggagccttccaacacccgggggggtccctgagactcacctgtgaagcctctggatttagatttagcagccatgccatgacctgggtccgccaggctccaggtcaggggctggagtgggtctcaggtattagcggaactggtgataccacgtactacgcggactctgtgaagggccncttcaccatctcgtagggacagttccaagacacgctgtatctgacaaatgaatagcctgagagtcgaggacacggtcgtttatactgtgacgaaagatcggagtcgactatgactggttttggagtcggaccaaagcgagtacggttccgcgtcgggggttcgacgtcggtacggggaccgaagggacccgacggtccgaccgtcgccctcgacgccctaccaccgaacgggcccctacgtccggtcccttcccccgcggtaccccctaccccttcccgtacccaacgacgaccctaccgttcgggcgggggaccaaccgcgggcccggcccgtcggggcctcggcccgtagggtaccgaacggtaccttacctttaccgaacgtttaacggacgtccgacgttacggacgggcccgggtcgg

SEQ ID NO: 325409 - DNA, 599 bp, Homo sapiens
  misc_feature: GZ8MTXP02JOWR2.52.57.F02.1.454.CMB.2.raw
  modified_base (248)..(248): a, c, t, g, unknown or other
  misc_feature (248)..(248): n is a, c, g, or t
  modified_base (324)..(324): a, c, t, g, unknown or other
  misc_feature (324)..(324): n is a, c, g, or t
  modified_base (376)..(376): a, c, t, g, unknown or other
  misc_feature (376)..(376): n is a, c, g, or t
  modified_base (384)..(384): a, c, t, g, unknown or other
  misc_feature (384)..(384): n is a, c, g, or t
tcagcgcagtacgacacgaccggtgctcgatttagctcgatatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggatccagcagtgacgttggtgtcttangacttgtctctgtaccacaccacctgacaacgccccaaactcatctattttgagtcatagcgcctcgacgggtccngactcgcttctccgtgctcgaagtctggacacgacgtcctcctcgaccgtcncgtcggcnccgaggtctggagagtgacgtctagacttactacgtcacctactctaatgtggacacgggactaacgtaacggttaaagggtttcgggggtttaccgggacgggttaaacggggacggtaaacggtcggtaacccgttccgtaacggtaccgacggtacccgaagggcctccggtcccccgtacggtccctaccgttccgtacccgtttcccccg

SEQ ID NO: 325410 - DNA, 733 bp, Homo sapiens
  misc_feature: GZ8MTXP02IG642.52.57.F02.1.454.CMB.2.raw
  modified_base (210)..(210): a, c, t, g, unknown or other
  misc_feature (210)..(210): n is a, c, g, or t
  modified_base (239)..(239): a, c, t, g, unknown or other
  misc_feature (239)..(239): n is a, c, g, or t
  modified_base (244)..(244): a, c, t, g, unknown or other
  misc_feature (244)..(244): n is a, c, g, or t
tcagcgcagtacgacacgaccggtgctcgatttagctcgatatagttgggtttgggggggtctcaggaggcagcgctctcaggacgtcaccaccatggcctgggctctgctcctcctcacccctcctcactcagggcacagggtcctgggcccagtctgccctgactcagcctcctcgcgtccggtctcctggacagtcagtcaccatcncctgcactggatccagcagtgacgttggncttangtactttgtctctgaccaacaccacctgacaacgaccccaatcatctattttgagtcatagcgcctgacggtcctgactcgtcttctcctcgctacgtaacgtcgtacggaccaccgtacgtcccgttcccgtacgtacccgttcgtccgttccggggaccttacccggacggtcgttacggaacgggtacgttacgggaacggtccgttaaggtaaccgttttaacctaccgttaccggtacccgttaacccgttaccgttaaatacggttacggtaccggaacgggtaaacccggtaaacgttaaaccgggtttaagggggtttttaccggggggtttaccgggaaccgggggtaaaacggggttaccgtaaacggggttaccgtaaacccgtttaccggtaaccgttaccgaaccggttacccgaaacggtcccgtaccggtacccccgtacggtacccttacgttaccgtttcccgttacccccg

SEQ ID NO: 325411 - DNA, 681 bp, Homo sapiens
  misc_feature: GZ8MTXP02FR7HX.52.57.F02.1.454.CMB.2.raw
tcagcgcagtacgacacgaccggtgctcgatttagctcgatatagttgggtttggggtggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctctgcactgatccagcagtgacgttggtgtcttatgtactttgtctctgtaccaacaccacctgacaacgaccccaaatcatctattttgagtacactaacgccgccctcgacgggtccctagactccgtcttccgtctcggtctacgtaacgtcgtacgggccaaaccgaccgggtcccttccccgtacgtaccccgtcgtccgtcggggaccctacccgaggtccgtagggaagggtaagtcgggaacggtcgttagtaaacgttactaacggttcgacctacccttacgtattaacgtcggacccgaggaccgtaaacgttaaaacggtttaacggggtttttcggggggtttaccgggaacggggtaaacggggtaaacccggtagggtaccggtacccgttaccgtacgtaccgacgtacccgaacggtccgtaccgtccccgtggtacctctccgttccccg

SEQ ID NO: 325412 - DNA, 706 bp, Homo sapiens
  misc_feature: GZ8MTXP02FWN7U.52.57.F02.1.454.CMB.2.raw
  modified_base (243)..(243): a, c, t, g, unknown or other
  misc_feature (243)..(243): n is a, c, g, or t
tcagcgcagtacgacacgaccggtgctcgatttagctcgatatagttgggtttggggggggtctcaggaggcagcgctctcaggacgtcaccaccatggcctgggctctgctcctcctcaccctcctcactcagggcacagggtcctgggcccagtctgccctgactcacgcctcctccgcgtccgggtctcctggacagtcagtcacatctcctgcactggactccagcagtcgacgttggntcttatcgtactttcgtctccgtaggtaccaacacctaccgtggaaccaaaccgacccccaaaactccaacttccttaagttttcgacggtactaacgtaacggccggtacccgtcgtacggggtcctagtacgtcgtcttcgtcgtcggtcctagaacgttcgtacggacctaccgtccgtccctacccgtcgtacccgttcgtcgtcgggtccctcggtaggtctaggaggtactaggacggtctacggttaactttaacctcgttacgaccctacgtactaagtacgtacgacggaacggtaaccgttaaacggttaacgggtttacggggtttccgggggtaaccgggacggggtaaacggtaccggtacgggtaccgtaccgtacgtacgtacgtaccgtaccggtacggtccgtcccggtacccgttcgtacgttaccgtccgttacccgttacccc

SEQ ID NO: 325413 - DNA, 689 bp, Homo sapiens
  misc_feature: GZ8MTXP02HO107.52.57.F02.1.454.CMB.2.raw
  modified_base (242)..(242): a, c, t, g, unknown or other
  misc_feature (242)..(242): n is a, c, g, or t
  modified_base (247)..(247): a, c, t, g, unknown or other
  misc_feature (247)..(247): n is a, c, g, or t
  modified_base (253)..(253): a, c, t, g, unknown or other
  misc_feature (253)..(253): n is a, c, g, or t
  modified_base (257)..(257): a, c, t, g, unknown or other
  misc_feature (257)..(257): n is a, c, g, or t
  modified_base (264)..(264): a, c, t, g, unknown or other
  misc_feature (264)..(264): n is a, c, g, or t
  modified_base (266)..(266): a, c, t, g, unknown or other
  misc_feature (266)..(266): n is a, c, g, or t
  modified_base (269)..(269): a, c, t, g, unknown or other
  misc_feature (269)..(269): n is a, c, g, or t
tcagcgcagtacgacacgaccggtgctcgatttagctcgatatagttgggtttgggggggtctcaggaggcagcgctctcaggacgtcaccaccatggcctgggctctgctcctcctcaccctcctcactcagggcacagggtcctgggcccagtctgccctgactcagcctccctcgccgtccggtctcctggacagtcagtccaccatctctgcactggactccagcagtgacgttggtncttangtcttnctcngtacacncnccngacaacaccccaatcatctatttgagtcacgtaagccgcctgtacgggtccctagactcgtccttcgtccgtcggtactcggtaacgtcgtaccggaccaccgtcccggtcccttcccgtccgtacccgttcgtccgttcggggccttacccggcgggtctacgggaggtacgtacggtacggttcgtaacgttaccttaccgtacgtccgtaaccctaccgttactaacgtacggacgtaccgtacggtaaccgtaaaaccgtttaacgggtttacgggggttttccggggttaccgggacggggtaaacgggtaaccggtaacgggtaccggtaaccgtaccgtacggtaccggaccgtacccgtaccgcccgtccccgtcccgttaccggtacctcccgttccgtttcccgtccccg

SEQ ID NO: 325414 - DNA, 726 bp, Homo sapiens
  misc_feature: GZ8MTXP02JYWWZ.52.57.F02.1.454.CMB.2.raw
  modified_base (242)..(242): a, c, t, g, unknown or other
  misc_feature (242)..(242): n is a, c, g, or t
tcagcgcagtacgacacgaccggtgctcgatttagctcgatatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggatccagcagtgacgttggtntcttatgtactttgtcctcctggtaccaacaccaccgtggacaaacgcccccaaactcatctattttgagtcactaacgcgtaccctgacgggtcctgactcgtcttctccgtggacctcgtaacgtcgtggaccacgaccggccctcccgtgacccgtctccgtcgggacccttccgaaggccgttaggacggtagtgggacggtaccgttaggtaacttacctaacgtccggtacctaaccccttactagttacgtacggtaccgaacgggtacccgtaaaccgtaaacccgggtttaaaggggtttttccgggggggtttaccgggacgggggtaacggggtaaacccgggtaacggggttaccggtaccccggtttacccgttaacgggtacccgaaccggtaccccgtaacgggtccgttaccccggccccccggttacgggtcccttaacccggttccgttacccggtttaccccccc

SEQ ID NO: 325415 - DNA, 608 bp, Homo sapiens
  misc_feature: GZ8MTXP02IAOEA.52.57.F02.1.454.CMB.2.raw
  modified_base (240)..(240): a, c, t, g, unknown or other
  misc_feature (240)..(240): n is a, c, g, or t
  modified_base (292)..(292): a, c, t, g, unknown or other
  misc_feature (292)..(292): n is a, c, g, or t
  modified_base (372)..(372): a, c, t, g, unknown or other
  misc_feature (372)..(372): n is a, c, g, or t
  modified_base (385)..(385): a, c, t, g, unknown or other
  misc_feature (385)..(385): n is a, c, g, or t
tcagcgcagtacgacacgaccggtgctcgatttagctcgatatagttgggtttggggtggggtctcaggaggcagcgctctcaggacgtcaccaccatggcctggctctgctcctcctcaccctcctcactcaggcacagggtcctgggcccagtctgccctgactcagcctccctccgcgtccgggtctcctggacagtcagtcaccatctcctgcactgatccagcagtgacgttggngcttatgtactttgtctctggtaccaacaccacctggacaacgccccaaacncatctattttgagtcactaacgcggccctcgcggggtccctgactcgtcttcctacgtgctacaacgtctacggcaaccnccggtacctcccncgaccgtctcgtcgggtcctcgacgcgtgacggtatggaggtctacgtattactacgtcgacctaccctcatagtcacgtagggacacgtaaaaccgttgggttttacgggggttacgggacggtacgggaaccgtaaaggggttccgtaaacccggtcctacgtacgacggtacccgaaggtccgtaccggtccccgtacgtccaccgttcccgtttacccg

SEQ ID NO: 325416 - DNA, 689 bp, Homo sapiens
  misc_feature: GZ8MTXP02FV2N1.52.57.F02.1.454.CMB.2.raw
  modified_base (227)..(227): a, c, t, g, unknown or other
  misc_feature (227)..(227): n is a, c, g, or t
tcagcgcagtacgacacgaccggtgctcgatttagctcgatatagttggggggagccttccaacacccgggggggtccctgagactcacctgtgaagcctctggatttagatttagcagccatgccatgacctgggtccgccaggctccaggtcaggggctggagtgggtctcaggtattagcggaactggtgataccacgtactacgcggactctgtgaagggccncttcaccatctcgtagggacagttccaagaacacgctgtatctgacaaatgaatagcctggacgagtacggaggaccgacggtccgtttaattacgtgtgacgaaagtagtacggaggtcgacagtgacgtagttttggaggtcgaccgaaagacggcgtacggttccgtacggttacggggttcgggcggttaccggtcgggggaccgtaaacggggacccgaccgggtccgtacccggtcccgccctcgtaccgtccctacccgacccggaaccgggtcccgtacgttcccggttcccctttcccccgtccggcccctacccctacccttaccgaacgccgacccgaccgtcggcggggaccacggacgccgggcccggtcgggccgtacggtcccgtggtaccgtaacgggtacccttacgttacctaacgtaccgacgtcgaccgtggcggcggtcgg

SEQ ID NO: 325417 - DNA, 711 bp, Homo sapiens
  misc_feature: GZ8MTXP02FN3YY.52.57.F02.1.454.CMB.2.raw
  modified_base (240)..(240): a, c, t, g, unknown or other
  misc_feature (240)..(240): n is a, c, g, or t
  modified_base (427)..(427): a, c, t, g, unknown or other
  misc_feature (427)..(427): n is a, c, g, or t
tcagcgcagtacgacacgaccggtgctcgatttagctcgatatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggatccagcagtgacgttggngcttatgtactttgtctccgtggtacccaacaccaccctggacaaacgcccccaatcatctattttgagtcacgtaagccgccctacgacggggtccctgactcgtctttctccgtcggtctacggaacgtcgtacggacaccgtaccgggccctaccgtcgtacccgtcgtcgtcgggcctaccgngtcgtaggacggtaagtcggacggtctacgttattaaacctacgttcggacctaaccttacagttaacgttcggacgaaccgggtacgtaaaccgtaaacgtttaacggggtttttacgggggtttaccgggacggggtaaccgggtaaccgtaaacggggttccgtaaccccggtttaccgtaaccggttaccgaaccgttacccgggaaaccggtcccgttacccggtccccccgtaccgggttaacctaccccgtttccgttaccccggttttcccccccg

SEQ ID NO: 325418 - DNA, 642 bp, Homo sapiens
  misc_feature: GZ8MTXP02JBLWV.52.57.F02.1.454.CMB.2.raw
  modified_base (246)..(246): a, c, t, g, unknown or other
  misc_feature (246)..(246): n is a, c, g, or t
  modified_base (477)..(477): a, c, t, g, unknown or other
  misc_feature (477)..(477): n is a, c, g, or t
tcagcgcagtacgacacgaccggtgctcgatttagctcgatatagttgggtttggggtggggtctcaggaggcagcgctctcaggacgtcaccaccatggcctgggctctgctcctcctcaccctcctcactcagggcacagggtcctgggcccagtctgccctgactcagccctccctccgcgtccggtctcctggacagtcagtcaccatctcctgcactggactccagcagtgtacgttggtncttatgtactttgtctctggtaccaacaccacctgaccaaacgccccaaatcatcttagttttgacgtacaactaacgccggtaccctcgtacgggtccctgactcgtcttcctcgtcgcctacgtacgtccgacggaccaaccgaccggtccctacccgtcgtacccgtctcgtcgggtcctccgaggcgtaggagatggacgtctagtacttacgtactcgacctactntatacgtcgaccgacggacgtaacgtaaacggtttaaggggtttcgggggttacgggacgggtaacgggtaaccgtagggtaccggtaccgtaccgtacgtaccgtaaccggacccgaacggtcccgacccgtccccgtcggtacctaccgttcccgtttccccg

SEQ ID NO: 325419 - DNA, 663 bp, Homo sapiens
  misc_feature: GZ8MTXP02JUKUV.52.57.F02.1.454.CMB.2.raw
tcagcgcagtacgacacgaccggtgctcgatttagctcgatatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctccgtggacagtcagtccaccatctcctgcactggactccagcagtgacgttggtgcttagtgtacttgtctccgtcgtaccaacaccaccgtggacaaaccgaccccctaaatctaattctagttttgacgtcaactagccgtccctcggtacggggtcctggtactcgtccttcgtccgtcggtacgtacgtaacgttcgtacggacctacccgccgggcccttccgtccgtaccgtccgtcgttccggggcctacccgaggtccgtagaggtagtggacggtctagtaacgttaccctaggtacgtccctaaacttcggtaaattcgtacggacgaacggtacgtaaacgttaacgggtttaggggtttcggggtacgggacgggtacgtaacggtacggaccgtaccgtacgtacgtcgaccgaccgacgtccgtccgtacccgtcgtacctacgttcccgtacctccc

SEQ ID NO: 325420 - DNA, 832 bp, Homo sapiens
  misc_feature: GZ8MTXP02JLMAB.52.57.F02.1.454.CMB.2.raw
  modified_base (139)..(139): a, c, t, g, unknown or other
  misc_feature (139)..(139): n is a, c, g, or t
tcagcgcagtacgacacgaccggtgctcgatttagctcgatatagttgggggagccttccaacacccgggggggtccctgagactcacctgtgaagcctctggatttagatttagcagccatgccatgacctgggtccnccaggctccaggtcaggggctggagtgggtctcaggtatagcggaactggtgataccacgtactacgcgactctgtgaagggccgcttcaccatctcgtagggactagttaccaagaacacgctgtatctgacaaatgaatacgcctggagagtcggaacggacgaccggttctttaatactgtacgacgaaagtctcggaacggtcgactacgtggtaacgtttaggtttttggacggttaccggaccgaaaagggcccggtacggtacgggtttcccggacggttaccgggggttacggaaccggtttcggacgggggaccgtaaacggggaccctaccgggtcccgaacccggttcccggaccctacgaccgtcccgtacccaacccggtaaacggggccccctacgttaccccggttcccctttccccccggacgggtcccctaccccccgtttacccgtaacccggaaaacggcccgtacccgtaaccccgttccgggggtaccgggggtacccaaacccggttaccggggccccgggtaacccccggttcgggggacccgttacccgggtcccggttacggggttaaacccgaaaccggggtaaacccgtttaccctttaacccgtaaacgttaacgttacggaaccgtttacccgggccgttaaaggggtaccggggtccccgggg

SEQ ID NO: 325421 - DNA, 617 bp, Homo sapiens
  misc_feature: GZ8MTXP02G2IIR.52.57.F02.1.454.CMB.2.raw
  modified_base (241)..(241): a, c, t, g, unknown or other
  misc_feature (241)..(241): n is a, c, g, or t
  modified_base (246)..(246): a, c, t, g, unknown or other
  misc_feature (246)..(246): n is a, c, g, or t
  modified_base (258)..(258): a, c, t, g, unknown or other
  misc_feature (258)..(258): n is a, c, g, or t
  modified_base (266)..(266): a, c, t, g, unknown or other
  misc_feature (266)..(266): n is a, c, g, or t
  modified_base (287)..(287): a, c, t, g, unknown or other
  misc_feature (287)..(287): n is a, c, g, or t
  modified_base (399)..(399): a, c, t, g, unknown or other
  misc_feature (399)..(399): n is a, c, g, or t
tcagcgcagtacgacacgaccggtgctcgatttagctcgatatagttgggtttgggggggtctcaggaggcagcgctctcaggacgtcaccaccatggcctgggctctgctcctcctcaccctcctcactcaggcacagggtcctgggcccagtctgccctgactcagcctccctccgcgtccgggtctcctggacagtcagtccaccatctcctgcactggatccagcagtgacgttggncttangtacttgtctcngtaccacnccacctggcaaacgccccaancatctattttgagtcactagccgcctcgacgggtccctgactcgcttctctgctcgtagtctaggctacgccggtcctaccgtcgtacccgtctcgtcgggctccgaggtcnggtaggatcggagctagtacttactactcggtctacctacatacgtgacgacggtaccgtaactaacggttaaggggttttcgggggtttaccgggacggggtaaccgggtaaccggtaacgggtacggtacccgttacccggtacgtacggacggtacccgaacggtcccgtccggtccccgtaccggtcctaccgtttccgttacggtttcccccc

SEQ ID NO: 325422 - DNA, 717 bp, Homo sapiens
  misc_feature: GZ8MTXP02FJ3Y2.52.57.F02.1.454.CMB.2.raw
  modified_base (215)..(215): a, c, t, g, unknown or other
  misc_feature (215)..(215): n is a, c, g, or t
  modified_base (241)..(241): a, c, t, g, unknown or other
  misc_feature (241)..(241): n is a, c, g, or t
  modified_base (558)..(558): a, c, t, g, unknown or other
  misc_feature (558)..(558): n is a, c, g, or t
tcagcgcagtacgacacgaccggtgctcgatttagctcgatatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcngcacgtgactcagcagtgtacgtggntacttatcgtactttgtaccttccgtacgtaacccaaccacccaccgtcggaacctaaaccccgacccccctaaatacctactttactttaacgtttttacggacggtacctaaacgtaccggccccggtcccctacgggtacccggggttcctaggtccgttccgttacctttccgtccggtgaccgttaacgtaacgttcgaccgaaccaacccggtccggtccccttcgtacgtaccctcgtccgtcgggtccctcgacggtcaggggacgatagggacctagttacgtaacttaccgactcgaccctactaanagttacgacgacgaccggtaactaaacggttacgggtttacggggtttaccggggtacggacgggtaacggtaccggtacggtccgtaaccgtacgtacgaccgacgaccggtaccgccgtccccggtacccgtctaccgtacgtcccttacccacccg

SEQ ID NO: 325423 - DNA, 560 bp, Homo sapiens
  misc_feature: GZ8MTXP02I5A3N.52.57.F02.1.454.CMB.2.raw
  modified_base (227)..(227): a, c, t, g, unknown or other
  misc_feature (227)..(227): n is a, c, g, or t
  modified_base (325)..(325): a, c, t, g, unknown or other
  misc_feature (325)..(325): n is a, c, g, or t
  modified_base (341)..(341): a, c, t, g, unknown or other
  misc_feature (341)..(341): n is a, c, g, or t
  modified_base (373)..(373): a, c, t, g, unknown or other
  misc_feature (373)..(373): n is a, c, g, or t
  modified_base (472)..(472): a, c, t, g, unknown or other
  misc_feature (472)..(472): n is a, c, g, or t
tcagcgcagtacgacacgaccggtgctcgatttagctcgatatagttggggggagccttccaacacccgggggggtccctgagactcacctgtgaagcctctggatttagatttagcagccatgccatgacctgggtccgccaggctccaggtcaggggctggagtgggtctcaggtattagcggaactggtgataccacgtactacgcggactctgtgaagggccncttcaccatctctagggacagttccaagaacacgctgtatctgcaaaatgaatagcctgagagtcgaggacacggccgtttatactgtgacgaaaagntcgaggtcgcatgacngtttttggagtggccaaaagcggcaggttccnctacggggttgacgtctggggccaaagggccaggtcaccgtcgcctcagctcaccaaggacccatcgtctcccctcgcaccctcctccacgagcacccncgtcgggcgacgacgcgccgtcggcgtcgccgtcggtacgaacggaactaacttacctaacgtacgaacgtcgcgtacgacggcggcg

SEQ ID NO: 325424 - DNA, 696 bp, Homo sapiens
  misc_feature: GZ8MTXP02FH9IF.52.57.F02.1.454.CMB.2.raw
  modified_base (243)..(243): a, c, t, g, unknown or other
  misc_feature (243)..(243): n is a, c, g, or t
tcagcgcagtacgacacgaccggtgctcgatttagctcgatatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggactccagcagtgacgttggncttatgactttgtctcctggtaccaacaccacccgtggaccaaacgacccccaaactcatctattttgagtcactaagccgcctcgacgggtccctgactcgtctttctccgtcggcctacgtaagtcgtcggacctaccgccgggaccctccgtcgacccgttctcgtcgggcctccgaggtcgtaggacggagttcggacggtaccgtagtactttaaccgtacgttacgacctaacccgttcaacgttacgttacggaccgacgggtaccgaaacgtaaaccggtttaagggttttcggggggtttaccgggacggggtaacggggtaacccgtaaaggggttccgtacccggttaccgttaacggttaccgaccggacccgtaacggcccgttacccggtacccccggttccgggtacctaccggttcccgtttacccggttccccccg

SEQ ID NO: 325425 - DNA, 620 bp, Homo sapiens
  misc_feature: GZ8MTXP02GIUH6.52.57.F02.1.454.CMB.2.raw
  modified_base (241)..(241): a, c, t, g, unknown or other
  misc_feature (241)..(241): n is a, c, g, or t
  modified_base (360)..(360): a, c, t, g, unknown or other
  misc_feature (360)..(360): n is a, c, g, or t
  modified_base (409)..(409): a, c, t, g, unknown or other
  misc_feature (409)..(409): n is a, c, g, or t
tcagcgcagtacgacacgaccggtgctcgatttagctcgatatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctctgcactggatccagcagtgacgttggngtcttatgtacttgtctcctagtaccaacaccacctggaccaaacgaccccaactcatctattttgagtcactagccgcctcgacggtcctgactcgtcttctccgtcgctacgagtcnggacacgccgtcctccgtgaccgtctcgtcggcctcgaggcgtagacgngtagacggtctagtacttacgacttacgacctacctactagtactcggacgaaggaccgtaaacgtaacggtttaagggtttcgggggtttacggacggggtaacggtaccgtaaagggtccgtaacccgtaccgtaacgtaccgaccgaccgtaacggtccgtacccggcccccgttacggtaccctaccgttccgtaccgtttcccccg

SEQ ID NO: 325426 - DNA, 808 bp, Homo sapiens
  misc_feature: GZ8MTXP02I67P2.52.57.F02.1.454.CMB.2.raw
  modified_base (199)..(199): a, c, t, g, unknown or other
  misc_feature (199)..(199): n is a, c, g, or t
tcagcgcagtacgacacgaccggtgctcgatttagctcgatatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacngtcagtcaccatctctgcatgactccagcagtgacgttggtgtcttagtgtactttgtcctccgtacgtaaccaacctacccgtaccgtacggaaaccaaaccccgtaaccccctaaatcctaactttacgtttaacgtttttacggacgttaaccaaacggtaaccggccccggtaccccttacgggtaccggggttcccttaaagtccgttccgtaccgtttccgtccggtccggtaccgttaaccggtaacgttccggtaccgaacccgacccggggtcccgtacccccgttccgtaacccgggtacccttccggtacgggtccgggtaacccgtcggacggtaccgttaggaaacggtgtaacggtccggtgttaacgtaacgtttacctacggtacccgtacccttacgtacttagtaacggttacggaacgggaccgtaaaccggttaaacgttaacggggtttaacgggggttttcgggggttacgaaacggggaccggttaaaacgtcgggtaccgtacccgtaacgtcgtacgaaaccggcctaacgtccccgtccggtaccccgtggttaccctccgttaccggttccccgttaccccc

SEQ ID NO: 325427 - DNA, 583 bp, Homo sapiens
  misc_feature: GZ8MTXP02F2GV7.52.57.F02.1.454.CMB.2.raw
  modified_base (242)..(242): a, c, t, g, unknown or other
  misc_feature (242)..(242): n is a, c, g, or t
  modified_base (247)..(247): a, c, t, g, unknown or other
  misc_feature (247)..(247): n is a, c, g, or t
  modified_base (349)..(349): a, c, t, g, unknown or other
  misc_feature (349)..(349): n is a, c, g, or t
  modified_base (355)..(355): a, c, t, g, unknown or other
  misc_feature (355)..(355): n is a, c, g, or t
  modified_base (364)..(364): a, c, t, g, unknown or other
  misc_feature (364)..(364): n is a, c, g, or t
  modified_base (425)..(425): a, c, t, g, unknown or other
  misc_feature (425)..(425): n is a, c, g, or t
tcagcgcagtacgacacgaccggtgctcgatttagctcgatatagttgggtttggggtggggtctcaggaggcagcgctctcaggacgtcaccaccatggcctgggctctgctcctcctcaccctcctcactcagggcacagggtcctgggcccagtctgccctgactcagcctccctcgcgtccgggtctcctggacagtcagtcaccatctcctgcactggatccagcagtgacgttggncttangactttgctctggtaccacaccacctggacaaacgccccaaatcatctatttgagtcactagcgccctgagggtccctgatcgtctcctctggctcgagtcnggcacncggcctccngaccgtctcgtgggctaccgagctagacgatgacggtctagacttactactcgactacctnactagtgaccaggacgaactaaacgttagggtttcgggggtttacggacgggtaacgggtaccgtaaagggttcggaaccgttacgtacgtaccgacggtacccgaacggggtcctaccggtcccccgttagggtcctacccgttaccgtttccccgg

SEQ ID NO: 325428 - DNA, 657 bp, Homo sapiens
  misc_feature: GZ8MTXP02FSIRD.52.57.F02.1.454.CMB.2.raw
  modified_base (215)..(215): a, c, t, g, unknown or other
  misc_feature (215)..(215): n is a, c, g, or t
  modified_base (239)..(239): a, c, t, g, unknown or other
  misc_feature (239)..(239): n is a, c, g, or t
tcagcgcagtacgacacgaccggtgctcgatttagctcgatatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcacatctctncactgatccagcagtgacgttggngtcttatgtactttgtctcctaggtaccaacaccacctggaccaaacgaccccaaactcactctattttcgacggtacacgtaagccgtccgtcgacgggtcctgactcgcttctcctcgtctagacgtctcggacacgcgccctcctcgacctctcgtcgactcgagcgtagaggactggacgtacgtagtacttaacgtacgtacgcctaaaccgttctaactagtacgggacgaacggaacggtaacgtaaacgtttaacggggttttcgggggtttaccgggaccgggggtaacgtaaccggtaaggggtaccgtaacccggggttaccaccggttacgaacccggacccgttaaccgggccgttaccccggcccccgttcgggaccctacttccccggttcccttaacccccg

SEQ ID NO: 325429 - DNA, 664 bp, Homo sapiens
  misc_feature: GZ8MTXP02GB3P9.52.57.F02.1.454.CMB.2.raw
  modified_base (245)..(245): a, c, t, g, unknown or other
  misc_feature (245)..(245): n is a, c, g, or t
  modified_base (464)..(464): a, c, t, g, unknown or other
  misc_feature (464)..(464): n is a, c, g, or t
tcagcgcagtacgacacgaccggtgctcgatttagctcgatatagttgggtttggggggggtctcaggaggcagcgctctcaggacgtcaccaccatggcctgggctctgctcctcctcaccctcctcactcagggcacagggtcctgggcccagtctgccctgactcacgccctccctccgcgtccggtctcctggacagtcagtccacatcctctgcacgtgactccagcagtgtacgttggntcttatgtactttgtctcgtcgtaccaacacccaccgtgaccaaacgacccccaaatcatacctagttttagacgtacaactaacgccgtacctcgacgggtcctgactcgtcttactccgtgtcctagtaacgttcgacgaaccaccgaccggcccttacccgtacgtcccgttcgtcgtcgggtcctccgacggtcgtaggaggaagttggacggtnttagtaactactagtcgtaccactacattacgcgagaccgacgtaaacgtaaacggtttagggtttcgggggttaccggacggggtaacggtaaccggtacggttacggtaccccgttacgttaaccgaccgaccgacccgaaacgtcccgtacccgtacccccggtcgtaaccctccgttaccgtccctttaacccccg

SEQ ID NO: 325430 - DNA, 612 bp, Homo sapiens
  misc_feature: GZ8MTXP02F4HTU.52.57.F02.1.454.CMB.2.raw
  modified_base (247)..(247): a, c, t, g, unknown or other
  misc_feature (247)..(247): n is a, c, g, or t
  modified_base (276)..(276): a, c, t, g, unknown or other
  misc_feature (276)..(276): n is a, c, g, or t
  modified_base (299)..(299): a, c, t, g, unknown or other
  misc_feature (299)..(299): n is a, c, g, or t
  modified_base (338)..(338): a, c, t, g, unknown or other
  misc_feature (338)..(338): n is a, c, g, or t
  modified_base (410)..(410): a, c, t, g, unknown or other
  misc_feature (410)..(410): n is a, c, g, or t
tcagcgcagtacgacacgaccggtgctcgatttagctcgatatagttgggtttggggtggggtctcaggaggcagcgctctcaggacgtcaccaccatggcctgggctctgctcctcctcaccctcctcactcagggcacagggtcctgggcccagtctgccctgactcagccctccctcgcgtccgggtctcctggacagtcagtcaccatcctcctgcactggactccagcaggtcgacgttggntcttatgtactttgctcctggtaccaacnccacctgacaaaccgccccaaancatctatttgagtcactaacgcgccctcgacgggtcccngacgtcgtccttctctgctacgaagtctagccaacgaccgtcctcctacgaccgttctcgtcggcctaccgngctgagatggagctgtattactacgtcgacctacctacgattacgtcgacgacgtaacgtaacgtaaacggtttaacgggtttcgggggtttacgggaccgggttaaacgggaccgtagggtaccgtaccgttaccgttaccgacgtaccgacccggaacggttccgaccggtaccccgtcgtcgtaccgttctttaccccg

SEQ ID NO: 325431 - DNA, 706 bp, Homo sapiens
  misc_feature: GZ8MTXP02IFOFQ.52.57.F02.1.454.CMB.2.raw
  modified_base (226)..(226): a, c, t, g, unknown or other
  misc_feature (226)..(226): n is a, c, g, or t
  modified_base (322)..(322): a, c, t, g, unknown or other
  misc_feature (322)..(322): n is a, c, g, or t
tcagcgcagtacgacacgaccggtgctcgatttagctcgatatagttgggggagccttccaacacccgggggggtccctgagactcacctgtgaagcctctggatttagatttagcagccatgccatgacctgggtccgccaggctccaggtcaggggctggagtgggtctcgaggtattagcggaactggtgataccacgtactacgcggactctgtgagggccncttcaccatctctagggacagttccaagaacacgctgtatctgacaatgaatagcctgagagtcgaggacacggtcgtttatactgtgacgaaagntcggaggtcgctagtgtaacgttaggttttacggagttaccggaccgtaaaggaccgggtacgtacgggttcccgcggttacgggggttcggaccggttcggtacgggggaccgaaacgggggacccgtaccgggtccgacccggtccgcccgtcgacgccctacccgaacccgtaacgggcccctacgtcccggttcccttcccccgtcggccctaccccttcccgtaccgaacggccgacctaccgtcgggtcgggggaccctacggaccggcccgggtcccggtcgggtccgtaccggtcccgttacgggaacgtaccgggtacctttaccttaccgtaacgtaccggtacgtcggtacgtcggacggtccggggtaccgg

SEQ ID NO: 325432 - DNA, 667 bp, Homo sapiens
  misc_feature: GZ8MTXP02F06WG.52.57.F02.1.454.CMB.2.raw
  modified_base (246)..(246): a, c, t, g, unknown or other
  misc_feature (246)..(246): n is a, c, g, or t
  modified_base (361)..(361): a, c, t, g, unknown or other
  misc_feature (361)..(361): n is a, c, g, or t
tcagcgcagtacgacacgaccggtgctcgatttagctcgatatagttgggtttggggggggtctcaggaggcagcgctctcaggacgtcaccaccatggcctgggctctgctcctcctcaccctcctcactcagggcacagggtcctgggcccagtctgccctgactcagcctccctcgcgtccgggtctcctggacagtcagtcaccatcctcctgcacgtggactccagcagtgtacgttggtntcttatgtactttgtctccgtaggtacccaactacccaccgtggaacctaaaccgacccccaaactcacttctattttgacgtcactagcgcctgacggtcctgactcgtcttcncgtcgctacgagtcgtcggacacgccggtcctacccgtcgtacccgttctccgtcgggtccctaccgtacgttcgtaggaggtacgtaggacgtcgtagttacttacctagtacaccaccttacattgacgacgacggaccgtaaacgttaacggtttaacggggtttcgggggttaccggtacggggtaaccgggtaaccgtaaaggggttaccgtaaccggttacccgtaaacggtccgaacgacccgtaacggcccgttcccggtccccgttacgtaccgtccgtccttacccggtttccccc

SEQ ID NO: 325433 - DNA, 427 bp, Homo sapiens
  misc_feature: GZ8MTXP01DTYFJ.44.79.H02.1.454.CMB.2.raw
  modified_base (423)..(427): a, c, t, g, unknown or other
  misc_feature (423)..(427): n is a, c, g, or t
tcagacagtatatacacgaccggtgctcgatttagtgtcacacgaagggaaaggggctggagtgggtggccaacgtgaggcaagatggagttagtaaatactatgcggacagtttgaagggccgattcaccatctccagagacaacgccaagaactctctgtatctgcaaatgaccagcctgagagtcgaggacacggctgtgtattactgtgcgaccatatcagcgcctggagtccgttctgagtacttccaagattggggccagggcaccctggtcaccgtcgcctcagcctccaccaggcccatcgtctcccctgcgccctgctccagagcacctcccgagagcacagccgccctgggctgcctggtcaaggactacttcctatatactgtctgagcgggctggcaaggcacgatagggnnnnn

SEQ ID NO: 325434 - DNA, 439 bp, Homo sapiens
  misc_feature: GZ8MTXP01A2BTD.44.79.H02.1.454.CMB.2.raw
  modified_base (430)..(439): a, c, t, g, unknown or other
  misc_feature (430)..(439): n is a, c, g, or t
tcagacagtatatacacgaccggtgctcgatttagtgtcacacgaagggaaagggctggagtgggtggccaacgtgaggcaagatggagttagtaaatactatgcggacagtttgaagggccgattcaccatctccagagacaacgccaagaactctctgtatctgcaaatgaccagcctgagagtcgaggacacggctgtgtattactgtgcgaccatatcagcgcctggatccgttctgagtacttccaagattggggccagggcaccctggtcaccgtcgcctcagcctccaccaacgggccccatccggtccttccccctggccgcccctgcctccaggacgcacctccccgagagcacagcggccctgggctgcctggtcaaggctactcatatactgtctgagcgggctggcaggcgcataggnnnnnnnnnn

SEQ ID NO: 325435 - DNA, 617 bp, Homo sapiens
  misc_feature: GZ8MTXP01AH943.4.53.E09.1.454.CMB.2.raw
  modified_base (295)..(295): a, c, t, g, unknown or other
  misc_feature (295)..(295): n is a, c, g, or t
  modified_base (308)..(308): a, c, t, g, unknown or other
  misc_feature (308)..(308): n is a, c, g, or t
tcagagcactgtagcacgaccggtgctcgatttagagagagtgtgttgggtttgggggtccctgagactctcctgtacagtctctgcatctaccttcactttcttttggatgacctggctccgccgggctccgagggaggggctggagtgggtggccaccatcaaatcaaagatggaagtgagagaacctatgtggactctgtgaaggccattcacatctcagagacaacgccaaagattctctgtatctgacaaatgaacagccagagagccgaggactcggctgtctattacngtgacgaaggaanaagtattactatgaattaacaagtgaactagtgggctggtcccgacccgtgggggacccaacggggaccctgggtccacccgtctcctcgacgccctaccgaaccgaacgggcccctagttcccggttcccttcccccgtggcccgccctgcctccgaggacgccacccgtccgaagacgccacgtacggccggcccgtggggcctcggcccgttaagggtaaccaaacgggtaccttacccgttacccgtaacgacggttcggccttccggtggaacgggccggggcgttcgggaacgaacgggtccg

SEQ ID NO: 325436 - DNA, 584 bp, Homo sapiens
  misc_feature: GZ8MTXP02FIII7.4.53.E09.1.454.CMB.2.raw
  modified_base (291)..(291): a, c, t, g, unknown or other
  misc_feature (291)..(291): n is a, c, g, or t
  modified_base (302)..(302): a, c, t, g, unknown or other
  misc_feature (302)..(302): n is a, c, g, or t
  modified_base (320)..(320): a, c, t, g, unknown or other
  misc_feature (320)..(320): n is a, c, g, or t
  modified_base (335)..(335): a, c, t, g, unknown or other
  misc_feature (335)..(335): n is a, c, g, or t
  modified_base (473)..(473): a, c, t, g, unknown or other
  misc_feature (473)..(473): n is a, c, g, or t
  modified_base (560)..(560): a, c, t, g, unknown or other
  misc_feature (560)..(560): n is a, c, g, or t
tcagagcactgtagcacgaccggtgctcgatttagagagagtgtgttgggtttggggggtccctgagactctcctgtacagtctctgcatctaccttcactttctttttggatgacctggctcccgccgggctccgaggggaggggctggaggtgggtggccaccatcaatcaagatggaagtgagagaacctatgtggactctgtgaaggccattcaccatctccagagacaacgcaaagaattctctgtatctgacaaaatgaaacagcctgagagccgaggactcggntgtctattacngtgcgaggaagattatanatgaatacaagtganagtgggctggttccgacccccgtggggacccaggggaacccctggtaccacccgtctccctcacgccctccgaaacccgaacgggccccagtcccggttcccttcccccgtggcccgtccctcgccgtaccgaggacnccgacccgtccgagacgccacgacggccggccgtgggcctcgccgtcggtaccaaaggtacctaccgttacccacgacgtcgctcgngacggtcgggctcggacgacggcg

SEQ ID NO: 325437 - DNA, 550 bp, Homo sapiens
  misc_feature: GZ8MTXP01BLCYL.25.51.E07.1.454.CMB.2.raw
  modified_base (403)..(403): a, c, t, g, unknown or other
  misc_feature (403)..(403): n is a, c, g, or t
  modified_base (442)..(442): a, c, t, g, unknown or other
  misc_feature (442)..(442): n is a, c, g, or t
  modified_base (482)..(482): a, c, t, g, unknown or other
  misc_feature (482)..(482): n is a, c, g, or t
  modified_base (489)..(489): a, c, t, g, unknown or other
  misc_feature (489)..(489): n is a, c, g, or t
  modified_base (491)..(491): a, c, t, g, unknown or other
  misc_feature (491)..(491): n is a, c, g, or t
  modified_base (506)..(506): a, c, t, g, unknown or other
  misc_feature (506)..(506): n is a, c, g, or t
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggtctttttcttgtggcttcttttaaaaggtgtccactgtgacgtgcagctattggagtcgtgggggagcttggtgcaggccgggaggtccctagctctcctgtacagcgtctggattgcctttggcagccatcgccctgggctgggtcccgccgaggggtccaggggaaggcctggagtgggtctcaaatgtgactccgtggcccggtagtgtcacactctaacgcggactcgtgtgaacggccccgnttcacaatatcagagacaattcaagtactacccttttanactaatacaacgaactagagagacgacgacgacgtacctntatatgngngagagtagagacgcnccgcgttacgtaactagtgttacttacgttaacgtgtttcgtcg

SEQ ID NO: 325438 - DNA, 571 bp, Homo sapiens
  misc_feature: GZ8MTXP01AIXBC.25.51.E07.1.454.CMB.2.raw
  modified_base (409)..(409): a, c, t, g, unknown or other
  misc_feature (409)..(409): n is a, c, g, or t
tcagactgtacagtcacgaccggtgctcgatttagcatactctacaacacacaaaggggtctgagagaggagcccagccctgggattttcaggtgtttcatttggtgatcagggctgaacagagagaactcaccatggagtttgggctgaactggctttttcttgtggctcttttaaaaggtgtccactgtgacgtgcagctattggagtcgtgggggagcttggtgcaggccgggaggtccctgagactctcctgtacagcgtctggattgccttggcagccatgccctgggctgggtccgcgagggtccaggggaggcctgggagtgggtctcgaaatgtgactccgtggcggtagtgtcacaactctaacgcgggactcgtgtgaacggcccgtcttacacaatanccagagaacaacttaccaacggaccttaccctttttagacctaaatacggaacaaccgtgagagacgagacacggccctctatattgtgcgagacgttgaggaagacgttcccgcctcgggtacctaaagtcgggtatttacgtaaacgttggttttaacgg

SEQ ID NO: 325439 - DNA, 560 bp, Homo sapiens
  misc_feature: GZ8MTXP01DRHHG.25.51.E07.1.454.CMB.2.raw
  modified_base (417)..(417): a, c, t, g, unknown or other
  misc_feature (417)..(417): n is a, c, g, or t
  modified_base (448)..(448): a, c, t, g, unknown or other
  misc_feature (448)..(448): n is a, c, g, or t
  modified_base (494)..(494): a, c, t, g, unknown or other
  misc_feature (494)..(494): n is a, c, g, or t
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggtctttttcttgtggcttcttttaaaaggtgtccactgtgacgtgcagctattggagtcgtgggggagcttggtgcaggccgggagggtccctgagactctcctgtacagcgtctggatttgccttggcagccatgccccgtgggctgggtcccgccgagggtcccgaggggaagggcctgggagtgggtctcaaatgtgactcctggcggtagtgtcacaactctaacgcggactcgtgtgaacggcccgcttcacaatanccagagacaattcaacgactaccctttttanactaatacgaacaacagagagacgacgacgacgcctctatatgtgngagacgagagaacgacgccgccgtcgtacgtaacgtagttacgttacgttaacgttaaggtttaag

SEQ ID NO: 325440 - DNA, 580 bp, Homo sapiens
  misc_feature: GZ8MTXP01A8RB5.25.51.E07.1.454.CMB.2.raw
  modified_base (261)..(261): a, c, t, g, unknown or other
  misc_feature (261)..(261): n is a, c, g, or t
  modified_base (411)..(411): a, c, t, g, unknown or other
  misc_feature (411)..(411): n is a, c, g, or t
  modified_base (421)..(421): a, c, t, g, unknown or other
  misc_feature (421)..(421): n is a, c, g, or t
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggtctttttctgtggctcttttaaaaggtgtccactgtgacgtgcagctattggagtcgtgggggagcttggtgcaggccgggaggtccctgagactctcctgtacngcgtctggatttgccttggcagccatcgccctgggctgggtccgcgagggtccgaggggaggcctgggagtggggtctacgaaatggtgactccgtggtcgggtagtggtccacaactcgtaacgcggtactcgtgtcgaacgggccctnttcacaatanccagagaacaacttaccaacgtacttaccctttttagactaaatacggaacactgagagacgagacacgcctctatatgtgcgagacgttgaggaacgccgttaccgccgtaacggtaccctaagtcggttactttacgtaaaccggttgttttaacgg

SEQ ID NO: 325441 - DNA, 787 bp, Homo sapiens
  misc_feature: GZ8MTXP01DH7ZF.25.51.E07.1.454.CMB.2.raw
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggtctttttcttgtggctcttttaaaaggtgtccactgtgacgtgcagctattggagtcgtgggggagcttgggtgcaggccgggagggtccctgagactctcctgtacagcgtctggtatttgccttggcagccatcgccccgtgggctcgggtcccgccgagggtcccgagggggaacgggccgtgggaggtcgggggttactacgaaaagttggtacgacttcccgtggggccgggttagtcggttccaaccgtaacccgttcctaaccgggcgggtaaccttcgttggtacggaacgggccccgtacttacaactaaatactacccaagaacgaactaaactttaccgaaacgggtaaccttaaccccgttttttacgaaacctaaaacgttaacggtaaaaccgtaaacccgttaggaaacggtaacggaaaccgggaacgggaaacccgtaaacccggggtaccccttaaccgtttaactttaacgtttggttaacggaccggttaaggtaaccgttaggaaacgggtaacgttacccggttcccggttacccggttaacgggtaaccctaaagtttacgggttaacgttttaaccgttaaacgggtttaacgggtttttaaccggg

SEQ ID NO: 325442 - DNA, 545 bp, Homo sapiens
  misc_feature: GZ8MTXP01D3NP0.25.51.E07.1.454.CMB.2.raw
  modified_base (350)..(350): a, c, t, g, unknown or other
  misc_feature (350)..(350): n is a, c, g, or t
  modified_base (404)..(404): a, c, t, g, unknown or other
  misc_feature (404)..(404): n is a, c, g, or t
  modified_base (447)..(447): a, c, t, g, unknown or other
  misc_feature (447)..(447): n is a, c, g, or t
  modified_base (496)..(496): a, c, t, g, unknown or other
  misc_feature (496)..(496): n is a, c, g, or t
  modified_base (514)..(514): a, c, t, g, unknown or other
  misc_feature (514)..(514): n is a, c, g, or t
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggctttttctgtggctcttttaaaaggtgtccactgtgacgtgcagctattggagtcgtgggggaggcttgggtgcagccgggagggtccctgagactctcctgtaccagcgtctggattgccttggcagccatcgcccctgggctgggtccgccagggtccagggggaaggcctgggagtgggtctcgaaatgtnactccgtggcggtagtgtcacgaactctcgcggactctgtcgaacgggcccgtnttcacaatatccagagaacaattaccaaggtactacccttttnacaataggaaactactagagagacgaggacacggccctctattatgtgngagcttgagagacgttcnctggtacaagtgtattactaagttgtttaag

SEQ ID NO: 325443 - DNA, 583 bp, Homo sapiens
  misc_feature: GZ8MTXP01D6M5K.25.51.E07.1.454.CMB.2.raw
  modified_base (443)..(443): a, c, t, g, unknown or other
  misc_feature (443)..(443): n is a, c, g, or t
  modified_base (448)..(448): a, c, t, g, unknown or other
  misc_feature (448)..(448): n is a, c, g, or t
  modified_base (515)..(515): a, c, t, g, unknown or other
  misc_feature (515)..(515): n is a, c, g, or t
  modified_base (521)..(521): a, c, t, g, unknown or other
  misc_feature (521)..(521): n is a, c, g, or t
  modified_base (524)..(524): a, c, t, g, unknown or other
  misc_feature (524)..(524): n is a, c, g, or t
  modified_base (526)..(526): a, c, t, g, unknown or other
  misc_feature (526)..(526): n is a, c, g, or t
  modified_base (529)..(529): a, c, t, g, unknown or other
  misc_feature (529)..(529): n is a, c, g, or t
tcagactgtacagtcacgaccggtgctcgatttagcatactctacaacacacaaaggggtctgagagaggagcccagccctgggattttcaggtgtttttcatttggtgatcagggctgaacagagagaactcaccatggagtttgggctgaactggtctttttcttgtggcttctttttaaaaggtgtccactgtgacgtgcagcttagttggagtcgtgggggaggcttgggtgcaggccgggaggtccctgagacctctcctgtacagcgtctggtatttgccgttggcagcccatcggccccgtgggctcgggtcccgccgagggtccgagggggaacggccgtgggagtggggttctacgaaagttgtgactccgtggccggtagtcgtcactaactctcggcgtactcgtgtacgacggcccgtcttacactatacncaganaacaattaccagtaccttaccctttttgacctaaatcggaaacactagagagacgagacacgccctntagttntgngngancgagacgacgacgccgcgtaacgtactaagttgttattacgtaacgttggttcg

SEQ ID NO: 325444 - DNA, 546 bp, Homo sapiens
  misc_feature: GZ8MTXP01C0W7P.25.51.E07.1.454.CMB.2.raw
  modified_base (303)..(303): a, c, t, g, unknown or other
  misc_feature (303)..(303): n is a, c, g, or t
  modified_base (335)..(335): a, c, t, g, unknown or other
  misc_feature (335)..(335): n is a, c, g, or t
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggctttttctgtggctcttttaaaaggtgtccactgtgacgtgcagctattggagtcgtgggggagcttgggtgcagccgggagggtccctgagactctcctgtacagcgtctggattgccttggcagccatgccctgggctgggtccncgagggtccagggaaggcctgggagtgggtcncaaagtgtgacgtccgtggcggtagtgtcacaactctaacgcggtactctgtgaacggcccgcttcacatactcagagacaacttcaaggactacctttttgacaaattcggaacaacctagagagacgagacgaaccggcctctattatgtgcgagacgttgagtaagaccgttcgcctggaccaagtgtattactaacgttgtttaacg

SEQ ID NO: 325445 - DNA, 664 bp, Homo sapiens
  misc_feature: GZ8MTXP01EP3FG.25.51.E07.1.454.CMB.2.raw
  modified_base (407)..(407): a, c, t, g, unknown or other
  misc_feature (407)..(407): n is a, c, g, or t
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggctttttcttgtggctcttttaaaaggtgtccactgtgacgtgcagctattggagtctgggggaggcttgggtgcaggccgggagggtccctgagactctcctgtacagcgtctggattgccttggcagccatgccctgggctgggtccgccgagggtcccgaggggaacgggcctgggagtggggtctcaaatgtgactcgtggcggtagtgtcaccaactctcgcggactctgtacggaacggccccgtnttcacaatactaccagacgaactaacttaccaacggtacctacccttttttgacctaaagttacgggaaactaaacccgtagaagaacggaacggacggaaccgtaaacccgggccccttaccgttaatttaacgttggttcggtaccggttaaggaccgttaggaagggtaaacggaaccgttccccggaccgttcgggtacccgtaaacgttacgggttaatttacgttaaaaccggttaagggtttttaacggg

SEQ ID NO: 325446 - DNA, 718 bp, Homo sapiens
  misc_feature: GZ8MTXP01D988G.25.51.E07.1.454.CMB.2.raw
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggtctttttcttgtggcttcttttaaaaggtgtccactgtgacgtgcagctattggagtcgtgggggaggcttggtgcaggccgggagggtccctgagactctcctgtacagcgtctggatttgccttggcagccatcgccccgtggggctcgggtcccgccgagggtccgagggggacgggccgtgggaggtgggtctacgaaattggtgactccgtggcggtagtcgtcactaacctctaacggcgggtactccgtggtacgaacgggccccgtcttacactaaatactccgaagaagaacctaaacgttaccgaaacggtaccttaaccccttttttagaactaaactacgggaaacctaaaccgtagaacgaaggaaccggtaaggaccgtaaccgggtaccccttcgttaaactttacgtttggtaaggtaccggaaaggtaccgttaggtaacggggaaaccggttaacccgttccccggaccgttcgggtaacccgtaaaagtttacgggtttaacgttttaccgttaaaacgggtttaacgggttttttaaccggg

SEQ ID NO: 325447 - DNA, 746 bp, Homo sapiens
  misc_feature: GZ8MTXP01CYWSM.25.51.E07.1.454.CMB.2.raw
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggtctttttcttgtggcttcttttaaaaggtgtccactgtgacgtgcagctattggagtcgtgggggagcttggtgcaggccggggaggtccctgagactctcctgtacagcgtctggatttgccttggcagccatcgcccctgggctgggtcccgccgagggtccgaggggaacgggcctgggaggtggggtctacgtaaagtgtacgacgtccgtacgggccggttagtgtaccacgaaccttctaacggcgggacttcgtgtaggaaccgtccccgacttaccaactaactaacgtccaagaacgtaactaaacgttaccgtaaacggtaccctttaaccccttttttagaacctaaaacttacggggtaaaccctaaacccgttaacgaagggaacgaaccgggaacggaacccgtaacccggggtaccccttaccgttaactttaacgtttcggttaaggtaccggaggtaaccgttgggtaaacgggaacgttaacccgttcccggttacccgttaacgggtaacccgtaaagtttacgggttaacttttaaccgttaaaacccgggttggggttttttaacccgg

SEQ ID NO: 325448 - DNA, 747 bp, Homo sapiens
  misc_feature: GZ8MTXP01AG6IC.25.51.E07.1.454.CMB.2.raw
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggtctttttcttgtggtcttacttttaaaaggtgtccactgtgacgtgcagctattggagtcgtgggggagcttggtgcaggccgggagggtccctgagactctcctgtacagcgtctggtatttgccttggcagccatcgccccgtgggctgggtccgccgagggtcccgagggggaggccgtgggagtgggtctacgaaagtgtgactccgtggccggtagtgtaccacaacctcgtaacggccggtactcgttggtacggaacggtccccgtacttaccaactaaactactacccgaagaagaacctaacttacccgaaacggttaacccttacccgttttttacgaccttaaaacttacgggaaacctaaacccgtaggaaacggaacggaaccggaacgggtaaccgaacccgggttaccccgttaccttaacgtttaacgtttcggttggtaccggttaagggaccgttagggtaaacgggaaacggttacccgttaccccgggttcccgttaacgggtacccctaaaaggtttacgggttaagttttaacccgtttaaaacgggtttaacgggtttttaacccggg

SEQ ID NO: 325449 - DNA, 574 bp, Homo sapiens
  misc_feature: GZ8MTXP01CAME7.25.51.E07.1.454.CMB.2.raw
  modified_base (406)..(406): a, c, t, g, unknown or other
  misc_feature (406)..(406): n is a, c, g, or t
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggctttttctgtggctcttttaaaaggtgtccactgtgacgtgcagctattggagtcgtgggggaggcttggtgcaggccgggagggtccctgagactctcctgtacagcgtctggtatttgccttggcagccatgccctggggctggggtcccgccgaggggtccgaggggagggcctgggagtggggtctcgaaatgtgactccgtgggcggtagtgtcacactctcgcggactcgtgtcgaacggcccncttcacaatactaccagacgaacaacttccaacggtaccttaccctttttcgactaaatcgaactaacctagacgacgacgaggacacggcctacgtatacttgtgcgaggacttggaggagacgttccgccgtgtactaagtgtatttactaacgttggttttaacg

SEQ ID NO: 325450 - DNA, 666 bp, Homo sapiens
  misc_feature: GZ8MTXP01BIKX3.25.51.E07.1.454.CMB.2.raw
  modified_base (586)..(586): a, c, t, g, unknown or other
  misc_feature (586)..(586): n is a, c, g, or t
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggtctttttcttgtggcttcttttaaaaggtgtccactgtgacgtgcagctattggagtcgtgggggagcttggtgcgaggccgggaggtccctgagactctcctgtacagcgtctgtattgccttggcagccatcgcccgtgggctgggtcccgcgacgggtccgaggggacggcgtgggagtcgggtactacgaaagttcgtacgacgtcccggtgggaccgggttagtcggtaccaccgtaacccgttccgtaacggcggtaaccttcgttacggtacggaaccgggtccccgtacttaccaactaactacgtaccgaacggaacgtaaactaactttacccgaaacggttacccttacccgtttttagaactaaactacgggaaactaaccgtagagacgacgacggacgaccgtcctctattattgngcgagacgttgacggaacgacgttccgcgtcgggtacctaagttacggttactttacgttaacggttcggttttaaccgg

SEQ ID NO: 325451 - DNA, 752 bp, Homo sapiens
  misc_feature: GZ8MTXP01AGY21.25.51.E07.1.454.CMB.2.raw
  modified_base (270)..(270): a, c, t, g, unknown or other
  misc_feature (270)..(270): n is a, c, g, or t
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggtctttttcttgtggtcttacttttaaaaggtgtccactgtgacgtgcagctagttggagtcgtgggggagcgttgggtgcgaggccggggaggtccctgagactctcctgtacngcgtcgtggtatttgccttggcagccagtcgccccgtgggcctcgggtcccgccgagggtccgagggggaacggccgtgggaggttgggtctacgaaattggtgaccttccggtgggcggtagtcgtaccactaaccgttcgtaacggcgtacctcgtggtacggaacgggtccccgtcttaccaactaactactaccgaacgaacgaaaccgtaacgttaccgtaaacggtaaccctttaacccgttttttacgaacttaaacgtaacgggtaaacgtaaacccgttaggaacggaacggaaccggaacgggaacccgtaacccgggtacccttacgttaacgtttaacgttggttaacgacggttacgacggttaacggaacgggaaacgttacccgttcccggttaccgttaacggttaaccgtaaacgtttacgggttaactttaaccggttaaacggtttaacgggttttaacccgg

SEQ ID NO: 325452 - DNA, 580 bp, Homo sapiens
  misc_feature: GZ8MTXP01A5L3B.25.51.E07.1.454.CMB.2.raw
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggctttttcttgtggcttacttttaaaaggtgtccactgtgacgtgcagctattggagtcgtggggggaggcttgggtgcaggcccggggagggtcccctgagactctccctgtaccagcgtctggtattgccttggcagccatgccctgggctgggtccgccagggtccaggggagggcctgggagtgggctcaaatgtgactcgtggcggtagtgtcactaactctaacgccgggactcgtcgtagaacgggccccgcttacacaactataccagagaacaacttaccaaggtaccttaccctttttagactaaatacggaacaacctagagagacgagacgacgcctctactatgtgcgagacttgaggaagacgttccgccgtcggacctaagtagtacgtttacgtaacgttggtttaacg

SEQ ID NO: 325453 - DNA, 589 bp, Homo sapiens
  misc_feature: GZ8MTXP01COT4H.25.51.E07.1.454.CMB.2.raw
  modified_base (266)..(266): a, c, t, g, unknown or other
  misc_feature (266)..(266): n is a, c, g, or t
  modified_base (308)..(308): a, c, t, g, unknown or other
  misc_feature (308)..(308): n is a, c, g, or t
  modified_base (420)..(420): a, c, t, g, unknown or other
  misc_feature (420)..(420): n is a, c, g, or t
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggtctttttcttgtggcttcttttaaaaggtgtccactgtgacgtgcagctattggagtcgtgggggagcgttggtgcgaggccgggagggtccctgagactctcctgtacngcgtctggattgccttggcagccatcgcctggctgggtcccnccgagggtccgaggggaggccgtggagtgggtcacaaagttgcgactccgtggcggtagtgtcacgtaactcgtaacgcggtactcgtgtacgacggcccgcttcacactanaccaagacgaactaacttaccgaaacggtaccttacccttttttagacctaaatacgggaacaaccgtagacggaagaaccgaggacgaccggcctctattatggcgtcgagacttggaacgagccgttccgcgtgacctaagtggtacttactaacggttgtttaacg

SEQ ID NO: 325454 - DNA, 625 bp, Homo sapiens
  misc_feature: GZ8MTXP01EG0KG.25.51.E07.1.454.CMB.2.raw
  modified_base (263)..(263): a, c, t, g, unknown or other
  misc_feature (263)..(263): n is a, c, g, or t
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggtctttttcttgtggctcttttaaaaggtgtccactgtgacgtgcagctattggagtcgtgggggagcttggtgcaggccgggaggtccctgagactctcctgtaccngcgtctggatttgccttggcacgccatcgcccgtgggctgggtcccgcgaggtccgaggggacggctgggagtcgggtctacgaaagttgtacgacgtccgtgggccggttagtcgtaccacgtaaccttcgtaacggcgtactcgtgtacggaacggccctcttacactaatactaccgaagacgaactaacttaccgaaacggtaccttaccctttttagaactaaagttacgggaactaaaccgtagacgacgacgacggaccgaccggccttactattagtgtgtcgagacgttaggacggaacgaccgttccgcgtcggtactaagttggtacttacgtaacgttaaggtttaacgg

SEQ ID NO: 325455 - DNA, 749 bp, Homo sapiens
  misc_feature: GZ8MTXP01AMI2D.25.51.E07.1.454.CMB.2.raw
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggtctttttcttgtggcttacttttaaaaggtgtccactgtgacgtgcagctattggagtcgtgggggagcttggtgcaggccgggagggtccctgagactctcctgtacagcgtctggattgccttggcagccatcgcccgtgggctcggggtcccgccgagggtccgaggggacgggccgtgggaggtgggtctacgaaagttggtacgacgttccgtggggtacgggttagtcgtcactaaccgtcgtaaccggcggtaccgtcgtcggtacgggaaacccggtccccgtacttaccgaactaaactaactacccgaagggaacgtaaacctaaacgttacccgtaaacgggtaccccttttaacccgtttttttacgaaaccgttaaacttaccggaaaccgtaaacccgttaggaaacggaacggaaccggaacggaaccgacccgggtccccttacgttaatttaaccgttggttaacggtaccgttaggaccgttagggaaacgggaacgttaccgttcccggacccgttcgggtaccctaagttacggtttaacgtttaccgttaaacgggtttcgggttttaacgg

SEQ ID NO: 325456 - DNA, 712 bp, Homo sapiens
  misc_feature: GZ8MTXP01C299W.25.51.E07.1.454.CMB.2.raw
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggtctttttcttgtggtcttacttttaaaaggtgtccactgtgacgtgcagctagttggagtcgtgggggagtcgttggtgcgaggccgggaggtccctgagtactctcctgtacagtcgtcgtggtattgccttggcacgccagtcgcccgtgggctcgggtcccgcgacggtccgaggggacggtccgtgggacgtgggtacacgtaaagtcgtacgtacgtccggtgggtaccggtagtcgtaccgactaaccttcgtaacgcggtactcgtggtacggaacggtccctcttacaactaactactaccaagaacgaaactaacgttaccgtaaacggttaacctttaaccgtttttacgaaactaaactacggtaaaccgtaaacccgtaagaacggaaacggaaccggaacggaaccgtaacccggtccttacgttattacgttggtaacgacgttaggtaacgaggtaaacggaacgttacccgttccgttaccgtaacggtaaccgtaagttacggttaactttaacgttaaacggtttcggttttaaccgg

SEQ ID NO: 325457 - DNA, 820 bp, Homo sapiens
  misc_feature: GZ8MTXP01DTAHE.25.51.E07.1.454.CMB.2.raw
  modified_base (275)..(275): a, c, t, g, unknown or other
  misc_feature (275)..(275): n is a, c, g, or t
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggtctttttcttgtggtctcttttaaaaggtgtccactgtgacgtgcagctattggagtcgtgggggagcttgggtgcaggccgggaggtccctgacgactctcctgtacagcgtctggtnttgccttggcagccatcgcccgtgggctgggtcccgcgagggtccgagggggaagggccgtgggaggtcggggtactacgtaaagttcggtacggacgttcccgtggggtccgggttaggttcggttaccaaccgtaacctccgtaacggccgggtaacttccgtaggtcggaacgggtccccgtacttacaacctaatactacccgaagaacgaaactaaacgtttacccgtaaacgggttaaccctttaaccccgtttttttacgaaccttaaaacgttacggggtaaaacccttaaacccgttaggaaacgggaaacgggaacccgggaaacgggaaccggtaacccggggtacccctttaaccgtttaacgttttaaacgtttgggtttaacggaccgggttaaggtaaaccggttgggtaaacgggttaacggaaacccgttcccgggttacccgttaacggggttaaacccgtaaacggtttagggtttaacgtttttaaccggttaaaacgggttttaacgggttttttaacccgggg

SEQ ID NO: 325458 - DNA, 834 bp, Homo sapiens
  misc_feature: GZ8MTXP01A3EEW.25.51.E07.1.454.CMB.2.raw
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggtctttttcttgtggcttcttttaaaaggtgtccactgtgacgtgcagctattggagtcgtgggggagcttggtgcgaggccgggaggtccctgagactctcctgtacagcgtctggtattgcttggcacgccagtcgccccgtgggcgtcggggtcccgccgacggggtcccgagggggaacgggccgttgggacggttgggtctacgaaagttcggtggtacccgttccgtcgggggtacggttacggtcggtaccctaaccgtaaccgttcccgtaaccggaccgggtaccgttccgttacgggtacgggaaacccgggtccccccgttactttaccgaaaccgtaaacgttaacttacccgaaacggaaacggttaaaccctaaaccgtttaacccgtaaaccgggttaaccctttaaccccgtttttttacggaaacctaaacgttaacgggtaaaacccgtaaacccgttaggaaacgggtaacggaaccggaaccgggaacccgtacccgggtaccccttaccgttaagtttacgttaggttcggacgaacggtaccgttagggaaacggtaacggacccgttccccggttacccgttaacgggttaaccctaaaggtttacggtttaacgtttaaccgttaaaacgggttttaacgggtttttaacccggg

SEQ ID NO: 325459 - DNA, 900 bp, Homo sapiens
  misc_feature: GZ8MTXP01AUXZ6.25.51.E07.1.454.CMB.2.raw
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggtctttttcttgtggcttacttttaaaaggtgtccactgtgacgtgcagctattggagtcgtgggggagcttggtgcgaggccgggagggtccctgacgactctcctgtacagcgtctggtattgccgttggcagccatcgtccccgtggggcctcggggtccccgccggacggggtaccgagggggaacgggccgtagggggtacggttcgggtactacgaaagttcggtacgtacccgttccggtggggtaccgggtttaaggtcgtaccaaccgtaaacccttcggttaacccgggccgggttaaccgttccggtttcgggaacgggtaaaccccgggggtcccccgttaccgtttaacccgaaacctaaaacgttaaccttaacccggaaacgggtaaacctaaaccggttaaacctttaacccgtaaaaccgggtttaaccctttaaaccccgttttttttaacggaaaccgttaaaaactttaaccggggaaaaccctaaacccggttaggaaaccgggtaaacggtaaaccgggaaaccgggttaacccgaaccccggggttaccccgtttaacctttaacgttttaaacgtttcggaaggtaacccggttaacgggacgttaagggaaacgggtaaaaccgttcccgttcccggttacccgttaacgggtaaacccctaaggtttaacggtttacgtttaaacccggttaaacggtttaacgggtttttaacccggg

SEQ ID NO: 325460 - DNA, 740 bp, Homo sapiens
  misc_feature: GZ8MTXP01AO94U.25.51.E07.1.454.CMB.2.raw
  modified_base (263)..(263): a, c, t, g, unknown or other
  misc_feature (263)..(263): n is a, c, g, or t
  modified_base (287)..(287): a, c, t, g, unknown or other
  misc_feature (287)..(287): n is a, c, g, or t
  modified_base (337)..(337): a, c, t, g, unknown or other
  misc_feature (337)..(337): n is a, c, g, or t
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggtctttttctgtggctcttttaaaaggtgtccactgtgacgtgcagctagtggagtcgtgggggagtcttggtgcgaggccgggaggtccctgagactctcctgtacngcgtctggtattcgccgttggcanccagtcgcccgtggctcgggtccgccgaggtccgaggggacggcctgggngtcgggtctacgaaagtggtacgacgttccggtggtcgggttaagtcgtaccacgtaactaccgtaacgccgggtactcgtacggtcggaacccggcccgtacttacaactaacgtaactaccgtaacggaactaaaccgtaaacttacccgtaaacgttaaccctttacccgtttttttacggaaccttaaacgtaacggtaaaccctaaaccggttacgaacggaaaccggacgaaccgggacccgtaacccgggtccccgttaattaaccgtttaagttacgggtcggttaacggacggttaacgaacgggacggtaaacgttacccgttccgttaccggtaacggtaacgtaacgtttaggttaacgtttaccggtaaacggttcgtttttaacccggg

SEQ ID NO: 325461 - DNA, 682 bp, Homo sapiens
  misc_feature: GZ8MTXP01AWM7W.25.51.E07.1.454.CMB.2.raw
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggtctttttcttgtggtcttacttttaaaaggtgtccactgtgacgtgcagctagtggagtcgtgggggagcttggtgcaggccgggaggtccctgacgtactctcctgtacagcgtctggtatttcgccgttggcagccatcggccctgggctcgggtcccgcgagggtccgaggggacggccgtgggaggtcgggtactacgaaagtcgtacgtactccgtggcggttagtcgtccactaccgtaccgtaaccgcggtacttacgtggtacggaaaccggggtcccctacttaccaactaaactacgtacccgaagaacgaacctaacttaccgaaacggtaccttacccttttttacgaactaaactacgggaaactaaccgttagaacgacgaacgacggaccgtaccggtccccttatactttaacgtgtcgacgacgtacgttggaaggaacgaccgttcccgttacgtaacgtacccgtaaagttgggttactttacgtaaacggtttggttttaacccgg

SEQ ID NO: 325462 - DNA, 630 bp, Homo sapiens
  misc_feature: GZ8MTXP01CNOV8.25.51.E07.1.454.CMB.2.raw
  modified_base (271)..(271): a, c, t, g, unknown or other
  misc_feature (271)..(271): n is a, c, g, or t
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggtctttttcttgtggtcttactttttaaaaggtgtccactgtgacgtgcagctagttggagtcgtgggggagcttgggtgcgaggccgggagggtccctgacgactctcctgtacngcgtctggatttgcctggcagccatcggccccgtgggctcgggtcccgccgagggtccgagggggacggccgtgggagtcgggtctacgaaagtgtcggactccgtgggccggtagtgtaccaccaacttcgtaacggcgtacctcgtgtcgaacgggtccccattacactaatactccgaagacgactaactaccaacggtaccttacctttttacgaactaaactacggaaactaacgtacgacgaacgaacgacggacgaccggtccctatacgttatggtgacgagtacgttggaacggacgacgttccgccgtcggtacctaagtgttacttacgtaacgttaaggtttaacgg

SEQ ID NO: 325463 - DNA, 654 bp, Homo sapiens
  misc_feature: GZ8MTXP01AEG1T.25.51.E07.1.454.CMB.2.raw
  modified_base (245)..(245): a, c, t, g, unknown or other
  misc_feature (245)..(245): n is a, c, g, or t
  modified_base (261)..(261): a, c, t, g, unknown or other
  misc_feature (261)..(261): n is a, c, g, or t
tcagactgtacagtcacgaccggtgctcgatttagcatactctacaacacacaaaggggtctgagagaggagcccatccctgggattttcaggtgttttcatttggtgatcagggctgaacagagagaactcaccatggagtttgggctgaactggtctttttcttgtggctcttttaaaaggtgtccactgtgacgtgcagctatggagtcgtgggggagcttggtgcaggccgggaggtcccngagactctcctgtacngctctggtatttgccttggcacgccatcggccccgtgggcgtcgggtcccgccgagggtccgaggggacgggcctgggagtgggtactacgaaagtcggtagacctccgtcgggcggttagtcgtaccacgtaaccgttcgtaacggccgacttcgtgtacggaacggcccgtcttacaacaacttacaccaagaacaacgtaacttaccgaacgttaacctttacccttttgaactaagtacgaactacgagagacgacgacgacgaccgtcctagtacttagtgtaacggcgagacgttacggaacggtaacgttccgttcccggttacgttaacggtaacccgtaaagttcggttaacgtttaccgtaaacggtttggttttaacccggg

SEQ ID NO: 325464 - DNA, 657 bp, Homo sapiens
  misc_feature: GZ8MTXP01AZ2P1.25.51.E07.1.454.CMB.2.raw
  modified_base (266)..(266): a, c, t, g, unknown or other
  misc_feature (266)..(266): n is a, c, g, or t
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggtcttttttcttgtggcttacttttaaaaggtgtccactgtgacgtgcagctattggagtcgtgggggagcttggtgcgaggccgggaggtcccttagactctcctgtacngcgtctggtatttgcctttggcagccagtcgcccgtgggctgggtcccgcgagggtcgaggggacggccgtggagtgggtctacgaaagtgtagactcgtggccgtagtcgcacactcacgcgactcgtgtcgaacgcccgacttacaactaatactaccagaacgaactaaacgttaccaaacggtacccttacctttttacgaactaaatacgaaactaaccgtagaacgaacgaacggacggaccgaccggtaccctactaagttacgttagtcgaacgacgacgttaggacggaaacgtaccgttcccgttccgttacggttaaccgtaaagttaacggtttaacgtttaaccgttaaggttaacgggtttttaacgttaacccggg

SEQ ID NO: 325465 - DNA, 640 bp, Homo sapiens
  misc_feature: GZ8MTXP01BFVP3.25.51.E07.1.454.CMB.2.raw
  modified_base (254)..(254): a, c, t, g, unknown or other
  misc_feature (254)..(254): n is a, c, g, or t
  modified_base (554)..(554): a, c, t, g, unknown or other
  misc_feature (554)..(554): n is a, c, g, or t
  modified_base (578)..(578): a, c, t, g, unknown or other
  misc_feature (578)..(578): n is a, c, g, or t
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggtctttttcttgtggtcttacttttaaaaggtgtccactgtgacgtgcagctagttggagtcgtgggggaggtcgttggtgcgaggccgggaggtcccngacgactctctgtacagcgtctggtattgtcctggcacgccatcggccgtgggcgtcgggtcccgccgagggtccgaggggacggcgtgggaggtgggtctacgtaagtgtacgtacgtccgtcggtcggtagtcgccaccgtacgtaccgtcgcgtactcgtcgtacgaccgggccctacgttacactaaatctacaagacaacgtaacttaccgaacggtcctttaaccgttttagaactaaagttacgaaactaaccgtgaacgacgacgacggacgacgtccctattattagtcgnggtcagacgttagaacgggtaacncgttccgacggtaacgtaacgtaacgttggttactttacggtaaaccgtttggtttaaccgg

SEQ ID NO: 325466 - DNA, 693 bp, Homo sapiens
  misc_feature: GZ8MTXP01AT3XY.25.51.E07.1.454.CMB.2.raw
  modified_base (570)..(570): a, c, t, g, unknown or other
  misc_feature (570)..(570): n is a, c, g, or t
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggtctttttctgtggcttacttttaaaaggtgtccactgtgacgtgcagctattggagtcgtgggggagtcgttggtgcgagggccgggtagggtccctgagactctcctgtacagcgtctggtatttgccgttggcagccatcggcctgggcgtcgggtcccgcgaggtccgaggggacggccgtgggacggtgggtactacgaaagtcggtcgtaccgtccgtggggccggttagtcgtaccacgtaacctccgtaacggccggtactcgtacggtacggaaccgggtcccctacttaccaactaactactacccgaagaacgtaacctaacttaccgtaaacggtaccctttacccgttttagactaaagtacgaaactaccgtagaagacgacgacgaccgtacgtaccctntattacgtgtgcggttacgacgttagggaacggtaacgttacccggttccgttaccggtaacgggtaaccctaaggttacggtttaagtttaccggtaaaacggtttcgggttttaacccggg

SEQ ID NO: 325467 - DNA, 593 bp, Homo sapiens
  misc_feature: GZ8MTXP01CINER.25.51.E07.1.454.CMB.2.raw
  modified_base (480)..(480): a, c, t, g, unknown or other
  misc_feature (480)..(480): n is a, c, g, or t
tcagactgtacagtcacgaccggtgctcgatttagcatactctacaacacacaaaggggtctgagagaggagcccagccctgggattttcaggtgttttcatttggtgatcagggctgaacagagagaactcaccatggagttgggctgaactggtctttttctgtggcttcttttaaaaggtgtccactgtgacgtgcagctattggagtcgtgggggagcttggtgcgaggccgggaggtccctgagactctcctgtacagcgtctggattgcttggcagtccatgcccctgggctgggtcccgcgagggtccagggggaacggtccgtggaggttcggggtcctacgtaaagtgtacggcgtccgttgggccggttaggtcgtccactaaaccgtcgtaacgcgggtactcgttagcggaacgcccgtcttcacaatactccagacacaactcaacggactacctttttagctaaanacggtaacaacgtacgacgacgacgaacggacaccggtcctctattactgtgcgagattgaaggagacgcgctcgggtaccaagtgtacgttactaacggttaaggtttaacg

SEQ ID NO: 325468 - DNA, 761 bp, Homo sapiens
  misc_feature: GZ8MTXP01AT1MF.25.51.E07.1.454.CMB.2.raw
  modified_base (306)..(306): a, c, t, g, unknown or other
  misc_feature (306)..(306): n is a, c, g, or t
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggctttttctgtggctacttttaaaaggtgtccactgtgacgtgcagctattggagtcgtgggggagcgttggtgcagccgggaggtccctgagactctcctgtacagcgtcgtggtattcgcttggctagccatcgccctgggctgggccncgaggtccgagggaacggctagggagtgggtactacgaaagtcgtagactccgtcggtccggttagtcggtaccacggtaaaccttcgaaccggccggtaacctcgtacggtacggaaacgggtccccgtacttaccgaaactaaacgtaacgtacccaaggaacgtaaacgtaaacttacccgaaacgggtaaccttaaccccggttttttaacgtaaccgtaaaacgtaacgggtaaaaccgtaaccgttaaggaaacggaaacggaaccggtaaacggtaacccgtaacccggtacccgttacgttaacgtttacgttaggtaacggtacggacggtaacgttacggggtaaacggtaacgttaccggttacccgttacccgtaaccggttaaccgtaaacgttacggtttaaacggtttaaccgttaaaacggtttaaccgggttttaacg

SEQ ID NO: 325469 - DNA, 556 bp, Homo sapiens
  misc_feature: GZ8MTXP02G49SO.25.51.E07.1.454.CMB.2.raw
  modified_base (381)..(381): a, c, t, g, unknown or other
  misc_feature (381)..(381): n is a, c, g, or t
  modified_base (394)..(394): a, c, t, g, unknown or other
  misc_feature (394)..(394): n is a, c, g, or t
  modified_base (404)..(404): a, c, t, g, unknown or other
  misc_feature (404)..(404): n is a, c, g, or t
  modified_base (408)..(408): a, c, t, g, unknown or other
  misc_feature (408)..(408): n is a, c, g, or t
  modified_base (474)..(474): a, c, t, g, unknown or other
  misc_feature (474)..(474): n is a, c, g, or t
  modified_base (481)..(481): a, c, t, g, unknown or other
  misc_feature (481)..(481): n is a, c, g, or t
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggctttttcttgtggctcttttaaaaggtgtccactgtgacgtgcagctattggagtctgggggaggcttggtgcagccgggagggtccctgagactctcctgtacagcgtctggatttgccttggcagccatgcccctggctgggtccgcagggtccagggaagggcctggagtgggtctcaaatgtgactctgggcggtagtgtcacactctacgcggactctgngaaggcccccggnttcacaatanccanagacaatccaaggactaccctttttgacaaatagaacaacctagagagacgaggactacggccctntattatntgacgagacgtagagagaacgtaccgccgaacgtaccgtaactacggtagttattaaaccgtaacggtttaacgg

SEQ ID NO: 325470 - DNA, 582 bp, Homo sapiens
  misc_feature: GZ8MTXP02F4P4N.25.51.E07.1.454.CMB.2.raw
  modified_base (302)..(302): a, c, t, g, unknown or other
  misc_feature (302)..(302): n is a, c, g, or t
  modified_base (414)..(414): a, c, t, g, unknown or other
  misc_feature (414)..(414): n is a, c, g, or t
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggcttttctgtggctcttttaaaaggtgtccactgtgacgtgcagctattggagtctgggggagcttggtgcaggccgggaggtccctgagactctcctgtacagcgtctggattgcctttggcagccatgcccctgggctgggtccncgagggtccaggggaaggcctggagtgggtctcgaaatgtgactcctggcggtagtgtcacgactctacgcgactcgtgtgaacggcccgcttcacaatactaccaggaaanactaactaccgaacgtaccttaccgttttagaactaaatacgaacaacgtagagacgaacgacgacgaccgtacctactattagtgtcgacgagtacgtaggaacggacgacgtccgaccgtaacgtaccgtaagtacgttaacttacgttaaacggttacgtttacg

SEQ ID NO: 325471 - DNA, 551 bp, Homo sapiens
  misc_feature: GZ8MTXP02JFZ66.25.51.E07.1.454.CMB.2.raw
  modified_base (391)..(391): a, c, t, g, unknown or other
  misc_feature (391)..(391): n is a, c, g, or t
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggcttttctgtggctcttttaaaaggtgtccactgtgacgtgcagctattggagtctgggggagcttggtgcagccgggagggtccctgagactctcctgtacagcgtctggatttgcctttggcagccatgccctgggctgggtccgcagggtccaggggaaggcctgggagtggggtctcaaatgtgactcctggcggtagtgtcacactctcgcggactctgtgaacggcccgnttcacaatactaccagagacaacttaccaaggtactaccctttttgacctaaatagaacaacctgagagacgaggacacggcctctatatgtgcgagacgtgaggacgacgtccgaccgtcggtaccaaacgtggtatttacgtaaacgtaggttttacg

SEQ ID NO: 325472 - DNA, 544 bp, Homo sapiens
  misc_feature: GZ8MTXP02GURY2.25.51.E07.1.454.CMB.2.raw
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggcttttcttgtggctcttttaaaaggtgtccactgtgacgtgcagctattggagtctgggggaggcttggtgcagccgggagggtccctgagactctcctgtacagcgtctggatttgcctttggcagccatgccctgggctgggtccgccagggtccaggggaggcctgggagtgggtctcaaatgtgactccgtggcggtagtgtcacactctacgcggactctgtgaacggcccgcttcacaatatccagagacaattccaagactaccctttttgactaaatgaacacctgagagacgaggacacggccctctattatgtgcgagacgtgaggaacgacgtccgcctggtaccaaagtggtatttacgtaaacgtaggttttacg

SEQ ID NO: 325473 - DNA, 653 bp, Homo sapiens
  misc_feature: GZ8MTXP02JYM74.25.51.E07.1.454.CMB.2.raw
  modified_base (268)..(268): a, c, t, g, unknown or other
  misc_feature (268)..(268): n is a, c, g, or t
  modified_base (305)..(305): a, c, t, g, unknown or other
  misc_feature (305)..(305): n is a, c, g, or t
  modified_base (406)..(406): a, c, t, g, unknown or other
  misc_feature (406)..(406): n is a, c, g, or t
tcagactgtacagtcacgaccggtgctcgatttagcatactctacaacacacaaaggggtctgagaggaggagcccagccctgggattttcaggtgttttcatttggtgatcagggctgaacagagagaactcaccatggagttttgggctgaactggctttttcttgtggctcttttaaaaggtgtccactgtgacgtgcagctattggagtctgggggagcttggtgcaggccgggagggtccctgagactctcctgtacagcgtntggatttgccttggcagccatgccctggctgggtccncgagggtccagggaggcctgggagtgggtctcaaagtgtagactccgtgggccgtagtcgtcacacctcgtcggcggtactctgtcgaaacggcccccgtnttaccaactaatactacccgagacgaccaacttacccgaaggtaacccttacccgtttttaggacctaaagtacgaaacaaccgtagaaggaacggaaccgaacggaccgaaccgggtcccttaccgttaactttaacgttggttcgacggagaccgtacggaacgggtaacgaacccgttcccgacccgtcggtacccgtaaagttacgggttaactttaccgtaaaaccggttaggttttaacgg

SEQ ID NO: 325474 - DNA, 632 bp, Homo sapiens
  misc_feature: GZ8MTXP02HTW76.25.51.E07.1.454.CMB.2.raw
  modified_base (345)..(345): a, c, t, g, unknown or other
  misc_feature (345)..(345): n is a, c, g, or t
  modified_base (348)..(348): a, c, t, g, unknown or other
  misc_feature (348)..(348): n is a, c, g, or t
  modified_base (353)..(353): a, c, t, g, unknown or other
  misc_feature (353)..(353): n is a, c, g, or t
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggctttttctgtggctcttttaaaaggtgtccactgtgacgtgcagctattggagtctgggggagcttggtgcagccggggagggtccctgagactctcctgtacagcgtctggatttgcctttggcagccatgccctgggctggccgccaggtccagggaggcctggagtgggtctcaaatgtgactcgnggngtagntcacactctcgcgtactcgtgacgaacggccctctacaaacaaactactacgaacgaacgaactaaactaaccgtaaacgtaaccgttacccttttacgtaactaaactaacgtaaactaaaccgtaagaacgaagaacgaacggaacgaaccgacccgtacttaacgttagttagtacgacgaacgacgtacggaacggaaacgaccgtacccgtaccgtaacggtaaccgtaaacgtaacggttaacgtttaacgttaaaacggttaacggtttacg

SEQ ID NO: 325475 - DNA, 681 bp, Homo sapiens
  misc_feature: GZ8MTXP02J0OK4.25.51.E07.1.454.CMB.2.raw
  modified_base (310)..(310): a, c, t, g, unknown or other
  misc_feature (310)..(310): n is a, c, g, or t
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggctttttcttgtggctcttttaaaaggtgtccactgtgacgtgcagctattggagtctgggggagcttggtgcaggccggggagggtccctgacgactctcctgtacagcgtctggatttgcctttggcagccatcgcccgtgggctgggtcccncgagggtccaggggacggcctgggagtgggtctacaaatggtcgacctccgtgggcggttagtcgtacactactctacggcggactcgtggtacgaacgggtccccgtcgttaccaactaaatactaccgaaggaacgaactaacttacccgaaacggtaccctttacccgttttttacgacctaaattacgaaacaacccgttagaacggtaacgaacggaacggaaccgaccgggacccttacgttaactttacgttaggttcgacggacgtaccgtaggaacggtaaacgaccgtacccggtaccgtcggtaacccgtaaaagttacggttaacgtttaccgttaaaacggttacggtttttaaccgg

SEQ ID NO: 325476 - DNA, 557 bp, Homo sapiens
  misc_feature: GZ8MTXP02G8148.25.51.E07.1.454.CMB.2.raw
  modified_base (308)..(308): a, c, t, g, unknown or other
  misc_feature (308)..(308): n is a, c, g, or t
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggctttttcttgtggctcttttaaaaggtgtccactgtgacgtgcagctattggagtcgtgggggaggcttggtgcaggccgggagggtccctgagactctcctgtacagcgtctggatttgcctttggcagccatcgccctgggctgggtccnccgagggtccagggaggcctggagtgggtctcaaatgtgactcgtggcgtagtgtcacactctcgcggactcgtgtgaacgggcccgcttcacaatactccagagacaacttaccaacggtaccttaccctttttagactaaatacgaacaacctgagagacgagacacggcctactatactgtcgacgagactgacggacgaccgtccgcctcggtacaacgtacgtatttacgtaacgtagtttacg

SEQ ID NO: 325477 - DNA, 577 bp, Homo sapiens
  misc_feature: GZ8MTXP02F54NY.25.51.E07.1.454.CMB.2.raw
  modified_base (345)..(345): a, c, t, g, unknown or other
  misc_feature (345)..(345): n is a, c, g, or t
  modified_base (399)..(399): a, c, t, g, unknown or other
  misc_feature (399)..(399): n is a, c, g, or t
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggcttttcttgtggctcttttaaaaggtgtccactgtgacgtgcagctattggagtctgggggagcttggtgcagccgggagggtccctgagactctcctgtacagcgtctggattgccttggcagccatgcccctgggctgggtccgccgaggggtccaggggaagggcctgggagtgggtctcaaatgngactccgtggcggtagtgtcacactctacggcggactctgtgaaacggccccgnttcacaatatccagagaacaattaccaaaggacctaccctttttgacaaatagaaacaacctgagaagacgaggaacacggaccctacgtattatgtacgcgagactggaacggaacgaaccgtccgaccgtaacggtacccaaagttaggtaatttacgtaaacgtaggttttacgg

SEQ ID NO: 325478 - DNA, 779 bp, Homo sapiens
  misc_feature: GZ8MTXP02GLRUL.25.51.E07.1.454.CMB.2.raw
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggctttttcttgtggctcttttaaaaggtgtccactgtgacgtgcagctattggagtctgggggagcttggtgcaggccgggaggtccctgagactctcctgtacagcgtctggattgcctttggcagccatcgcccctgggctgggtccgccgagggtccaggggaacgggcctgggagtgggtctacgaaagtgtgactccgtgggcggtagtgtcacactctaccggcggtactcgtgtggaacgggcccccgtcgtttaccaactaaacttacgtacccaaggaacgtaaacctaaacgtttacccgaaaacgggtaacccttaacccccgttttttttacggtaacctaaaacgttacgtaaaacccgtaaacccgttacggaaacgggaacggaaaccggaacgggaaccgaacccggggtacccccttaccgtttaaacgtttaaagtttcggttacggtaccgggtaacggtaaccggttacgggaaacggggtaaaacggtaacccgttacccccgggtaccccgttaacggggttaaccccgtaaaaggtttacggggtttaaactttttaaacccggttaaaaaccggggtttaacgggtttttttaaccgggg

SEQ ID NO: 325479 - DNA, 554 bp, Homo sapiens
  misc_feature: GZ8MTXP02INDFO.25.51.E07.1.454.CMB.2.raw
  modified_base (263)..(263): a, c, t, g, unknown or other
  misc_feature (263)..(263): n is a, c, g, or t
  modified_base (308)..(308): a, c, t, g, unknown or other
  misc_feature (308)..(308): n is a, c, g, or t
  modified_base (401)..(401): a, c, t, g, unknown or other
  misc_feature (401)..(401): n is a, c, g, or t
  modified_base (409)..(409): a, c, t, g, unknown or other
  misc_feature (409)..(409): n is a, c, g, or t
  modified_base (412)..(412): a, c, t, g, unknown or other
  misc_feature (412)..(412): n is a, c, g, or t
  modified_base (416)..(416): a, c, t, g, unknown or other
  misc_feature (416)..(416): n is a, c, g, or t
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggctttttcttgtggtctcttttaaaaggtgtccactgtgacgtgcagctattggagtctgggggaggcttggtgcaggccgggagggtccctgagactctcctgtacngcgtctggtatttgcctttggcagccatcgcctgggctgggtccncgagggtccaggggaggcctggagtgggtctacaaagtgtgactccgtgggccggtagtcgtcacactctacggcgactcgtgtgacggcccntcacatancanaganactacagactaccttttgactaatgaacactgagagacgagacacggccctctatattgtgcgtagactagaaggacgaccgtccgaccgtcggtacctaaagttacggttatttacgttaaacggttaggttttacg

SEQ ID NO: 325480 - DNA, 574 bp, Homo sapiens
  misc_feature: GZ8MTXP02HMUSV.25.51.E07.1.454.CMB.2.raw
  modified_base (259)..(259): a, c, t, g, unknown or other
  misc_feature (259)..(259): n is a, c, g, or t
  modified_base (400)..(400): a, c, t, g, unknown or other
  misc_feature (400)..(400): n is a, c, g, or t
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggctttttcttgtggctcttttaaaaggtgtccactgtgacgtgcagctattggagtctgggggagcttggtgcagccgggaggtccctgagactctcctgtacngcgtctggattgccttggcagccatgcccctgggctgggtccgccgagggtccaggggaaggcctgggagtggggtctacaaagtgtgactccgtggcggtagtgtcacactctacgcggactcgtgtagaacgggccccntcacaatactaccagagacaacttaccaaggtacttaccctttttagactaaatcgaaacaaccgtagagagacgaggacacggcctactattatgtcgacgagactaggaggaacgactccgccgtaacggtacctaaagtggttaactttacgttaaacggtagttttacgg

SEQ ID NO: 325481 - DNA, 553 bp, Homo sapiens
  misc_feature: GZ8MTXP02IUH04.25.51.E07.1.454.CMB.2.raw
  modified_base (263)..(263): a, c, t, g, unknown or other
  misc_feature (263)..(263): n is a, c, g, or t
  modified_base (306)..(306): a, c, t, g, unknown or other
  misc_feature (306)..(306): n is a, c, g, or t
  modified_base (368)..(368): a, c, t, g, unknown or other
  misc_feature (368)..(368): n is a, c, g, or t
  modified_base (372)..(372): a, c, t, g, unknown or other
  misc_feature (372)..(372): n is a, c, g, or t
  modified_base (395)..(395): a, c, t, g, unknown or other
  misc_feature (395)..(395): n is a, c, g, or t
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggtcttttttctgtggctcttttaaaaggtgtccactgtgacgtgcagctattggagtcgtgggggagcttggtgcaggccgggagggtccctgagactctcctgtacngcgtctggattgcctttggcagccatcgccctgggctgggccncgagggtccaggggacggcctggagtgggtctcaaatgtgactccgtgggcgtagtgtcacnctcncggcgactcgtgtgaacggcccncttcacatatccagagacacttaccgaaggtacctaccctttttgactaaatcgaaacacctagagagacgagacgacggcctctagttattgtgcgagacgtagaaggacgacctccgactggtaccaaagtcgtatttacgtaacgttagtttacg

SEQ ID NO: 325482 - DNA, 557 bp, Homo sapiens
  misc_feature: GZ8MTXP02J00ZA.25.51.E07.1.454.CMB.2.raw
  modified_base (304)..(304): a, c, t, g, unknown or other
  misc_feature (304)..(304): n is a, c, g, or t
  modified_base (397)..(397): a, c, t, g, unknown or other
  misc_feature (397)..(397): n is a, c, g, or t
  modified_base (478)..(478): a, c, t, g, unknown or other
  misc_feature (478)..(478): n is a, c, g, or t
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggcttttcttgtggctcttttaaaaggtgtccactgtgacgtgcagctattggagtctgggggagcttggtgcagccgggagggtccctgagactctcctgtacagcgtctggatttgcctttggcagccatgcccctgggctgggtccnccagggtccaggggaaggcctgggagtggggtctcaaatgtgactcctggcggtagtgtcacactctacgcggactcgtgtgaacggccccgnttcacaatatccagagacaattaccaaggacctacctttttgactaaatcgaacacctagagagacgaggacacggccctntacttattgtcgcgagactagacggaacgacgtccgcctcggtaccaaagtcggtatttacgtaaacgtaggttttacg

SEQ ID NO: 325483 - DNA, 616 bp, Homo sapiens
  misc_feature: GZ8MTXP02GQHU6.25.51.E07.1.454.CMB.2.raw
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggcttttcttgtggctcttttaaaaggtgtccactgtgacgtgcagctattggagtcgtgggggaggctttgggtgcaggccggggagggtccctgagactctcctgtacagcgtctggattgcctttggcagccatcgccccgtggggctggggtcccgccgagggtcccgaggggaacgggccgtgggaggtggggtctcgaaatgtgactccgtgggcggtagtgtcacactctcgcggactctgtgaacgcccgcttcaacaatactaccagacgaacaacttaccgaaacggtaccttaccctttttgacctaaatacgaaacaacctagaagagaacgaggacaccggccctctaattatagtcgacgagactaggaacggaacgaccgtcccgaccgtaacggtaacccgtaaacgttaggtaactttacgtaaaaccggttaggtttttaacgg

SEQ ID NO: 325484 - DNA, 566 bp, Homo sapiens
  misc_feature: GZ8MTXP02JT57M.25.51.E07.1.454.CMB.2.raw
  modified_base (307)..(307): a, c, t, g, unknown or other
  misc_feature (307)..(307): n is a, c, g, or t
  modified_base (389)..(389): a, c, t, g, unknown or other
  misc_feature (389)..(389): n is a, c, g, or t
  modified_base (402)..(402): a, c, t, g, unknown or other
  misc_feature (402)..(402): n is a, c, g, or t
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggcttttcttgtggctcttttaaaaggtgtccactgtgacgtgcagctattggagtctgggggaggcttggtgcagccggggagggtccctgagactctcctgtacagcgtctggatttgcctttggcagccatgcccctggggctgggtccnccgagggtccaggggaaggcctgggagtggggtctcgaaatgtgactcctgggcggtagtgtcacactctacggcggactcngtgaaggccccgnttcacaatactccagagacaacttccaaaggtacctacccctttttgacctaaattacgaaactaacctagagacgacgaggacaccggcctcgtatatgtgcgagactagacggacgactccgctggtaccaaagtggtatttacgtaaacgtagttttacgg

SEQ ID NO: 325485 - DNA, 577 bp, Homo sapiens
  misc_feature: GZ8MTXP02FVP52.25.51.E07.1.454.CMB.2.raw
  modified_base (357)..(357): a, c, t, g, unknown or other
  misc_feature (357)..(357): n is a, c, g, or t
  modified_base (399)..(399): a, c, t, g, unknown or other
  misc_feature (399)..(399): n is a, c, g, or t
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggctttttcttgtggctcttttaaaaggtgtccactgtgacgtgcagctattggagtctgggggaggcttgggtgcaggccgggagggtccctgagactctcctgtacagcgtctggattgcctttggcagccatgcccctgggctgggtccgccgagggtcccaggggaggcctgggagtggggtctcgaaatgtgactccnggcggtagtgtcacactctacgcggactctgtgaacggcccnttcacaatatcagagacaattaccaaggacctaccctttttagactaaatagaacaacctagagagacgagacgacggcctcgtattagttgtacgcgtagacgtaggaggaacgtaacctccgtaccgtcggtaccctaaagttacggtatttacgtaaacggtaggtttttaacgg

SEQ ID NO: 325486 - DNA, 604 bp, Homo sapiens
  misc_feature: GZ8MTXP02JGTL9.25.51.E07.1.454.CMB.2.raw
  modified_base (318)..(318): a, c, t, g, unknown or other
  misc_feature (318)..(318): n is a, c, g, or t
  modified_base (416)..(416): a, c, t, g, unknown or other
  misc_feature (416)..(416): n is a, c, g, or t
tcagactgtacagtcacgaccggtgctcgatttagcatactctacaacacacaaaggggtctgagagaggagcccagccctgggattttcaggttgttttcatttggtgatcagggctgaacagagagaactcaccatggagtttgggctgaactggtcttttttcttgtggtcttacttttaaaaggtgtccactgtgacgtgcagctagttggagtcgtgggggaggcttggtgcgaggccggggagggtccctgacgactctcctgtacagcgtctggatttgcctttggcagccatcgccctgggctgggtccncgagggtccgaggggacggccgtggagtgggtctacaaagtgtgactccgtgggcgtagtcgtacactactcacggcgactctgtacgaacggccctntacaacaatactaccaagacgaactaacttaccgaaacgtaccttacctttttacgaactaaatacgaaacaacctagaagaagaacgacgacaccggcctacttagtattgtgacgagacgtagaaggaacgaccgtccgacgtaacgtaccaacgttagttaactttacgtaaacgttagtttacg

SEQ ID NO: 325487 - DNA, 804 bp, Homo sapiens
  misc_feature: GZ8MTXP02JNXRR.25.51.E07.1.454.CMB.2.raw
tcagactgtacagtcacgaccggtgctcgatttagcatactctacaacacacaaaggggtctgagagaggagcccagccctgggattttcaggtgttttcatttggtgatcagggctgaacagagagaactcacatggagtttgggctgaactggctttttcttgtggcttacttttaaaaggtgtccactgtgacgtgcagctattggagtcgtgggggagcttgggtgcgaggccggggaggtccctggacgactctcctgtacagcgtctggtattgccttggcagccatcgccccgtgggctggggtcccgccgagggtcccgaaggggaacgggccgtggggagttggggtctacgaaagttggtacgaccttccgtggggtccggttaggttcgtaccacgaccttcgtaccggccgggtacttccgtggtacggaaaccgggcccccgtacgttaccaaacctaacttaactacccgaaggaacgaaacctaaaccgttacccgtaaaacgggttaaccctttaaccccgtttttttacgtaaaccttaaaacgttaacggtaaaaccctaaacccgttaggaacggtaacggaaacggaacggaaaccggacccggtacccttacgtttaacgtttagtttacggttacggtacggtaacggtaaccggtagggtaaacgggtaaaccgtaacccggttacccggtacccggttaacggttaaacccgtaaaacggtttacgggtttaaacgtttttaaccggtttaaaaacgggtttacgggtttttaaaccggg

SEQ ID NO: 325488 - DNA, 602 bp, Homo sapiens
  misc_feature: GZ8MTXP02IH3FA.25.51.E07.1.454.CMB.2.raw
  modified_base (268)..(268): a, c, t, g, unknown or other
  misc_feature (268)..(268): n is a, c, g, or t
  modified_base (273)..(273): a, c, t, g, unknown or other
  misc_feature (273)..(273): n is a, c, g, or t
  modified_base (347)..(347): a, c, t, g, unknown or other
  misc_feature (347)..(347): n is a, c, g, or t
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggtcttttttcttgtggtcttacttttaaaaggtgtccactgtgacgtgcagctattggagtcgtgggggagcttgggtgcaggccgggagggtccctgagactctcctgtacngcgtntggtattgcctttggcagccatcgccctgggcctgggtcccgcgagggtccaggggaggctggagtgggtctanaaatgtgactccgtgggcggtagtcgtcactactctacggcgactcgtgtacgacggccctctacacaatactccagaacgactaaacttaccgaacggtaaccttaccctttttagaacctaaatacgaaactaacctagagagacgagacacggcctactattattgtagacgtagactaggaacggaacgaccgtccgacgtaacggtacctaaacgttaggttaactttacgtaaacgttaggttttacgg

SEQ ID NO: 325489 - DNA, 663 bp, Homo sapiens
  misc_feature: GZ8MTXP02JCV2J.25.51.E07.1.454.CMB.2.raw
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggctttttcttgtggctcttttaaaaggtgtccactgtgacgtgcagctattggagtcgtgggggagcttggtgcaggccgggagggtccctgagactctcctgtacagcgtctggatttgcctttggcagccatcgcccctgggctgggtccgccgagggtccaggggaaggcctgggagtggggtctacgaaatgtgactccgtgggcggtagtcgtcacacgtctacggcggactcgtgtgaacgggcccgacttcactaaatactacccagaacgaacaacttaccaaacggtaccttaccctttttagacctaaaattacgaaactaacccgttagaacggaacgaacggaacggaaccgaccgggacccttacttaacttagttacggtacgtaccggaagaccgttaggaaacgggtaacggaacccgttacccggaccttaacggtacccgtaaaagttacgggttaactttaccgttaaaaccggttaggtttttaccgg

SEQ ID NO: 325490 - DNA, 743 bp, Homo sapiens
  misc_feature: GZ8MTXP02HQBF4.25.51.E07.1.454.CMB.2.raw
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggtctttttcttgtggcttacttttaaaaggtgtccactgtgacgtgcagctattggagtcgtgggggagtcttgggtgcaggcccgggagggtccctggagtactctcctgtacagcgtctggattgcctttggcagccatcgcccgtggcgtggtcccgccgaggtccaggggaggcctgggagtgggtctacaaagtgtacgacctccgtggggccgttaggtcgtacaacctacgtacgttccgacgggtactccgtagtacggaaaccggtcccccgtccttaccaaactaaactaactacccgaaaggaacgtaaacctaaaacgttaaccccgtaaaacgggtaaccccgttttaacccctttttttacggaaacccgttaaaattaacgaaaacctaaacccgttagaaggaacggaacggaaacggaaccgaacccggtaccccttaccttaactttaaacgttcgttacggtaccggaggtaaaccgtagggaaacggaaacgacccgtacccgaccgttaacggtaaccgtaaaagttacggttaactttaacgtaaaaccggttaggttttaaccgg

SEQ ID NO: 325491 - DNA, 560 bp, Homo sapiens
  misc_feature: GZ8MTXP02G1DYE.25.51.E07.1.454.CMB.2.raw
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggctttttcttgtggctcttttaaaaggtgtccactgtgacgtgcagctattggagtctgggggagcttggtgcagccgggagggtccctgagactctcctgtacagcgtctggattgcctttggcagccatgccctgggctgggtccgccagggtcccaggggaaggcctgggagtggggtctcaaatgtgactccgtggcggtagtgtcacactctacgcggactctgtgaaacggcccgcttcaccaaatatccagagaacaattccaaaggactaccctttttgacctaaatagaaacaacctagagagaacgaggacacggcctactattatgtgcgagactagacggaacgactcccgctcggtaccaaatacggtatttactaaacgtaggttttacgg

SEQ ID NO: 325492 - DNA, 597 bp, Homo sapiens
  misc_feature: GZ8MTXP02GF9IZ.25.51.E07.1.454.CMB.2.raw
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggctttttcttgtggctcttttaaaaggtgtccactgtgacgtgcagctattggagtcgtgggggagcttggtgcaggccgggagggtccctgagactctcctgtacagcgtctggtatttgtctttggcagccatcgcccctgggctgggtccgcgagggtccgaggggacggcctgggaggtgggtctcgaaatgtgactccgtggcggtagtcgtcacactcgtcggcgactcgtgtcgaacggccccgcttacactaatactccaagacgacaacttaccaaacggtaccttaccctttttcgactaaatacgaactaacctagagagacgagacacgcctactacttatgtcgcgagacgtagacggaacgaccgtaccgtccgtcggtaaccgtaaagttacggttaacgtttacgtaaacggttacggttttacgg

SEQ ID NO: 325493 - DNA, 623 bp, Homo sapiens
  misc_feature: GZ8MTXP02JS7PU.25.51.E07.1.454.CMB.2.raw
  modified_base (264)..(264): a, c, t, g, unknown or other
  misc_feature (264)..(264): n is a, c, g, or t
  modified_base (379)..(379): a, c, t, g, unknown or other
  misc_feature (379)..(379): n is a, c, g, or t
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggtcttttcttgtggctcttttaaaaggtgtccactgtgacgtgcagctattggagtcgtgggggagcttgggtgcgaggccgggagggtccctgagactctcctgtacngcgtctggatttgcctttggactagcccatcgccccgtgggcctgggtccgccgagggtccaggggaggccgtgggagtgggtctcgaaatgtagactcgtggcgtagtgtcacncgtctacgcggtactcgtggtgaacggcccgcttccaacaatactacgaagagacaactaccgaaacgtaccttaccctttttagactaaacgttacgaaactaactacgaagaacgaacgaacggaaccgaccggacccttacttacttagttacgtcggtacgacgtacgtaggaacggacgaccgtccgaccgtcggtaccctaaagtacggttacttacgttaacggtacggttttaacg

SEQ ID NO: 325494 - DNA, 583 bp, Homo sapiens
  misc_feature: GZ8MTXP02H754U.25.51.E07.1.454.CMB.2.raw
  modified_base (310)..(310): a, c, t, g, unknown or other
  misc_feature (310)..(310): n is a, c, g, or t
tcagactgtacagtcacgaccggtgctcgatttagcatactctacaacacacaaaggggtctgagagaggagcccagccctgggattttcaggtgttttcatttggtgatcaggggctgaacagagagaactcaccatggagtttgggctgaactggtctttttctgtggctcttttaaaaggtgtccactgtgacgtgcagctattggagtcgtgggggagcttggtgcgagccgggagggtccctgagactctcctgtacagcgtctggattgcctttggcagccatcgcccgtgggcctgggtcccnccgagggtccaggggaggcctgggagtgggtctcaaatgtgactccgtgggcggtagtcgtcactactcgtacgcggtactccgtgtacgacgggccctctcacatactccagagacaacttacgaacgtaccttacctttttagactaaatacgaaactaacctagagagacgaacgacaccggcctactatatgtagacgagactaggacgacgacgtccgaccgtaacggtaccaaagtacggtactttacgtaaacgttacggtttacg

SEQ ID NO: 325495 - DNA, 637 bp, Homo sapiens
  misc_feature: GZ8MTXP02FG27A.25.51.E07.1.454.CMB.2.raw
  modified_base (193)..(193): a, c, t, g, unknown or other
  misc_feature (193)..(193): n is a, c, g, or t
  modified_base (304)..(304): a, c, t, g, unknown or other
  misc_feature (304)..(304): n is a, c, g, or t
  modified_base (363)..(363): a, c, t, g, unknown or other
  misc_feature (363)..(363): n is a, c, g, or t
  modified_base (402)..(402): a, c, t, g, unknown or other
  misc_feature (402)..(402): n is a, c, g, or t
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggcttttcttgtggctcttttaaaaaggtgtccactgtnacgtgcagctattggagtctgggggagcttggtgcagccgggagggtccctgagactctcctgtacagcgtctggattgccttggcagccatgcccctgggctggggtccncgaggggtccaggggaagggcctggagtgggtctcaaatgtgactccgtggccggtagngtcacactcgtaccgcgggactctgtagaacgggccccnttacacaaatactaccacgaagaccaaactttaccaaacgggtaccttaaccccctttttttagacctaaactacgaaaccaaacccgtagaacggaggaccgaacggaccgaaaccgggtcccctacttaatttaattcggtgaccggagacctaggacggaaacggaccccgtccgaccgtaacggtaaccgtaaacgtacggttactttaacgtaaacggttacggtttacg

SEQ ID NO: 325496 - DNA, 542 bp, Homo sapiens
  misc_feature: GZ8MTXP02GN7AA.25.51.E07.1.454.CMB.2.raw
  modified_base (333)..(333): a, c, t, g, unknown or other
  misc_feature (333)..(333): n is a, c, g, or t
  modified_base (366)..(366): a, c, t, g, unknown or other
  misc_feature (366)..(366): n is a, c, g, or t
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggctttttctgtggctcttttaaaaggtgtccactgtgacgtgcagctattggagtctgggggagcttggtgcagccgggagggtccctgagactctcctgtacagcgtctggatttgcctttggcagccatgccctgggctgggtccgcagggtccagggaggcctgggagtgggtcncaaatgtgactcctggcggtagtgtcacactcncgcggactcgtgtgaaggcccgcttcacaatatccagagacaattaccaacggactaccctttttgactaaatagaaacacctagagagacgagacacggcctctatatgtgcgagacgtagacggacgacgtccgactcggtaccaagtaggtatttacgtaaacgtagtttacg

SEQ ID NO: 325497 - DNA, 551 bp, Homo sapiens
  misc_feature: GZ8MTXP02IL2LT.25.51.E07.1.454.CMB.2.raw
  modified_base (302)..(302): a, c, t, g, unknown or other
  misc_feature (302)..(302): n is a, c, g, or t
  modified_base (395)..(395): a, c, t, g, unknown or other
  misc_feature (395)..(395): n is a, c, g, or t
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggctttttctgtggctcttttaaaaggtgtccactgtgacgtgcagctattggagtctgggggagcttggtgcagccgggaggtccctgagactctcctgtacagcgtctggatttgcctttggcagccatgccctgggctgggtccncgagggtccaggggaggctggagtgggtctcaaatgtgactcctggcggtagtgtcacactctacggcggactcgtgtcggaacggccccgtnttcacaatactccagagacaacttaccaacggtacctaccctttttagactaaatacgaacacctagagagacgagacacgcctctatatgtcgcgagactagacggacgactccgacctcggtaccaagtcggtatttacgtaacgtagtttacg

SEQ ID NO: 325498 - DNA, 774 bp, Homo sapiens
  misc_feature: GZ8MTXP02GNGGD.25.51.E07.1.454.CMB.2.raw
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggtctttttcttgtggcttcttttaaaaggtgtccactgtgacgtgcagctattggagtcgtgggggagcgttggtgcgaggccgggaggtccctgagactctcctgtacagcgtctggatttgcctttggcagcccatcgccccgtgggcctgggtcccgccgagggtcccgaggggaacgggccgtgggaggtcgggtactacgaaatgtagaccttccgtgggccgggtagtcggtaccacgtaccgttcgtaccggccgggtaaccttcgtacggttacggaaacggggtccccccgtactttacccaacctaaacttaacgtacccgaaaggaaacgtaaacctaaacgtttacccgtaaaacgggttaaccctttaacccccgtttttttagaaaccttaaaacgttaaccggtaaaacctaaacccgttaggaacgggaaacggaaccggaacgggaacccgtacccgggtacccttacttaaccgtttaagttcggttacggaccggtagacgttaggaaacgggtaacgaaccgtcccggtacccgtaacggtacccgtaaaacgttacgggtttaactttaaccggttaaacggtttaggttttaaccgg

SEQ ID NO: 325499 - DNA, 729 bp, Homo sapiens
  misc_feature: GZ8MTXP02ITR4G.25.51.E07.1.454.CMB.2.raw
  modified_base (387)..(387): a, c, t, g, unknown or other
  misc_feature (387)..(387): n is a, c, g, or t
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggctttttcttgtggctcttttaaaaggtgtccactgtgacgtgcagctattggagtcgtgggggaggcgttggtgcgaggccggggagggtccctggagacctctcctgtacagcgtctggtatttcgcctttggcagccatcgccgtgggtcgtgggtcccgcgacgggtccgaggggacggcgtgggagtgggtctagaatgtgactcgtggcggtagtgcacgacctcncggcgactcgtacgtcggaacggtccccgtcttaccgactaactactaccgaacggtaaacgaaccgttaaaccttacccgtaaaccgggttaaccctttaccccgttttttacggtaaaccttaaaacgttacggtaaaacctaaccgtacggaaggaacggaaccgggaaccggaccgtaacccgggtacccttacgtttaaacgttagttaacggttcggacggtaaacggtaccgttaagggaacggtaacgtacccggtacccgtaccgtaacggttaaccctaaaaggtttcggttaaacttttaacgtttaaaccggtttacggtttttaaccgg

SEQ ID NO: 325500 - DNA, 561 bp, Homo sapiens
  misc_feature: GZ8MTXP02I5O1K.25.51.E07.1.454.CMB.2.raw
  modified_base (392)..(392): a, c, t, g, unknown or other
  misc_feature (392)..(392): n is a, c, g, or t
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggtctttttcttgtggctcttttaaaaggtgtccactgtgacgtgcagctattggagtcgtgggggagcttggtgcaggccgggagggtccctgagactctcctgtacagcgtctggtattgcctttggcagccatcgccctgggctgggtccgccgagggtccaaggggaacgggcctgggagtggggtctacgaaatgtgactcctgggcgtagtgtcacactctacggcggactntgtgaacggccccgcttacacaatactccagagactaacttaccgaacggtacctaccctttttagactaaatagaaactactagagagacgagacacggcctctatactgtgcgagactagacgacgactccgctggtaccaatcggtattacgtaacgtagtttacg

SEQ ID NO: 325501 - DNA, 607 bp, Homo sapiens
  misc_feature: GZ8MTXP02II8GY.25.51.E07.1.454.CMB.2.raw
  modified_base (304)..(304): a, c, t, g, unknown or other
  misc_feature (304)..(304): n is a, c, g, or t
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggctttttctgtggctcttttaaaaggtgtccactgtgacgtgcagctattggagtcgtgggggagcttggtgcaggccgggaggtccctgagactctcctgtacagcgtctggtattgcctttggcagccatcgccctgggctgggccncgagggtccaggggaggcctgggagtgggtctacgaaatgtgactccgtggcgtagtgtacactactctacggcgactcgtgtagacgggccctcttacacaatactaccagaacgactaacttaccgaacggtaaccttaccctttttagactaaactagaaacctaaccgtagaagaacgaacggacggacgaccggtccctacttacttagttgtacgacgacgacgtaggacggacgaccgtccgaccgtaacggtactaaacgttacggttaactttacgtaaacgtacggttttacg

SEQ ID NO: 325502 - DNA, 669 bp, Homo sapiens
  misc_feature: GZ8MTXP02I0IA1.25.51.E07.1.454.CMB.2.raw
  modified_base (371)..(371): a, c, t, g, unknown or other
  misc_feature (371)..(371): n is a, c, g, or t
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggtcttttttcttgtggcttacttttaaaaggtgtccactgtgacgtgcagctattggagtcgtgggggagcttggtgcgaggccggggagggtccctggagactctcctgtacagcgtctggtatttcgcctttggcagcccatcgccccgtgggctgggtccgacgaggtccgaggggacggcctgggagtcgggtctacaagtgtcgactccgnggcgtagtcgtaccacaccgttctacggcggtacttccgtagtacggaaccgggccctacgttaccaactaaactacgtacccgaagaacgaactaaacttaaccgaaacggtaaccctttaccctttttacgaactaaaacttacgaaacctaaccgtagaaggaacgaacgaacggaccgaccggtacctacgttaattacgttagttacgcgaagtacgtagaacggaacgtaccgtacccgacgtaacggtacctaaagttacggtaactttacgttaaacggttagttttacg

SEQ ID NO: 325503 - DNA, 675 bp, Homo sapiens
  misc_feature: GZ8MTXP02FSMAW.25.51.E07.1.454.CMB.2.raw
  modified_base (261)..(261): a, c, t, g, unknown or other
  misc_feature (261)..(261): n is a, c, g, or t
  modified_base (283)..(283): a, c, t, g, unknown or other
  misc_feature (283)..(283): n is a, c, g, or t
  modified_base (331)..(331): a, c, t, g, unknown or other
  misc_feature (331)..(331): n is a, c, g, or t
tcagactgtacagtcacgaccggtgctcgatttagcatactctacaacacacaaaggggtctgagagaggagcccagccctgggattttcaggtgttttcatttggtgatcaggactgaacagagagaactcaccatggagtttgggctgaactggcttttcttgtggctcttttaaaaggtgtccactgtgacgtgcagctattggagtctgggggaggcttggtgcagccgggagggtccctgagactctccctgtacngcgtcgtgtattcgtcgttgcncgcatccgccgtggcgtcggcccgcgacgggtccgaggggacggtcgngggtaggtcgggtctactaaagtgtacgtaccgtccgtgggtacgtagtcgacctactaccgttacgacgggccgtactccgttgacggtaaccggcccgttacctacaaactaacttacgaccgaagtaacgtaactaaccttaaccgaaacggttaccctttaaccttttcgaaacctaaagtaacgaaacctacgtagaacggacgaaacggacgaaccgtaccggtacctactaagtttgtacggtcgacgtagtacgtaggaacgtaacgacccgtcgtacccgtaagtaaccctaaaggttacggttactttaacggtaacggtttaggttttaaccg

SEQ ID NO: 325504 - DNA, 579 bp, Homo sapiens
  misc_feature: GZ8MTXP02JUEEJ.25.51.E07.1.454.CMB.2.raw
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggctttttcttgtggctcttttaaaaggtgtccactgtgacgtgcagctattggagtcgtgggggagcttggtgcagccgggagggtccctgagactctcctgtacagcgtctggattgcctttggcagccatcgccccgtgggcctggggtcccgccgagggtccgaggggaacggcctgggagtggggtctcaaagtgtgactccgtggcggtagtgtcacactctacgcggactcgtgtgaacggcccgcttcacaatactccagagacaactccaacgtacctaccctttttgacaatacgaacaactgagagacgacgacacggcctactatactgtgcgagacgtggaacggtacgaccgtcccgaccgtaacggtaccctaaagtcggttaactttacgtaaacgttaggttttacgg

SEQ ID NO: 325505 - DNA, 703 bp, Homo sapiens
  misc_feature: GZ8MTXP02GZ1CX.25.51.E07.1.454.CMB.2.raw
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggctttttcttgtggctcttttaaaaggtgtccactgtgacgtgcagctattggagtctgggggagcttggtgcaggccgggagggtccctgagactctcctgtacagcgtctggattgcctttggcagccagtcgccccgtgggctggggtccgccgagggtccaggggaggcctgggagtggggtctcgaaatgtgacttccgtgggcggtagtgtcacactctacggcggactcgtgtacgaacggccccgtcttaccactaaatactaccagaacgaactaaacgttaccaaacggtaccttaaccccttttttagaactaaaacgttacgaaacctaaaccgttaggaacggaacgaaccggaacgggaaccgaaccgggccccttaccgttaactttaagttcggttacggacggtaaacggaccgttagggaacggaaacggtaacccgttcccggtacccgttaacggggttaacccctaaaacggtttacggggttaaacttttaaccggttaaaaacgggttacgggtttttaaccggg

SEQ ID NO: 325506 - DNA, 715 bp, Homo sapiens
  misc_feature: GZ8MTXP02HH604.25.51.E07.1.454.CMB.2.raw
  modified_base (265)..(265): a, c, t, g, unknown or other
  misc_feature (265)..(265): n is a, c, g, or t
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggtctttttctgtggcttcttttaaaaggtgtccactgtgacgtgcagctagttggagtcgtgggggaggcttggtgcgaggccgggaggtccctgagactctcctgtacngcgtctggtatttgcctttggctacgcccagtcgccccgtgggccgtcggggtaccccgccggtacggggtcccgaaggggaacgggccgtgggacggttcggggtcctacgtaaaagttcggtacgaccgttccggtcggggtaccggtagttcggtacctaaccgtaccgttccgtaccgggccgtaacttcgttcgggtacgaaccgggcccgtaccttaccaactaaatactaccgaaggaacgtaaactaaccgttaccgtaaaccgggtacctttacccgtttttagaacctaaagttaacgaaaccgtaaccgtaggaacgaacgaacggtacgaccgaccggtaccctagttattagtgtacgacgtagagtcggaacggaccgacgtcccgtctaacggtacctaaagttcgttatttaccgtaaacggttacgtttacgg

SEQ ID NO: 325507 - DNA, 710 bp, Homo sapiens
  misc_feature: GZ8MTXP02JA5QE.25.51.E07.1.454.CMB.2.raw
  modified_base (307)..(307): a, c, t, g, unknown or other
  misc_feature (307)..(307): n is a, c, g, or t
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggtctttttcttgtggctcttttaaaaggtgtccactgtgacgtgcagctattggagtcgtgggggagcttggtgcagccgggaggtccctgagactctcctgtacagcgtctggtattgcctttggcagccatcgccctgggctgggtcccncgagggtccaggggacggcctgggagtgggtctacaaagtgtgactccgtgggcggttagtgtcactactctacggcgactcgtgtgaacggcccgcttcactaatactaccagaacgacaacttaccgaaacggtaccttacccgttttttacgacctaaaacgtacgtaaacctaacccgtaggaacgaacggaaccggaacgggaaccgacccgggtacccgttaccgtttaactttacgttaggtttacggaccggttaagggaaccgttaagggaacggggtaaaaccggtaacccgttccccggtacccgtttaaccgggttaaccccgttaaaacggtttacgggtttaaccgtttttaaccggttaaaaccggtttaacggggtttttaaccggg

SEQ ID NO: 325508 - DNA, 587 bp, Homo sapiens
  misc_feature: GZ8MTXP02GLFDE.25.51.E07.1.454.CMB.2.raw
  modified_base (398)..(398): a, c, t, g, unknown or other
  misc_feature (398)..(398): n is a, c, g, or t
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggtctttttcttgtggctcttttaaaaggtgtccactgtgacgtgcagctattggagtctgggggaggcttggtgcaggccgggagggtccctgagactctcctgtacagcgtctggattgccttggcagccatcgcccctgggctgggtccgccgagggtccaggggacggcctgggagtgggtctcgaaatgtgactctggcgtagtgtcacactctacgcggactcgtgtcgaacggcccncgttcacaaatactaccagaagaacaacttaccgaaacggtaccttacccttttttagacctaaatacgaaacctaacctagaagaagaacgaagacgacggccctactattattgtgcgagactagacggaacgacctccgaccgtcggtacctaaagtcggttatttacgtaaacgtaggttttacg

SEQ ID NO: 325509 - DNA, 762 bp, Homo sapiens
  misc_feature: GZ8MTXP02HO5OU.25.51.E07.1.454.CMB.2.raw
  modified_base (316)..(316): a, c, t, g, unknown or other
  misc_feature (316)..(316): n is a, c, g, or t
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggctttttcttgtggctcttttaaaaggtgtccactgtgacgtgcagctattggagtcgtgggggaggcttgggtgcaggccggggagggtccctgagactctcctgtacagcgtctggtatttgcctttggcagcccatcgccccgtgggctggggtcccnccgagggtccgaggggaacgggcctgggagtggggtctcgtaaagtgtgactccgtgggcggtagtcgtcacaccttctacgccggactcgtgttcggaacgggcccccgtacttaccaactaaacttacttacccgaaggaacgtaaacctaaaccgttacccgtaaaacgggtaacccgtttaaccccttttttttacgaaccttaaaacgttacgtaaaacctaaacccgttaggaacgggacggaaccggaacgggaacccgaacccggtaccccgttacttaacgtttaacgttacggttacggacggtaacggtaaccgttacgggtaaacgggaaacggtaacccgttccccggtacccgttaaccgggttaaccgtaaaacggtttacgggtttaacgtttaaccggttaaaacgggtttaacggggtttttaaccgg

SEQ ID NO: 325510 - DNA, 597 bp, Homo sapiens
  misc_feature: GZ8MTXP02IZVPG.25.51.E07.1.454.CMB.2.raw
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggtctttttcttgtggcttcttttaaaaggtgtccactgtgacgtgcagctattggagtcgtgggggaggcttgggtgcaggccggggagggtccctgagactctcctgtacagcgtctggattgcctttggcagccatcgccctgggctgggtcccgcgagggtccgaggggacggcctgggagtcgggtctacgaaagtgtgacctccgtgggcggtagtcgtcacacttctacgcggactcgtgtcgaacggccctcgttacacaaatactccaagacgaacaacttaccaaacggtaccttaccctttttcgactaaatacgaaacaaccgtagagaagacgacggacgacgcctactattatgtcgcgagactaggaacgacgacctccgaccgtcgtaccaaagttacggtatttacgtaaacggtacggttttacg

SEQ ID NO: 325511 - DNA, 561 bp, Homo sapiens
  misc_feature: GZ8MTXP02F4ULU.25.51.E07.1.454.CMB.2.raw
  modified_base (261)..(261): a, c, t, g, unknown or other
  misc_feature (261)..(261): n is a, c, g, or t
  modified_base (377)..(377): a, c, t, g, unknown or other
  misc_feature (377)..(377): n is a, c, g, or t
  modified_base (403)..(403): a, c, t, g, unknown or other
  misc_feature (403)..(403): n is a, c, g, or t
  modified_base (499)..(499): a, c, t, g, unknown or other
  misc_feature (499)..(499): n is a, c, g, or t
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggctttttcttgtggctcttttaaaaggtgtccactgtgacgtgcagctattggagtcgtgggggagcttggtgcaggccgggaggtccctgagactctcctgtacngcgtctggattgcctttggcagcccatcgccccgtgggctggggtcccgccgagggtccgaggggacggccgtgggagtgggtctcgaaatgtgactccgtggcggtagtgtcacnctctcgcgactctgtgaacggcccgnttcacaatactaccagagacaacttaccaaacggtaccttaccctttttgactaaatacgaactaactagaagagaacgagacacggcctctattntgtcgcgagactaggaacgacgactccgcgtcgtacaagtcgtattactaacgtagtttacg

SEQ ID NO: 325512 - DNA, 554 bp, Homo sapiens
  misc_feature: GZ8MTXP02FT0FQ.25.51.E07.1.454.CMB.2.raw
  modified_base (261)..(261): a, c, t, g, unknown or other
  misc_feature (261)..(261): n is a, c, g, or t
  modified_base (303)..(303): a, c, t, g, unknown or other
  misc_feature (303)..(303): n is a, c, g, or t
  modified_base (334)..(334): a, c, t, g, unknown or other
  misc_feature (334)..(334): n is a, c, g, or t
  modified_base (341)..(341): a, c, t, g, unknown or other
  misc_feature (341)..(341): n is a, c, g, or t
  modified_base (382)..(382): a, c, t, g, unknown or other
  misc_feature (382)..(382): n is a, c, g, or t
  modified_base (392)..(392): a, c, t, g, unknown or other
  misc_feature (392)..(392): n is a, c, g, or t
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggcttttcttgtggcttcttttaaaaaggtgtccatgtgacgtgcagctattggagtctgggggagcttggtgcagccggggagggtccctgagactctcctgtacngcgtctggattgccttggcagccatgccctgggctgggtccnccagggtccaggggaggcctggagtggggcncaaatgngactcctggcggtagtgtcacactctacgcgggactctgtnaaggccccgnttcacaaatatccagagacaattccaaaggacaccccttttttgacaaatagaacaacctgagagacgaggacacggccctctattatagtgcgagactggaaggaacgactccgacctggtacccaaaataggtatttactaaaaccgtaggttttaacgg

SEQ ID NO: 325513 - DNA, 744 bp, Homo sapiens
  misc_feature: GZ8MTXP02GI20E.25.51.E07.1.454.CMB.2.raw
  modified_base (261)..(261): a, c, t, g, unknown or other
  misc_feature (261)..(261): n is a, c, g, or t
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggctttttcttgtggcttcttttaaaaggtgtccactgtgacgtgcagctattggagtctgggggagcttggtgcaggccgggagggtccctgagctctcctgtacngcgtctggattgcctttggcagcccatcgccccgtggggctcgggtcccgccgagggtcccgaggggaacgggccgtggggagtggggtctcgtaaagtgtgaccttccgtgggtcggtagtcgtcactacttcgtacgcggtacttcgtgtcgaacggtccccgtacttaccaactaaacttactacccgaagaacggtaacctaaaccgttaacccgaaacggttaacccttaacccccgttttttttacggacctaaaacttacggtaaaaccctaaacccgttaggaaacggaacggaaccggaaacgggaaccgtaacccgggaccccttacttaacgtttaagttacggtggtacccggaggtaaccgttagggtaaacggaaacgtacccgttacccggtaccgtaacgggttaaccctaaagtttaccgggtttaattttaaacggttaaaacccggtttagggtttttaaccgg

SEQ ID NO: 325514 - DNA, 664 bp, Homo sapiens
  misc_feature: GZ8MTXP02G8LQS.25.51.E07.1.454.CMB.2.raw
  modified_base (266)..(266): a, c, t, g, unknown or other
  misc_feature (266)..(266): n is a, c, g, or t
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggtctttttcttgtggcttcttttaaaaggtgtccactgtgacgtgcagctattggagtcgtgggggagcgttggtgcgaggccgggagggtccctgagactctcctgtacngcgtctggtatttgccttggcagccatcgcccgtgggccgtgggtcccgccgacggggtccgaaggggaacgggccgtggggaggtcggggtctacgaaagttgtcgacttccgtgggcggtagtcgtcacactctacggcggactcgtgtacggaacggtccccgtacttaccgactaaactactaccgaagaacgaactaacttaccgaaacggtaccttacccgtttttacgaactaaatacgaaacctaaccgtagaagacgaacggaacggaccgaccggtaccctacttagttacgttgtcgacgagacgtaggaacggaacgaccgtcccgaccgtaacggtacctaaagttacggttaactttaacgtaaacggttacggttttaaccgg

SEQ ID NO: 325515 - DNA, 760 bp, Homo sapiens
  misc_feature: GZ8MTXP02HDYDY.25.51.E07.1.454.CMB.2.raw
  modified_base (267)..(267): a, c, t, g, unknown or other
  misc_feature (267)..(267): n is a, c, g, or t
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggtcttttttcttgtggtcttacttttaaaaggtgtccactgtgacgtgcagctattggagtcgtgggggaggcttggtgcaggccggggaggtccctgagctctcctgtacngcgtctggtatttgcctttggcagcccagtcgccccgtgggccgtcgggtcccgaccggtagggtcccgagggggaacggccgtaggggaggttcggggtctacgaaaagttcggtcggtaccttccggtggggaccggttaggtcgtaccacgtacctcgtaccggccggtacttcgtggtaggaaccgggtcccccgtacttaccaacctaaactaactacccgaagaacgaaacctaacttacccgaaacggtaacccttaaccccttttttagaaacctaaacgttacgtaaacctaacccgttagaacggaacgaaccggaacggaaccgaacccggtacccttaccgttaactttacgttcggtacgtaccggtaaggaacgttacgggaaacggtaaccggtacccgtacccgtacccgtaacggttaccgtaaaacgtttcggttaactttaaccggttaaaaccggtttacggtttttaaccgg

SEQ ID NO: 325516 - DNA, 723 bp, Homo sapiens
  misc_feature: GZ8MTXP02FOLPQ.25.51.E07.1.454.CMB.2.raw
  modified_base (266)..(266): a, c, t, g, unknown or other
  misc_feature (266)..(266): n is a, c, g, or t
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggtctttttcttgtggcttcttttaaaaggtgtccactgtgacgtgcagctattggagtcgtgggggaggcttggtgcaggccgggagggtccctgagacctctcctgtacngcgtctggattgccttggcagcccatcgccccgtgggctgggtcccgccgagggtccgaggggacgggcctgggaggtggggtcctacgaaatgtgacctccgtgggccggtagtcgtccacacctcgtacgcggactctgtacgaacggccccgtcttaccaactaaactactacccaagaacgaactaaacttacccgtaaacggtaccctttaaccccttttttacgaacctaaaacgtacgtaaaacctaacccgttaggaaacggaacgaaccggaacggtaacccgacccgggtaccccttaacgttaacgtttaagtttcggttacggtacggaacggtaaccgttagggaacggtaaaccgtaacccgttcccggtacccgtaacggttaacccgtaaaagtttacgggttaacttttaacgttaaaaccggtttaggtttttaaccgg

SEQ ID NO: 325517 - DNA, 607 bp, Homo sapiens
  misc_feature: GZ8MTXP02GPOHW.25.51.E07.1.454.CMB.2.raw
  modified_base (370)..(370): a, c, t, g, unknown or other
  misc_feature (370)..(370): n is a, c, g, or t
  modified_base (424)..(424): a, c, t, g, unknown or other
  misc_feature (424)..(424): n is a, c, g, or t
  modified_base (541)..(541): a, c, t, g, unknown or other
  misc_feature (541)..(541): n is a, c, g, or t
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggtcttttttcttgtggcttacttttaaaaggtgtccactgtgacgtgcagctattggagtcgtgggggaggcttggtgcgaggccggggagggtccctgagacctctcctgtacagcgtctggtatttgcctttggcagcccatcgccccgtgggctgggtcccgcgacgggtccaggggaaggcctgggagtgggtctcgaaatgtgactccgngggcggtagtcgtcactaccttcgtacggccggtactcgtgtgaacggcccctnttaccactaaatactacccaaggacgaactaacttaccgaaacggtaaccttaccctttttagacctaaatacgaaactacctagagagacgaggacgacgccctctattatgtcgngagacgtgacgacgacctccgcctaacggtaccaaagttcgtacttacgtaacggttacgtttacg

SEQ ID NO: 325518 - DNA, 605 bp, Homo sapiens
  misc_feature: GZ8MTXP02JC2GB.25.51.E07.1.454.CMB.2.raw
  modified_base (262)..(262): a, c, t, g, unknown or other
  misc_feature (262)..(262): n is a, c, g, or t
  modified_base (307)..(307): a, c, t, g, unknown or other
  misc_feature (307)..(307): n is a, c, g, or t
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggtctttttcttgtggctcttttaaaaggtgtccactgtgacgtgcagctattggagtcgtgggggagcttggtgcaggccgggagggtccctgagctctcctgtacngcgtctggattgcctttggcagccatcgccctgggctgggtcccncgagggtccaggggacggcctgggagtgggtcacaaatgtgactccgtggacgtagtcgtacacactctacggcggtactcgtgtacgaacggccccgtattacactaaatactaccaagaacgaactaactaccgaaacggtaccttaccctttttagactaaattacgaaactacctagagacgacggacgacgaccggtacctacttattattgtcgtacgagacgtagaacggacgaccgtccgccgtaacggtacctaaacgtaggttatttacgtaaacggttaggtttacg

SEQ ID NO: 325519 - DNA, 614 bp, Homo sapiens
  misc_feature: GZ8MTXP02H54YN.25.51.E07.1.454.CMB.2.raw
  modified_base (280)..(280): a, c, t, g, unknown or other
  misc_feature (280)..(280): n is a, c, g, or t
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggtctttttcttgtggcttactttttaaaaggtgtccactgtgacgtgcagcttattggagttcgtgggggagtcttgggtgcagccggggagggtccctgacgactctcctgtacagcgtctggnttgcctttgcagccatcgcccgtgggcgtgggtcccgccgagggtccgaggggaaggccgtggggacggttggggtactacgaaagtggtacgaccgtccgtgggacggttagtcgtcactactccgtacgcggtactcgtgcgaacgggccctctcacatactcagacgaacaacttaccgaaacggtacctttacccgtttttagaactaaagtacgaaactaacgtagaagagaacgaggaccacggcctacgtattctagtgacgtagactaggacgacgactccgacgtcggtaccaagtcgtactttacgtaaacgttacggtttacg

SEQ ID NO: 325520 - DNA, 642 bp, Homo sapiens
  misc_feature: GZ8MTXP02HGM6B.25.51.E07.1.454.CMB.2.raw
  modified_base (264)..(264): a, c, t, g, unknown or other
  misc_feature (264)..(264): n is a, c, g, or t
  modified_base (313)..(313): a, c, t, g, unknown or other
  misc_feature (313)..(313): n is a, c, g, or t
tcagactgtacagtcacgaccggtgctcgatttagcatactctacaacacacaaaggggtctgagagaggagcccagccctgggattttcaggttgttttcatttggtgatcagggctgaacagagagaactcaccatggagtttgggctgaactggtctttttcttgtggcttacttttaaaaggtgtccactgtgacgtgcagctattggagtctgggggagcttggtgcaggccgggagggtccctgagctctcctgtacngcgtctggtattgcctttggcagccatcgcccgtgggctcggggtcccnccgagggtccgaaggggacggcctagggaggtgggtctacgaaattgtacgaccttccgtgggcggtagtgtccacacctcgtaccggcgtactcgtgtacgaacgggccctcttaccaacaaactactaccgagaaacgactaaacttaccgaaacggtaacccttaccccgtttttagactaaactacgaaactaaccgtagaggaacgacgacggaacgtaccggcctacttagtttactggttacgacggagtacgtaggaaggaacgaccgtccgtaccgtcgtacgtaaacgtgttaacgttacgtaaacggttaggtttacg

SEQ ID NO: 325521 - DNA, 677 bp, Homo sapiens
  misc_feature: GZ8MTXP02JQU6Q.25.51.E07.1.454.CMB.2.raw
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggtctttttctgtggcttacttttaaaaggtgtccactgtgacgtgcagctattggagtcgtgggggaggcgttggtgcaggccgggagggtccctgagactctcctgtacagcgtctggtatttgcctttggcagcccatcgcccgtggggctgggtccgcgacgggtccaggggaggccgtggagtgggtctcgaaatgagactccgtgggcggtagtcgtcgacacctcgtaccggccggtactcctggtacggaaccggggccctactttaccaactaaatactaccgaagaacgaactaaacgttaccgtaaacggttaccttacccttttttacgaactaaaacgttacgaaaacctaaacccgttaggaacggaaggaacgaacggaaccgacccgggtacccttacttacgttattacggtagtaccgaagtaccgtaggaaggaacgtaccgtccgtacgtcgtaccgtaaacgttaggttacgtttacgttaaaccggttaggttttaaccgg

SEQ ID NO: 325522 - DNA, 580 bp, Homo sapiens
  misc_feature: GZ8MTXP02FO0DG.25.51.E07.1.454.CMB.2.raw
  modified_base (356)..(356): a, c, t, g, unknown or other
  misc_feature (356)..(356): n is a, c, g, or t
  modified_base (493)..(493): a, c, t, g, unknown or other
  misc_feature (493)..(493): n is a, c, g, or t
  modified_base (505)..(505): a, c, t, g, unknown or other
  misc_feature (505)..(505): n is a, c, g, or t
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggctttttcttgtggctcttttaaaaggtgtccactgtgacgtgcagctattggagtcgtgggggaggcttgggtgcaggccggggagggtccctgagactctcctgtacagcgtctggattgcctttggcagcccatcgcccctgggctggggtcccgccgagggtccaggggaagggcctgggagtgggtctcgaaatgngactccgtggcgtagtgtcacactctcgcggactctgtgaacggcccgtcttcacaatactaccagagacaacttaccaaggtacctaccctttttgactaaatagaacaacctagaagagacgagacacggccctntacttatgtcgngagacgtagaggaacgacctccgccgtcggtaccaaacgttaggtactttacgtaaacggttacggttttaacgg

SEQ ID NO: 325523 - DNA, 621 bp, Homo sapiens
  misc_feature: GZ8MTXP02HK1SS.25.51.E07.1.454.CMB.2.raw
  modified_base (231)..(231): a, c, t, g, unknown or other
  misc_feature (231)..(231): n is a, c, g, or t
  modified_base (361)..(361): a, c, t, g, unknown or other
  misc_feature (361)..(361): n is a, c, g, or t
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggtcttttttcttgtggcttacttttaaaaggtgtccactgtgacgtgcagctattggagtcgtgggggagcttggngcgaggccgggaggtccctgagactctcctgtacagcgtctggtatttgcccgtttggcacgcccatcgcccgtgggccgtgggtccccgcgacgggccgaggggaacggccgtgggaggtgggtcctanaaagtgtcgacgtccgtgggtcggtagtcgacacacttcgacgcgactcgtgacgaacggcccctcttacacaaactacaccagacgaactaacttaccaaacggtacccttaccttttacgaactaaatagaaacaactagagagaacgacggacgaccgacctactattagtagtacgcgagacaggaagacgtaccgtaccgaccgtaacgtaccgtaaacgtaggttaacttaccgttaaacggttagtttaccgg

SEQ ID NO: 325524 - DNA, 645 bp, Homo sapiens
  misc_feature: GZ8MTXP02GDRBW.25.51.E07.1.454.CMB.2.raw
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggtctttttcttgtggcttcttttaaaaggtgtccactgtgacgtgcagctattggagtctgggggagcttggtgcgagccgggagggtccctgagactctcctgtacagcgtctgtattgcctttggcagccatcgcccctgggctggggtcccgccgaggggtccgaggggaacgggccgtgggaggtcggggtctacgaaaagtgtgacctccgtgggtccgggttagtcgtaccacaccgttcgtaccggcggtacctcgtggtacgaaacgggcccccgtacttacaacaaatactccaagtaacgaacaacttaccaaacggtaccttacccgtttttagactaaatagaaacaacctaggacgagacgaggacacggtaccctctattagttagtgacgaagacgtaggaggaaacgaccgtaccgaccgtcggtaacccgtaaagttaggttaatttaccgtaaaacggttagttttaaccgg

SEQ ID NO: 325525 - DNA, 807 bp, Homo sapiens
  misc_feature: GZ8MTXP02F4XWS.25.51.E07.1.454.CMB.2.raw
  modified_base (260)..(260): a, c, t, g, unknown or other
  misc_feature (260)..(260): n is a, c, g, or t
  modified_base (304)..(304): a, c, t, g, unknown or other
  misc_feature (304)..(304): n is a, c, g, or t
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggctttttcttgtggctcttttaaaaggtgtccactgtgacgtgcagctattggagtctgggggagcttggtgcagccgggagggtccctgagactctcctgtacngcgtctggattgcctttggcagccatcgccctgggctgggtccnccgagggtcccaggggacggccgtgggagtcggggtctacgaaaagttggtagaccttcccgtggggtccgggttagtcggttccaaccgtaaccgttccgttaccggggccgggtaaacttccgttgggtacgggtaaacggggccccccgtacgtttacccaacctaaacttaacgttacccaaggaacggtaaacctaaaaccgtttaccccgtaaaacgggttaacccctttaaacccccgttttttttacggtaaaccttaaaaacgttaacggtaaaacccttaaaccccgttaggtaaacgggaaacggaaaccgggaaacggggaaccgaacccggggtaccccttaccgttaactttacgtttacggttacggtaccggtaaggtaaccgtagggaaacgggaaacggtacccgtacccggtaccgtaacgggtaaccctaaaagttacggttaacgttttaccgttaaaacggtttaacgggtttttaaccgg

SEQ ID NO: 325526 - DNA, 650 bp, Homo sapiens
  misc_feature: GZ8MTXP02I0T6P.25.51.E07.1.454.CMB.2.raw
  modified_base (366)..(366): a, c, t, g, unknown or other
  misc_feature (366)..(366): n is a, c, g, or t
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggtctttttcttgtggtcttacttttaaaaggtgtccactgtgacgtgcagctattggagtcgtgggggagcttggtgcagcggggaggtccctgagactctctgtacagcgtctggtattgccttggcagccatcggccctggggctcgggtccgcgagggtccgaggggaacggccgtgggaggttgggtctagaagtgtcgacctccgngggtcgtagtcgtaccactactcgtaccggcggtactccgtggtacgaaccgggcccgtacttacaactaaatactccaaggaacgaacacttaaccgtaaacggtaccctttaccgtttttacgaactaaactaacgtaaaccctaacgtacgaacggaacgaaccggaacggaaccgtacccggtcccttacgttaagtttagttcggtagacgtagacgtaggacgtaacgacctccgcgtaacgtaactaagtcgttaattaccgtaagttacgtttacg

SEQ ID NO: 325527 - DNA, 683 bp, Homo sapiens
  misc_feature: GZ8MTXP02GODK9.25.51.E07.1.454.CMB.2.raw
  modified_base (263)..(263): a, c, t, g, unknown or other
  misc_feature (263)..(263): n is a, c, g, or t
  modified_base (312)..(312): a, c, t, g, unknown or other
  misc_feature (312)..(312): n is a, c, g, or t
  modified_base (383)..(383): a, c, t, g, unknown or other
  misc_feature (383)..(383): n is a, c, g, or t
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggtctttttcttgtggctcttttaaaaggtgtccactgtgacgtgcagctattggagtcgtgggggagcttggtgcaggccgggaggtccctgacgactctcctgtacngcgtctggtattgcctttggcagccagtcgcccgtgggctggggtcccncgagggtccgaggggacggccgtgggagtgggtctacgaaatgtacgacttccgtgggcgtagtcgtcacncttcgacggcgtactcgtgtacgaacggtcccgtcttcaactaaatactaccgaagtaacgaactaacttaccgaaacggtacctttacccgtttttagaaacctaaatacgaaacctaaccgtaggaacggaacggacggaacggaaccgaccggtacccttacttaacgtttaacgttggttacgacggaacgtaacgtaggaaacggaacgtaccgtacccggtaccgttaacggttaacccgtaaaaggttacggttaaacgttttaacgttaaaaccggttaggtttttaaccgg

SEQ ID NO: 325528 - DNA, 728 bp, Homo sapiens
  misc_feature: GZ8MTXP02GS3PZ.25.51.E07.1.454.CMB.2.raw
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggtctttttcttgtggcttcttttaaaaggtgtccactgtgacgtgcagctattggagtctgggggagcttggtgcaggccgggagggtccctgagctctcctgtacagcgtctggatttgcctttggcagccatcgccccgtgggccgtggggtcccgccgaggggtcccaggggaacgggcctgggaggttgggtctacgaaagtgtcgacctccgtggcggtagtcgtaccacgtactcgtacgcggtactcgtgtacgaacggtccccgcttacaactaaactactacccagaacgtaaccgtaaacttaacccgaaacggtaaccctttaccccgttttttacgaaccttaaaacttacggtaaaaccctaaaccttacggaaacgggaacgtaacccggaaacgggaaccgaacccgggtaccccttaccgttaatttaaccgttggtacggtacgacggtaaaccgtacggaacgggaaacgtaccgtacccggtacccgtaaccggtaaccgtaaaacggttacggttaactttaccgttaaaacgggtttacggttttaaccggg

SEQ ID NO: 325529 - DNA, 617 bp, Homo sapiens
  misc_feature: GZ8MTXP02HEU36.25.51.E07.1.454.CMB.2.raw
  modified_base (413)..(413): a, c, t, g, unknown or other
  misc_feature (413)..(413): n is a, c, g, or t
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggtctttttcttgtggctcttttaaaaggtgtccactgtgacgtgcagctattggagtcgtgggggagcttggtgcgaggccgggaggtccctgagactctcctgtacagcgtctggtattgccttggcagccatcgcccgtgggcctgggtcccgccgagggtccgaggggacggccgtgggagttggggtctacgaaagtcgtgactccgtggcggtagtcgcacactcgtcgcgtactcgtgtcgaacggcccctnttcactaatactaccagacgactaacttaccgaaggtaccttacccgtttttagactaaatacgaactaacctagacgacgacggacggacgaccggtcctactacgtttatcggtcgacgagacgtagaacggaacgtaccgtcccgacgtcggtaacaacgttacggtttaacgtttacgtaaacggtttacggttttacgg

SEQ ID NO: 325530 - DNA, 769 bp, Homo sapiens
  misc_feature: GZ8MTXP02JGLJS.25.51.E07.1.454.CMB.2.raw
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggtctttttcttgtggcttacttttaaaaggtgtccactgtgacgtgcagctattggagtcgtgggggagcttggtgcgaggccgggaggtccctgacgactctcctgtacagcgtctggtatttgcctttggcagccagtcgcccgtgggctcgggtccgccgagggtccgaggggacggccgtgggaggtgggtctacaaagtgtacgaccgtccgtgggtaccggttagtcgtaccgacaccgttcgtaccggccggtacttcgtggtacggaacggtccccgtacttaccgaactaaactactaccgaagaacgtaactaacgttacccgaaacggtaacctttacccgttttttagaacctaaaacttacggtaaaacctaacccgtagaacggaacgaaccgggaacggaaccgtaacccgggtacccttaacgttaacgtttacgttacggttacggacggtaaacggtaaccggtaaggaaacgggtaaccggtaacccgtccccggtaacccggttaaccggggttaaaccccgtaaaaaggtttacgggtttaaacgttttaaaccggtttaaaaccgggtttacggggttttttaaacccgggg

SEQ ID NO: 325531 - DNA, 694 bp, Homo sapiens
  misc_feature: GZ8MTXP02JKG3G.25.51.E07.1.454.CMB.2.raw
  modified_base (272)..(272): a, c, t, g, unknown or other
  misc_feature (272)..(272): n is a, c, g, or t
tcagactgtacagtcacgaccggtgctcgatttagcatactctacaacacacaaaggggtctgagagaggagcccagccctgggattttcaggttgttttcatttggtgatcagggctgaacagagagaactcaccatggagtttgggctgaactggtcttttttcttgtggtcttacttttaaaaggtgtccactgtgacgtgcagctattggagtcgtgggggagcgttggtgcgaggccggggaggtccctgacgtactctcctgtacngcgtctggtatttgcctttggcagccatcgccccgtgggccgtgggtacccgcgacggggtccgaggggacggccgtgggacggttgggtactacgaaagtgtacgaccgtccgtagggtccggttagtcgtaccacgtacgttcgtacggcggtacttcgtaggtacgaaccggtcccgtacttaccaactaactacgtacccgaggaacgtaactaacgttacccgtaaacggtaccctttaacccgttttttcgaacctaaagttacgaaactaacgtacgagacgacgacgacacgcctctatactgtcgacgagtacgtaggaacggtacgtaccgtacccgaccgttaacgggtaacccttaaaggttacggtttaacgtttaacggtttaaaaccggtttaggtttttaacccgg

SEQ ID NO: 325532 - DNA, 662 bp, Homo sapiens
  misc_feature: GZ8MTXP02JC310.25.51.E07.1.454.CMB.2.raw
  modified_base (260)..(260): a, c, t, g, unknown or other
  misc_feature (260)..(260): n is a, c, g, or t
  modified_base (310)..(310): a, c, t, g, unknown or other
  misc_feature (310)..(310): n is a, c, g, or t
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggctttttctgtggctcttttaaaaggtgtccactgtgacgtgcagctattggagtctgggggagcttggtgcaggccgggagggtccctgagactctcctgtacngcgtctggtatttcgcctttggcagcccatcgcccgtgggctgggtcccncgagggtccaggggacggcctggagtgggtctacgaaatgtgacctccgtggtcggtagtgtcactaccttcgtaccgggcgtactcgtgtacgaacgggcccccgtacttacaacctaaatactaccgaagaacgaactaacttaccgaaacgggtaccctttacccgtttttagaactaaacttacgaaacctaaccgtaggtaagaacgaacggacggacgaccggtaccctacttattacgttgtacgacgtaggtacctaggaacggaacgtaccgtcccggtaccgtaacgggtactaaacggttacggttaactttaccggtaaacggtttacgggttttaaccg

SEQ ID NO: 325533 - DNA, 705 bp, Homo sapiens
  misc_feature: GZ8MTXP02GHNUP.25.51.E07.1.454.CMB.2.raw
  modified_base (264)..(264): a, c, t, g, unknown or other
  misc_feature (264)..(264): n is a, c, g, or t
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggtctttttcttgtggcttcttttaaaaggtgtccactgtgacgtgcagctattggagtcgtgggggagcttggtgcaggccgggagggtccctgagactctcctgtacngcgtctggtattgcctttggcagccatcgccccgtgggctggggtcccgccgaggggtcccgaggggaacggccgtggggaggtcggggtactacgtaaagtgtacgaccgtccgtggggtccggtagtcgtacacacctcgtacggcggtactcgtgcggaacggccccgtacttaccaactaaactactaccgaagaacgtaactaacttacccgaaacgggttaaccctttacccgttttttacgaaccttaaaacgtacggtaaaaccctaaccgtaggaacggtaacggaacggaacggaaccgacccggtaccctattaactttaagttcgtacggaccggagtaccgtaggaacggaacgaccgtcccgtaccgtaacgggtaccctaaagttacggtttactttaacgttaaaacggtttacggttttaacgg

SEQ ID NO: 325534 - DNA, 632 bp, Homo sapiens
  misc_feature: GZ8MTXP02FMNJ0.25.51.E07.1.454.CMB.2.raw
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggctttttcttgtggctcttttaaaaggtgtccactgtgacgtgcagctattggagtcgtgggggaggcttggtgcaggccgggagggtccctgagactctcctgtacagcgtctggatttcgcctttggcagccatcgcccctgggcgtgggtccgccgaggggtcccaggggacggggcccgtggggaggtggggtcctacgtaaagtgtgacctccgtggcggtagtgtcacactctaccgcggtactcgtgtgaacggcccgtcttcaactaactactaccaagaacgaacaacttaccaaacggtaccttacccctttttacgactaaatacgaaacctaaccgtagaagagaaccggagaccgaccggtaccctctagttagttgtcgacgagacgtaggaaggaacgaccgtccgccttaacggtaaccgtaaagttacggtactttacgtaaacggttacggttttaacg

SEQ ID NO: 325535 - DNA, 650 bp, Homo sapiens
  misc_feature: GZ8MTXP02I0R6Z.25.51.E07.1.454.CMB.2.raw
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggtctttttctgtggctacttttaaaaggtgtccactgtgacgtgcagctattggagtcgtgggggagcttggtgcaggccgggaggtccctgagactctcctgtacagcgtcgtggtatttgcctttggctagccagtcgccccgtaggggcctggggtcccgccgagggtcccgaggggaacggtccgtaggagtggggtctacgaaagtgtcgactccgtggcgtagtgtcactactcgtcggcgtactcgtgtcggaacgcccgtacttaccgaactaaactacgtccgaagaacgaactaacgttaccgtaaacggtacctttacccgtttttagaacctaaactacgaactaactaggagaacgacggacgacacggccttacgtattaacgtcgtcgacgagtacgtaggaacgtaacgaccgtaccgaccgtaacggtaaccgtaaagttcgtaaacgtttacgtaaacggtttacggtttttaccgg

SEQ ID NO: 325536 - DNA, 721 bp, Homo sapiens
  misc_feature: GZ8MTXP02JVOM7.25.51.E07.1.454.CMB.2.raw
  modified_base (269)..(269): a, c, t, g, unknown or other
  misc_feature (269)..(269): n is a, c, g, or t
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggtcttttttcttgtggcttacttttaaaaggtgtccactgtgacgtgcagctattggagtcgtgggggagtcttgggtgcgaggccgggagggtcccttagactctcctgtacngtcgtctggtatttgccttggcagccatcgcccgtgggctgggtcccgcgagggtccaggggacggccgtgggagttcgggtctacgaaagtggtacgtaccgtccgtggggaccccggttagtcgtaccaacgtaccgtaccgtacgggccggtacttcgtgggtacgaaccgggccccgtctttaccgaactaatactaccgaaggaacgaactaacgttaaccgaacggttaccctttacccttttttacgaactaaaagtacgaaaccgtaaccgtaggaacgacggaacgaacggaaccgaccggtacccgttaccttagtttacgttcgtagtacggtaacgtaccgtaaggtaacgggaacggtaccgtacccggtaccgtacggtaacccgtaaagttacggtttaactttaacgtaaacggtttacggtttacggttaaccgg

SEQ ID NO: 325537 - DNA, 686 bp, Homo sapiens
  misc_feature: GZ8MTXP02F09RX.25.51.E07.1.454.CMB.2.raw
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggctttttcttgtggctcttttaaaaggtgtccactgtgacgtgcagctattggagtcgtgggggagcttggtgcaggccgggagggtccctgagactctcctgtacagcgtctggattgcctttggcagccatcgccctgggctgggtccgccgagggtccaggggacgggcctgggagtgggtctacgaaatgtgaccttccgtgggcggtagtcgtacactaccgttctccggcgggtactcgtgtcggaacgggccccgtacttccgaactaaataactacccgaagaacgaacaacgttaccgaaacggtaccttaccccgttttttagacctaaaagtacgtaaacctaaaccgtagaacgaaggaaaccggacggaaccgaccgggtaccctacgttaacttaagttcggtagtaccggtaagaccgtaggaacggtaacgaaccgtcccggtaccgttaacggtaacccgtaaaacgttacggttaacgttttaacgttaaaaccggtttaggtttttaaccgg

SEQ ID NO: 325538 - DNA, 756 bp, Homo sapiens
  misc_feature: GZ8MTXP02F8QS5.25.51.E07.1.454.CMB.2.raw
  modified_base (263)..(263): a, c, t, g, unknown or other
  misc_feature (263)..(263): n is a, c, g, or t
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggctttttcttgtggctcttttaaaaggtgtccactgtgacgtgcagctattggagtcgtgggggaggcttggtgcaggccgggagggtccctgagactctcctgtacngcgtctggtattgcctttggcagccatcgccccgtggggctggggtcccgccgagggtccgaggggaacgggcctgggagtggggtactacgaaatcggtgtaccgtccgtgggccgggtaagtcgtaccgacacttcgtaccggccgggtaccttcgtggtacgaacgggtcccccgtcttaccgaacctaaatactaccgaacggaacgaaccgtaaatttacccgaaaacgggtaaccctttaaccccgtttttttacgaaccttaaaacttacgaaaaccgtaaacccgttaggaaacggtaacggaaaccgggaacgggaacccgtaccggggtaacccccttacgtttaactttactttacggtaggtacggtacggtaaccgttagggaaacgggtaacgtaacccgtcccggtaccgttaacggtaacccgtaaacgttaggggtttaactttaaccgttaaaacggttacggtttttaaccggg

SEQ ID NO: 325539 - DNA, 707 bp, Homo sapiens
  misc_feature: GZ8MTXP02GY5DD.25.51.E07.1.454.CMB.2.raw
  modified_base (279)..(279): a, c, t, g, unknown or other
  misc_feature (279)..(279): n is a, c, g, or t
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggtctttttcttgtggtcttacttttaaaaggtgtccactgtgacgtgcagctagttggagtcgtgggggagtcgttggtgcgaggccgggagggtccctgagactctctgtacagcgtctggtnttgccttggcagccatcgccgtgggcgtcgggtccgccgacgggtccgaggggacggccgtgggacggtcgggtctacgtaaagtgtacgtaccgttccgtcggggtacggtagtcgtaccactaccgttacgtaccgggccggtacttcggttagtacgggaaccggtccccgtacttaccgaactaaactactaccgaagaacgaactaacgttaccgaaacggtacccttttacccgtttttagaaaccttaaagtaacgtaaacctaaccgtagacggaacgaaaccggaacggacccgtaccggtacccttacttatttagttacgtacgacgagtacggtaggaacggtacgacccgtccgtacgtaacggtaacctaaaggttacgtttacgttaacgttaacggtttacggtttaaccgg

SEQ ID NO: 325540 - DNA, 738 bp, Homo sapiens
  misc_feature: GZ8MTXP02H9I1S.25.51.E07.1.454.CMB.2.raw
  modified_base (258)..(258): a, c, t, g, unknown or other
  misc_feature (258)..(258): n is a, c, g, or t
  modified_base (304)..(304): a, c, t, g, unknown or other
  misc_feature (304)..(304): n is a, c, g, or t
  modified_base (370)..(370): a, c, t, g, unknown or other
  misc_feature (370)..(370): n is a, c, g, or t
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggctttttctgtggctcttttaaaaggtgtccactgtgacgtgcagctattggagtctgggggagcttggtgcagccgggaggtccctgagactctcctgtacngcgtctggattgcctttggcagccatcgcccgtgggcctgggtccnccgagggtccaggggaggcctgggagtgggtctcgaaatgtgactccgtgggacggtagtgtcacnctctaccggcgtaactcgtagtacggaacggtcccctcgttaccaacaacttaactacccgaaggaaacggtaactaaacgtttacccgaaacgggttaaccctttaaaccccgtttttttacggaaaccttaaaacgtttacggaaaaccctaaacccgttaaggtaacggtaaacggtaaccggaacgggtaacccgaaccggggtacccccttacgttaactttaaccgtttaggttcggtaccggaaggtaaaccggttagggaaacggggtaacgaaacccggttcccgtacccgtaacggtacccgtaaaaggtttacggttaacgtttaaccgttaaaacggttaacggtttttaaccggg

SEQ ID NO: 325541 - DNA, 601 bp, Homo sapiens
  misc_feature: GZ8MTXP02G1289.25.51.E07.1.454.CMB.2.raw
  modified_base (300)..(300): a, c, t, g, unknown or other
  misc_feature (300)..(300): n is a, c, g, or t
  modified_base (446)..(446): a, c, t, g, unknown or other
  misc_feature (446)..(446): n is a, c, g, or t
  modified_base (460)..(460): a, c, t, g, unknown or other
  misc_feature (460)..(460): n is a, c, g, or t
  modified_base (479)..(479): a, c, t, g, unknown or other
  misc_feature (479)..(479): n is a, c, g, or t
  modified_base (481)..(481): a, c, t, g, unknown or other
  misc_feature (481)..(481): n is a, c, g, or t
  modified_base (487)..(487): a, c, t, g, unknown or other
  misc_feature (487)..(487): n is a, c, g, or t
  modified_base (521)..(521): a, c, t, g, unknown or other
  misc_feature (521)..(521): n is a, c, g, or t
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggtctttttctgtggcttacttttaaaaggtgtccactgtgacgtgcagctattggagtcgtgggggagcttggtgcgaggccgggagggtccctggagacctctcctgtacagtcgtctggtattcggtccgttggcacggaccngtcggccccgtgggcgtcgggtccccgaccgtaggggaccgaaggggacggccgtgggtaggtcgggtctaacgtaaagtggtacgaccgttccgtggggacgtagtcgtacacgtactcgtacgcgtactcgtgtacgacgcctntacatatcacaganacatacagtaccttctttnanaactanaacctatagagagacgagaccgacgcctatactntgtacgcgtagactaggacgacgcctcgacgtaacggtactaaggtacgttaacttaacgtaacggtttacgtttaccgg

SEQ ID NO: 325542 - DNA, 636 bp, Homo sapiens
  misc_feature: GZ8MTXP02FRKGI.25.51.E07.1.454.CMB.2.raw
  modified_base (357)..(357): a, c, t, g, unknown or other
  misc_feature (357)..(357): n is a, c, g, or t
  modified_base (415)..(415): a, c, t, g, unknown or other
  misc_feature (415)..(415): n is a, c, g, or t
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggtctttttcttgtggcttacttttaaaaggtgtccactgtgacgtgcagctattggagtcgtgggggaggcttggtgcgaggccggggagggtccctgagactctcctgtacagcgtctggtattgcctttggcagcccatcgcccgtgggctgggtcccgcgagggtccaggggacggctgggagtgggtctacaaagtgngacgtcctgggcgtagtgtcactacttcgtacgcggtactcgtgtgaacggtccccgnttaccgaactaaactatacccaagaacgaacaacttaccgaaacggtacctttaaccctttttgaacctaaaatcgaaaccaacctagaagacgaacggaacgaccgaccggtaccctcttaatttacgtgtagacgagacgtaggaacgaacgtaccgccgtaccgtaacggtaccctaaagttccggttatttaacgtaaacggttaggttttaaccgg

SEQ ID NO: 325543 - DNA, 696 bp, Homo sapiens
  misc_feature: GZ8MTXP02IAB2W.25.51.E07.1.454.CMB.2.raw
tcagactgtacagtcacgaccggtgctcgatttagcatactctacaacacacaaaggggtctgagagaggagcccagccctgggattttcaggttgttttcatttggtgatcagggctgaacagagagaactcaccatggagtttgggctgaactggtctttttcttgtggtcttacgtttttaaaaggtgtccactgtgacgtgcagctagttggagtcgtgggggaggtcttggtgcgaggccggggagggtccctggacgactctcctgtacaggtcgtctggtatttcgccgtttggcacgccctagtcggccccgtggggtccgtcggggtccccggccggtacggggtacccgaagggggaacggtccgtaggggaggttggggtactacgaaaagtggtcgacgttccggtgggacggtagttcgacactaccgttcgaccggtcggaactcgttaggtacgaaccgggccccctacttacaaacaaattactaccgaagaacgaactaaacttaccgaaacggtaacctttacctttttacgaacctaaaatacgaaactaacctagaacgagacgaacggacaccgtcctactagttagtgtcgacgagacgtaggaaggacgaccgtaccgtacgtaacggtaaccaaacgttagttaactttaaccgtaaagtttacggtttacg

SEQ ID NO: 325544 - DNA, 708 bp, Homo sapiens
  misc_feature: GZ8MTXP02GTGMM.25.51.E07.1.454.CMB.2.raw
  modified_base (264)..(264): a, c, t, g, unknown or other
  misc_feature (264)..(264): n is a, c, g, or t
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggtctttttcttgtggctcttttaaaaggtgtccactgtgacgtgcagctattggagtcgtgggggagcttggtgcaggccgggagggtccctgagacctctcctgtacngctcgtggtattgccgttgcagccatcgcccgtgggcgtcgggtcccgccggacgggtccgaggggaacggtccgtaggggcggttcggggtctacgtaaagtggtacgaccttccggtggggtcggttagtcgtaccaacctccgtcgtaccgggcgtactcgtggtacggaaccggtcccgtacttaccgtaactaactactaccgaaggaacgaactaacgttaccgaaacgttacctttaccctttttgaaactaaactacgaaacctaactaggaacgaacggaaccgaacgaccgaccggtaccctacttaagttacgttcggtacgaccgtaggtaccgtagggaaacggtaacgacccgtcccggtacgttaaccgtaaccgtaaaaggtttacggttaacgtttaaacgtaaaaccgggtttagttttaacccgg

SEQ ID NO: 325545 - DNA, 698 bp, Homo sapiens
  misc_feature: GZ8MTXP02GCVSK.25.51.E07.1.454.CMB.2.raw
  modified_base (268)..(268): a, c, t, g, unknown or other
  misc_feature (268)..(268): n is a, c, g, or t
  modified_base (315)..(315): a, c, t, g, unknown or other
  misc_feature (315)..(315): n is a, c, g, or t
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggtctttttcttgtggcttacttttaaaaggtgtccactgtgacgtgcagctattggagtcgtgggggagtcgttggtgcaggccggggagggtccctgagactctcctgtacngcgtctggatttgccttggcagccatcgcccgtgggctggggtcccncgagggtccaggggacggcctgggaggtgggtctacgaaagtgtcgaccgtcgtggggtcggtagtgtaccacgtaccgttcgtaccggcgtactcgtgtacggaaccggtccccgtacttacaactaactactaccgaagaacgtaaccaaacgttaccgaaacggttaccctttaacccgtttttacgaaacctaaaacgtacgtaaaacctaaccgtaggaacggaacggaaaccggacggaacccgtaccgggtacccttacgttaagtttaacgttggtacgacgacgtacgtaggaaacgtaacgtaccgtccgtaccgtaacggtaacctaaaagtcgtttaacgtttaacgttaaacggtttacggttttaacgg

SEQ ID NO: 325546 - DNA, 793 bp, Homo sapiens
  misc_feature: GZ8MTXP02FRU7S.25.51.E07.1.454.CMB.2.raw
  modified_base (312)..(312): a, c, t, g, unknown or other
  misc_feature (312)..(312): n is a, c, g, or t
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggtctttttcttgtggctacttttaaaaggtgtccactgtgacgtgcagctattggagtcgtgggggagcttggtgcaggccgggagggtccctgagactctcctgtacagcgtctggtattgccttggcagcccatcgccgtgggcgtcgggtcccncggagggtccgaggggacggccgtgggaggtgggtcctagtaaagtggtacgaccgttccgtggggtaccgttagtcggttaccaaccgtaccgttacgtacccgggccgggtaaccttcgttacggtacgggtaaaccgggcccccgtactttaccaacctaaacttacgtaacccgaaggtaaccgaaactaaaccgttacccgtaaaacgggttaccctttaacccgtttttttacgaaaccgttaaaacgttacggtaaaaccctaaaccgttacgggaaaacgggtaaacggtaaacccgggaacggaaccggtaaccccgggtaccccgttacctttaaagttttaacgttcggtacggtaaccggagtaccgtaaggaaacgggaacgtaaccgtcccggtaccgtaacggtaacccgtaaaagtttcggttaacgtttaaaccggtaaaacggtttacgggtttttaaaccgg

SEQ ID NO: 325547 - DNA, 616 bp, Homo sapiens
  misc_feature: GZ8MTXP02JBRHB.25.51.E07.1.454.CMB.2.raw
  modified_base (265)..(265): a, c, t, g, unknown or other
  misc_feature (265)..(265): n is a, c, g, or t
  modified_base (311)..(311): a, c, t, g, unknown or other
  misc_feature (311)..(311): n is a, c, g, or t
  modified_base (443)..(443): a, c, t, g, unknown or other
  misc_feature (443)..(443): n is a, c, g, or t
  modified_base (481)..(481): a, c, t, g, unknown or other
  misc_feature (481)..(481): n is a, c, g, or t
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggtcttttttcttgtggcttcttttaaaaggtgtccactgtgacgtgcagctattggagtcgtgggggaggcttggtgcaggccgggagggtccctgagctctcctgtacngcgtctggtattgcctttggcagccatcgccgtgggctgggtcccncgacgggtccgaggggaacggccgtgggagtcggggtctacgtaaagtgtacgtactccgtggggtcggtagtcgtacactactcgtaccggcgtactcgtgtacgaacggcccgtacttacactaattacnccaagagtacaacttacgaacgtaccttacctttttanactaaatacgaacactagagacgaacgacgacgaccggcctatattagtgtcgacgagacgtaggaacgacgtaccgccgtaccgtaacgtaccgtaaagttacggttactttacgtaaacgtttacggtttacg

SEQ ID NO: 325548 - DNA, 695 bp, Homo sapiens
  misc_feature: GZ8MTXP02JGHZP.25.51.E07.1.454.CMB.2.raw
  modified_base (267)..(267): a, c, t, g, unknown or other
  misc_feature (267)..(267): n is a, c, g, or t
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggtctttttcttgtggcttcttttaaaaggtgtccactgtgacgtgcagctattggagtcgtgggggaggcttggtgcgaggccggggagggtccctgagactctcctgtacngcgtctggtatttcgccttggcagccatcgcccgtgggctgggtccgcgacgggtccgaggggaacggccgtgggacggttgggtctacgtaaagtgtcgaccgtcgtcggggtcggtagtcgtaccactaccgttcgtaccggcggtacttcgtagtacggaaccgggtcccctcttaccactaaactacgtacgaacgaacgtaaactaacgttacccgtaaacggttaccctttacccgtttttacgaaactaaacgttaacgaaaacccgtaaccgtagaaacggaacgaccggaacggaccgaccggtccttactaacgttagttcgtagacgagaccgtaggaaacggtacgacccgtccgaccgtaacggtaaccgtaaagttacggttaactttaacgtaaacggtttacgtttaaccgg

SEQ ID NO: 325549 - DNA, 752 bp, Homo sapiens
  misc_feature: GZ8MTXP02G1JEX.25.51.E07.1.454.CMB.2.raw
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggctttttctgtggcttcttttaaaaggtgtccactgtgacgtgcagctattggagtcgtgggggagcttggtgcaggccgggaggtccctgagactctcctgtacagcgtctggatttgccgtttggcagccatcgcccgtgggcgtgggtcccgccgacgggtccgaggggaacgggccgtgggacggtcggggtctaccgaaaagtggtagaccgttccgtcggggccggttagtcggtcaacgtacgttctacggccgggtaactcgtgtcggaacggccccgtcttacgactaactacgtaccgagaacgaacgtaaacttaccgtaaacgggtaaccttacccgtttttttaggaacctaaaacgttacggaaaacctaaacccgttagtaacgggaaaggaaaccgggaacggaaccgtaaccgggtaccccgttaaccttaaagtttacgttacgtacggtacgggaacggtaaccggttacggaacggtaaacgaacccggttacccgtacccgttaacggttaaccgttaaaacggttacggttaacgttttaaccgttaaaacgggtttaacggggtttttaaccgg

SEQ ID NO: 325550 - DNA, 650 bp, Homo sapiens
  misc_feature: GZ8MTXP02H5872.25.51.E07.1.454.CMB.2.raw
  modified_base (269)..(269): a, c, t, g, unknown or other
  misc_feature (269)..(269): n is a, c, g, or t
  modified_base (279)..(279): a, c, t, g, unknown or other
  misc_feature (279)..(279): n is a, c, g, or t
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggtctttttcttgtggtctcttttaaaaggtgtccactgtgacgtgcagctagttggagtcgtggggggagcgttggtgcgaggccggggagggtccctgagactctcctgtacngcgtctggtntttgcctttggcagccatcgcccgtgggcgtgggtcccgcgagggtccgaggggacggccgtgggaggtcgggtctacgaaagtggtacgaccgtccgtgggcggttagtcgtacactactctacggccgtactcgtgtacggaaccggcccgtcttaccacaactactacccgagacgaactaacgtaccgtaaacggtaccctttaccgtttttagaactaaactacgtaaacctaaccgtagagagacgaggaccgaccggtcctactagttagttcgtagcggtacgacgtaggaacggtacgaccgtccgacgtaacggtacctaaacgttcgttaacgtttacgttaacggtttacggtttacgg

SEQ ID NO: 325551 - DNA, 693 bp, Homo sapiens
  misc_feature: GZ8MTXP02IUTIU.25.51.E07.1.454.CMB.2.raw
  modified_base (275)..(275): a, c, t, g, unknown or other
  misc_feature (275)..(275): n is a, c, g, or t
  modified_base (372)..(372): a, c, t, g, unknown or other
  misc_feature (372)..(372): n is a, c, g, or t
  modified_base (523)..(523): a, c, t, g, unknown or other
  misc_feature (523)..(523): n is a, c, g, or t
tcagactgtacagtcacgaccggtgctcgatttagcatactctacaacacacaaaggggtctgagagaggagcccagccctgggattttcaggttgtttttcattttggtgatcagggctgaacagagagaactcaccatggagtttgggctgaactggtcttttttcttgtggtcttacgtttttaaaaggtgtccactgtgacgtgcagctattggagtcgtgggggagtcgttggtgcgaggccgggaggtccctgacgactctcctgtacngcgtcgtggtatttcgccgtttggcagccagtcgccccgtgggccgtgggtcccgccgacgggtccgaaggggacggtccgtggaggtgggtactanaaagtgtagcctcgtggcgtagtcgtcacgtaccttcgtcggcgtaccttcgtcggtacggaaccggtccccgtcgttaccaaactaaacttactacccgtaagaacgaaactaacgttaaccgtaacggtaaccctttacccgtttttanactaaacgtacgaaacctaacgtagaagaacgaacgacggaccacgtaccgtcttaagtttacgtgtacgccgaagtacgtaaggacggtaaacgacccgttccgaccgttaacggtaaccgtaaacgttacggttaaacgtttacgttaaacggtttacggtttaaccg

SEQ ID NO: 325552 - DNA, 689 bp, Homo sapiens
  misc_feature: GZ8MTXP02I4MAK.25.51.E07.1.454.CMB.2.raw
  modified_base (267)..(267): a, c, t, g, unknown or other
  misc_feature (267)..(267): n is a, c, g, or t
  modified_base (313)..(313): a, c, t, g, unknown or other
  misc_feature (313)..(313): n is a, c, g, or t
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggtctttttcttgtggcttacgttttaaaaggtgtccactgtgacgtgcagctattggagtctgggggagtcttggtgcgaggccgggagggtccctgagactctcctgtacngcgtctggtatttgccttggcagccatcgcccgtgggctgggtccncggagggtccgaggggaacggccgtgggaggtgggtctacgaaagtgtacgactccgtgggcgtagtcgtacacacgtctacggcggactcgtgtcgaacggccccgtattacaacctaaactacgtaccagaacgaactaacttaacccgaaacggtaccttaccgtttttacgaaactaaacgttacgtaaacctaaacgttacggaacgaacgaacggaacggaaaccgaccggtacccttacgttacttacgttaggtcgtacggaacgtaccgtaggaaacggtaacgtacccgttacccgtaccgttaacggtaacccgtaaaagttacggttaaacgtttacgttaaaacggttacggtttttaaccgg

SEQ ID NO: 325553 - DNA, 560 bp, Homo sapiens
  misc_feature: GZ8MTXP02IV9KE.25.51.E07.1.454.CMB.2.raw
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggctttttctgtggctcttttaaaaggtgtccactgtgacgtgcagctattggagtctgggggagcttggtgcaggccgggaggtccctgagactctcctgtacagcgtctggattgcctttggcagccatcgccctgggctgggtccgcgagggtccaggggaggcctgggagtggggtctacaaatgtgactccgtggcggtagtgtcacactctacggcggtactctgtgaacggcccgacttcacaatactaccagagacaacttaccaaggtacctaccctttttgaacaaattagaacaactgagagacgaggacgacggcctctactattgtgtcgagacgtagaggacgactccgtcgtggtacctaatacggttatttacgtaacgttagtttacgg

SEQ ID NO: 325554 - DNA, 590 bp, Homo sapiens
  misc_feature: GZ8MTXP02I3PRB.25.51.E07.1.454.CMB.2.raw
  modified_base (308)..(308): a, c, t, g, unknown or other
  misc_feature (308)..(308): n is a, c, g, or t
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggtctttttcttgtggctcttttaaaaggtgtccactgtgacgtgcagctattggagtcgtgggggagcttggtgcaggccgggaggtccctgagactctcctgtacagcgtctggtatttgcctttggcagccatcgccctgggctgggtccncgaggtccgaggggacggcctggagtgggtctcaaagtgtgacctcgtgggcggtagtgtcacacttcacggccgactcgtgtgaacggcccctcttacactaatactccaagagaacaacttaccaaggtacctacccgtttttgactaaatacgaacactacgagacgacgagacacggacctcgtattattcgtgcgagacgtaggacggaacgaccgtccgaccgtaacggtacctaaacgttcggttaactttacgtaaacggttacggtttttacg

SEQ ID NO: 325555 - DNA, 713 bp, Homo sapiens
  misc_feature: GZ8MTXP02I72IV.25.51.E07.1.454.CMB.2.raw
  modified_base (406)..(406): a, c, t, g, unknown or other
  misc_feature (406)..(406): n is a, c, g, or t
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggtctttttcttgtggcttcttttaaaaggtgtccactgtgacgtgcagctattggagtcggtgggggagtcgttggtcgcgagggcccggggtagggtcccctggacgtacctcctccgtgtacagcgttcgtggtatttcgccgttggcacgcctagtccgccggtggccgtcgggtcccgcggacggtcggaggggacggccgtgggtacggtcgggtacctaacgtaaagtcgtacgaccgttccggngggtacggttagtcgtaccacgtacctcgtccgggcgtactcgtgtacggaccgcccgtataccacaactactacgaagaacgaactaaccttaccgaacgttaccctttaccgtttttacaaacctaaattacgaaaccgttaaccaggaacgaaacgacggaaccggaccgtacccggtacccttacttaagtttacgtggtacgacgtaagaaccgtaggtaacggaccgtaaaccgtcccggaccgtaacggtacctaaaggttacgttaacgtttaaccgttaaggtttacggtttaaccgg

SEQ ID NO: 325556 - DNA, 639 bp, Homo sapiens
  misc_feature: GZ8MTXP02HJWEO.25.51.E07.1.454.CMB.2.raw
  modified_base (308)..(308): a, c, t, g, unknown or other
  misc_feature (308)..(308): n is a, c, g, or t
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggctttttcttgtggcttcttttaaaaggtgtccactgtgacgtgcagctattggagtcgtgggggagcttggtgcgaggccgggagggtccctgagactctcctgtacagcgtctggattgcctttggcagccatcgccctgggctgggtccncgacgggtccgaggggaaggccgtgggagtcggggtctacgaaagtggtagaccgtccgtggggacggtagtcgtacacgactcgtaccggcgggtactcgtgtacgaacggcccgtctacacaaatactacgagacgaactaactaccgaacggtaccttaccctttttagactaaatacgaactaaccgtagaacgacgacgacgaccgaccggtacctacgttattacgttcgtcgacgtagacgtaggaacggacgaaccgtccgaccgtaacgtaaccgtaaagttacggttaacgtttacgtaaaacggtttacggttttaacgg

SEQ ID NO: 325557 - DNA, 684 bp, Homo sapiens
  misc_feature: GZ8MTXP02HHFYM.25.51.E07.1.454.CMB.2.raw
  modified_base (266)..(266): a, c, t, g, unknown or other
  misc_feature (266)..(266): n is a, c, g, or t
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggtcttttttcttgtggtcttacttttaaaaggtgtccactgtgacgtgcagctattggagtcgtgggggagtcttggtgcaggccgggaggtcccttagctctcctgtacngcgtctggtatttgcctttggcagccatcgccccgtgggctcgggtcccgcgaggggtcccgaggggacggcctggaggtgggtactacgaaatgtcgacgtccgtgggcccggttagtcgtacacgtacgttcgacggccgggtactcggtggtacgaacggtccccgtactttaccgaacaacgttacgtacccaaggaacgaactaaacgttacccgaaacggttaccctttacccgttttttacgaacttaaacgtacgtaaaccgaaccgtagaagacggaacgacggaccacggtccctattacttagttgtcgacgtacgacgtagaacggtaacgtaccgtccgaccgttacggtaacctaaacgttacggttaactttaacgttaaacggttacgtttacggtacccgg

SEQ ID NO: 325558 - DNA, 703 bp, Homo sapiens
  misc_feature: GZ8MTXP02JAURT.25.51.E07.1.454.CMB.2.raw
  modified_base (440)..(440): a, c, t, g, unknown or other
  misc_feature (440)..(440): n is a, c, g, or t
  modified_base (500)..(500): a, c, t, g, unknown or other
  misc_feature (500)..(500): n is a, c, g, or t
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggtctttttcttgtggcttacttttaaaaggtgtccactgtgacgtgcagctattggagtcgtgggggagtcgttggtgcgaggccggggtagggtccctagacgactctcctgtacagcgtctggtattgcctttggcacgccagtcgcccgtgggccgttcggggtcccgccgtagggtaccgaggggaacggccgtggaggtgggtctagaaagtgtacgacctcgtagggccgtagtcgtcactactcgacggccgtactccgtgtacggaacggccccgtntaccacgaactactaccagaacgaactaacttaccgaacggtacctttacccgtttttanaactaaacgtacgaaacctaccgtaggaacgtaacgaaacggacggaaacccgtaccgtccccgttacgttaactacgttacggtacgtacggtaaacggaccgtaggaacggtaaaccgtaccgtacccgtacgtaaccggtaaccgtaaaacgtttacggttaaccgtttaacgttaaaacggtttacggttttaaaccgg

SEQ ID NO: 325559 - DNA, 592 bp, Homo sapiens
  misc_feature: GZ8MTXP02IRRAC.25.51.E07.1.454.CMB.2.raw
  modified_base (261)..(261): a, c, t, g, unknown or other
  misc_feature (261)..(261): n is a, c, g, or t
  modified_base (270)..(270): a, c, t, g, unknown or other
  misc_feature (270)..(270): n is a, c, g, or t
  modified_base (343)..(343): a, c, t, g, unknown or other
  misc_feature (343)..(343): n is a, c, g, or t
  modified_base (422)..(422): a, c, t, g, unknown or other
  misc_feature (422)..(422): n is a, c, g, or t
  modified_base (427)..(427): a, c, t, g, unknown or other
  misc_feature (427)..(427): n is a, c, g, or t
  modified_base (503)..(503): a, c, t, g, unknown or other
  misc_feature (503)..(503): n is a, c, g, or t
  modified_base (510)..(510): a, c, t, g, unknown or other
  misc_feature (510)..(510): n is a, c, g, or t
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggctttttctgtggctcttttaaaaggtgtccactgtgacgtgcagctattggagtctgggggagcttggtgcaggccggggaggtccctgagtactctcctgtacngctctggtnttgcctttggcagccatcgccccgtggcgtcgggtccgcgagggtccaggggaggcctgggagtcgggtcctnaaagtgtcgtactccgtgggcggtatcggtcacgtccttcacgcggtactctgtacgacgggccctcttacacaatacncaganaactactactaagtaccttaccttttagactaaatcgaaactaccgtgaagacgaacgacgaccgacggtcccttnttaagtnttcggtacgacgtagacgtaggacggtacgacttccgcgtaacgtacaaacgttggtactttaccgtaagttacgttttcgg

SEQ ID NO: 325560 - DNA, 765 bp, Homo sapiens
  misc_feature: GZ8MTXP02FLYT7.25.51.E07.1.454.CMB.2.raw
tcagactgtacagtcacgaccggtgctcgatttagcatactctacaacacacaaaggggtctgagagaggagcccagccctgggattttcaggtgttttcatttggtgatcagggctgaacagagagaactcaccatggagtttgggctgaactggtctttttcttgtggcttacttttaaaaggtgtccactgtgacgtgcagctagtggagtcgtgggggagcgttggtgcgaggccgggaggtccctgagactctcctgtacagcgtcgtggtatttcgccttggcagccagtcgccccgtgggctcgggtcccgccgacgggtccgagggtaggccgtgggagtggggtctacgaaagtgtagaccgtcgtcggtcggtagtgtacacgaccttcgtaccggccgggaacttcgtacggtacggaaccggggtccccctacgtttacccaaactaaaccgtactacccgaaggaacgtaaaccctaacgttaaccccgtaaaaccgggttaaccctttacccccgtttttttacgtaaaccgtaaaacgttacggtaaaaccctaaacccgttaaggtaacggaaacggtaacccggaaacgggaaccgtaacccggtacccgttaccttaagtttaacttcggttaacgtcggaaactacgtagggaaacggtaacgtacccgtacccggtccgtaaccggttaccctaaaaggttacggtttactttaaaccggtaaaccgtttagggttttaacccgg

SEQ ID NO: 325561 - DNA, 802 bp, Homo sapiens
  misc_feature: GZ8MTXP02IMHS9.25.51.E07.1.454.CMB.2.raw
  modified_base (293)..(293): a, c, t, g, unknown or other
  misc_feature (293)..(293): n is a, c, g, or t
tcagactgtacagtcacgaccggtgctcgatttagcatactctacaacacacaaaaggggtctgagagaggagcccagccctgggattttcaggtgttttcatttggtgatcagggctgaacagagagaactcaccatggagtttgggctgaactggtcttttttcttgtggtctcttttaaaaggtgtccactgtgacgtgcagctattggagtcgtggggaggcttggtgcgaggccgggagggtccctgagacctctcctgtacagcgtctggatttgccttgcagccancgcccgtgggctgggccgaccgaaggtccgaaggggaggccgtgggaggttcgggtctacaaagtgtcgactccgtcggtacggtagtcgtactacgtaccttcgtaccggcgtaaccttccgtgtacggaaccggcccccgttacttaccaactaaacgttaactaccgaaacggtaacgaaaacctaaacgttaacccgtaaaacggttaaccctttaaaccccgtttttttacggtaaaccttaaaacgttaaccgtaaaaccgtaaaccccgttaggaaacggaacggtaaacccgggaagggaaacccgtaacccgggtacccccgttacgttaaagtttaacgttggttacggtacggtaacggtaaccgttaaagggaaacggggtaaacgtaaacccggttacccgtaccccgttaacgggttaaaccccgttaaaaggtttaccggtttaaacggttttaaacccgttaaaaacgggtttaacggggtttttaaaccggg

SEQ ID NO: 325562 - DNA, 605 bp, Homo sapiens
  misc_feature: GZ8MTXP01DPNCL.22.38.D05.1.454.CMB.2.raw
  modified_base (368)..(368): a, c, t, g, unknown or other
  misc_feature (368)..(368): n is a, c, g, or t
  modified_base (415)..(415): a, c, t, g, unknown or other
  misc_feature (415)..(415): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggtgcacttatttattgggatgacggttaccgctacagcccatctctgaggaggagactcacatccaccaagacaccccaaaacaagngtctacaatgacaccatggaccctgtgacacagccacatattctgtncacactctataggagcaacctggtagtctgaccaaaactgggttaccgaccccgttgggggcccccgggtaaaccccgttcggggttacccaacccggttccttccccttaccaccggcccccttcccgaaccccgaaaacgggggtcccccaacgttcccggggttccctttcccccccgttcccgggg

SEQ ID NO: 325563 - DNA, 613 bp, Homo sapiens
  misc_feature: GZ8MTXP01BMQWR.22.38.D05.1.454.CMB.2.raw
  modified_base (398)..(398): a, c, t, g, unknown or other
  misc_feature (398)..(398): n is a, c, g, or t
  modified_base (416)..(416): a, c, t, g, unknown or other
  misc_feature (416)..(416): n is a, c, g, or t
  modified_base (419)..(419): a, c, t, g, unknown or other
  misc_feature (419)..(419): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctggttctcactcaactctagtggagtgggtgtgggctggttccgtcagcccccaggaaaggccctggaatgggtgcacttattatggatgacggttacgctacagtcatctctgaggaggagactcacatccaccaaggaaccaaccccaaaacaaggtacgtcctacaatgaccaccatcggaccctgngacacagccacatattcngtncacactctaagtaggaacgcaaccgtgggtaatcgttacgaccctaaaaccgtcgggttacccgaaccccgttcgggggaacccccggggaaacccttcggggtcccaccgggtccctcccgttcgacgccccgttcccgaaccccgaaacggggccccctagttcccggggttccctttcccccccgtccggg

SEQ ID NO: 325564 - DNA, 561 bp, Homo sapiens
  misc_feature: GZ8MTXP01EM1R7.22.38.D05.1.454.CMB.2.raw
  modified_base (387)..(387): a, c, t, g, unknown or other
  misc_feature (387)..(387): n is a, c, g, or t
  modified_base (517)..(517): a, c, t, g, unknown or other
  misc_feature (517)..(517): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggtgcacttatttattgggatgacggttacgctacagtccatctctgaggaggagactcaccatccaccaagacaaccccaaaacaagtgtctacaatgaccaccancggaccctgtgacacagccacattatttctgtgcacactctagtaggagcacctggtagtctgaccaaacgtcggttaccgaccccgtgggggccccgggaacccttgggtccaccggtctacccgttcncgccctccgaccaacgggcccagttccggtcctttcccccgcgg

SEQ ID NO: 325565 - DNA, 562 bp, Homo sapiens
  misc_feature: GZ8MTXP01B62I3.22.38.D05.1.454.CMB.2.raw
  modified_base (370)..(370): a, c, t, g, unknown or other
  misc_feature (370)..(370): n is a, c, g, or t
  modified_base (396)..(396): a, c, t, g, unknown or other
  misc_feature (396)..(396): n is a, c, g, or t
  modified_base (401)..(401): a, c, t, g, unknown or other
  misc_feature (401)..(401): n is a, c, g, or t
  modified_base (412)..(412): a, c, t, g, unknown or other
  misc_feature (412)..(412): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggttgctacttattatggatgacggttacgctacagtccatctctgaggagagactcacatccaccaagacaccccaaaacagtgtctanaatgacacatggaccctgtgacacancccanatatttctgcncacactactagtagtagacacgtagtagtcgtacgtacctaacgtcggtaccggtcccggtccggggaacccgggtacccgttcggtccgccgtcctccttccgccgcctcccaccgaaccggccgaccgttccgtcccgttcccgtccg

SEQ ID NO: 325566 - DNA, 537 bp, Homo sapiens
  misc_feature: GZ8MTXP01DVUQD.22.38.D05.1.454.CMB.2.raw
  modified_base (414)..(414): a, c, t, g, unknown or other
  misc_feature (414)..(414): n is a, c, g, or t
  modified_base (417)..(417): a, c, t, g, unknown or other
  misc_feature (417)..(417): n is a, c, g, or t
  modified_base (501)..(501): a, c, t, g, unknown or other
  misc_feature (501)..(501): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggtgcacttattattgggatgacggttaccgctacagtccatctctgaggaggagactcacatccaccaaggacaccccaaaaccagtgtcttacaatgaccacatggaccctgtgacacagccacatatttcngtncacactctagtaggagcacctggtagtctgaccaaactggttcgaccccgtggggcccggaaccttgggtccacgtctccttcncgcctcacaagggcccattccggtcttccccgtcgg

SEQ ID NO: 325567 - DNA, 603 bp, Homo sapiens
  misc_feature: GZ8MTXP01EGTYY.22.38.D05.1.454.CMB.2.raw
  modified_base (473)..(473): a, c, t, g, unknown or other
  misc_feature (473)..(473): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgccccaggaaaggccctggaatgggtgcacttatttattgggatgacggttaccgctacagtccatctctgaggaggagactcaccatcccaccaaacggaaccaaacccccaaaaaccgaacgggtacggtccttaacaaactacgaccaccactcgggaccctggtcggacacacgccaactaattatttctagtgcactactctaagtaggancaccgtggtacgtctcgaccaaacgtgggttaccgaccccgtgggggccccggtaaccgttgggtccaccgtctcccttcgcgttccctcccgaccgaacgggcccacgttccggtcccttccccgtcgg

SEQ ID NO: 325568 - DNA, 568 bp, Homo sapiens
  misc_feature: GZ8MTXP01EMG2X.22.38.D05.1.454.CMB.2.raw
  modified_base (419)..(419): a, c, t, g, unknown or other
  misc_feature (419)..(419): n is a, c, g, or t
  modified_base (422)..(422): a, c, t, g, unknown or other
  misc_feature (422)..(422): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggtgcacttattatggatgacggttaccgctacagtccatctctgaggaggagactcaccatccaccaaggacaaccccaaaacaagtcgtcctacaatgaccacatggaccctgtacgacacacgccacattatttcngtncacactctaagtaggagccaccgtggtacgtctgaccctaaactcgggttaccgaccccgtgggggccccggtaacccttgggtccaccggtctcccttcgacgccctccaccgaagggccccagttcccggtccttccccgcggg

SEQ ID NO: 325569 - DNA, 552 bp, Homo sapiens
  misc_feature: GZ8MTXP01B497V.22.38.D05.1.454.CMB.2.raw
  modified_base (371)..(371): a, c, t, g, unknown or other
  misc_feature (371)..(371): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctggttctcactcaactctagtggagtgggtgtgggctggttccgtcagccccaggaaaggccctggaatgggttgcacttatttattggatgacggttaccgctacagtccatctctgaggaggagactcacatccaccaagacaccccaaaacagtgtctanaatgacacatcgaccctgtgacacagccacattattctgtgcacactctagtaggtagcaccgtggtagtctgaccaaacgtcggttaccgaccccgtggggccccgggaaaccttgggtccaccggtctccttcgcgccctccaccaacgggcccacgttccggtccttcccccgtcggg

SEQ ID NO: 325570 - DNA, 548 bp, Homo sapiens
  misc_feature: GZ8MTXP01CQE2R.22.38.D05.1.454.CMB.2.raw
  modified_base (377)..(377): a, c, t, g, unknown or other
  misc_feature (377)..(377): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagccccaggaaagccctggaatgggtgcacttatttatgggatgacggttacgctacagtccatctctgaggaggagactcaccatcccaccaaggacaaccccaaaaccaaggtgtcctanaatgacacatgaccctgtgacacagccacattatttctgtgcacactctagtaggagcaccgtggtagtctgccaaacgtcggttacgaccccgtggggcccggaaccgttgggtccaccgtctccttcgcgcctccaccaacgggcccagttccggtccttccccgtcgg

SEQ ID NO: 325571 - DNA, 624 bp, Homo sapiens
  misc_feature: GZ8MTXP01D204F.22.38.D05.1.454.CMB.2.raw
  modified_base (445)..(445): a, c, t, g, unknown or other
  misc_feature (445)..(445): n is a, c, g, or t
  modified_base (572)..(572): a, c, t, g, unknown or other
  misc_feature (572)..(572): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagccccaggaaaggccctggaatgggtgcacttattattgggatgacggttaccgctacagtccatctctgaggaggagactcacatccaccaaacggaaccaaacccccaaaaaccaacgggtacggtccttaacaaatacgaaccaccactacgggaccctgtcggacacagccaactaattatttcngtcgacacactctaagtacggagcaccgtggtacgtctggaccctaaaacgttcgggtttacccgaaccccgttcggggggaacccccgggtaaacccgttcggggtaccacccggttctcccttcncgcccctaacccaaccgaacgggccccagttcccggtccttcccccgtcggg

SEQ ID NO: 325572 - DNA, 633 bp, Homo sapiens
  misc_feature: GZ8MTXP01EPO1R.22.38.D05.1.454.CMB.2.raw
  modified_base (426)..(426): a, c, t, g, unknown or other
  misc_feature (426)..(426): n is a, c, g, or t
  modified_base (434)..(434): a, c, t, g, unknown or other
  misc_feature (434)..(434): n is a, c, g, or t
  modified_base (437)..(437): a, c, t, g, unknown or other
  misc_feature (437)..(437): n is a, c, g, or t
  modified_base (453)..(453): a, c, t, g, unknown or other
  misc_feature (453)..(453): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggtgcacttattattggatgacggttaccgctacagtccatctctgaggaggagactcaccatccaccaacggaccaacccccaaaaccaacggtcggtccttaacaaatcgaccaccatacgggaccctgtcggacacagcccanatatttcngtncacactctagtagganccaccgtggtacgtctggaccaaacgtcggttacccgaccccgttcggggggaaccccggaaaccccgttgggtcccttaacccggttcctccccttccgacggcccccttaaccccgaacccgtaaaccgggggccccctaacggttccccgggttccccttttccccccgtcccgggg

SEQ ID NO: 325573 - DNA, 676 bp, Homo sapiens
  misc_feature: GZ8MTXP01DECDB.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagccccaggaaaggccctggaatgggttgctacttatttatgggatggacggttaccgctacagtccatctctgaggaggagactcacatcccaccaacggaccaacccccaaaacgaacggtcggtccctacaaatcgaaccaccactcggaccctgtagacacacgccaactattatttctagtcgacacactctaagtaacgggacgctaacccgttgggtaacgttccgttacgaaccccgtaaaacgttcggggttaccccggaaccccccggttcggggggaaccccccgggtaaaccccgttccgggggtacccacccgggtttccctcccttaccgaccggttcccccttaaccccgaaacccgaacgggggtccccctaacgttcccgggttcccctttcccccgtcccggg

SEQ ID NO: 325574 - DNA, 694 bp, Homo sapiens
  misc_feature: GZ8MTXP01B7NNI.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgccccaggaaacggccctggaagtgggttgctacttatttattggatgacggttaccgctacagtccatctctgaggaggagactcacactacccaccaacggaaccaacccccaaaaaccgaacgggttacgggtaacccttaaacaaactacgaacccaaccacgtcggacccctgtacggacaacagaccaacattactttctaggtcacaacacttacttaagtacgggagtaccaacccgttggtacgtccgtacggaccctaaaacgttccggggttaccccgaacccccgggttcggggggaaccccccggggtaaacccttcgggggttaccccacccgggttccctcccgttaccgccggttacccttaaccccgaacccgaaacggggtcccctagttcccggttccccgtttcccccggtcccggg

SEQ ID NO: 325575 - DNA, 605 bp, Homo sapiens
  misc_feature: GZ8MTXP01CUPJQ.22.38.D05.1.454.CMB.2.raw
  modified_base (430)..(430): a, c, t, g, unknown or other
  misc_feature (430)..(430): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggttgctacttatttattgggatgacggttaccgctacagtccatctctgaggaggagactcaccatcccaccaacggaccaacccccaaaaccaaggtcgtcctacaatcgaccaccatcggaccctgtgacacagccacattatttcngtgcacactctaagtaggacgcacctggtacgtcctggaaccctaaagttcgggttcccgaccccggtgggggaaccccgggtaaacccgttgggttccccaccggtttcctcccttccgacgcccctaaccgacccaacggggtccccagttcccggttccttcccccgtcggg

SEQ ID NO: 325576 - DNA, 594 bp, Homo sapiens
  misc_feature: GZ8MTXP01D99LY.22.38.D05.1.454.CMB.2.raw
  modified_base (423)..(423): a, c, t, g, unknown or other
  misc_feature (423)..(423): n is a, c, g, or t
  modified_base (426)..(426): a, c, t, g, unknown or other
  misc_feature (426)..(426): n is a, c, g, or t
  modified_base (442)..(442): a, c, t, g, unknown or other
  misc_feature (442)..(442): n is a, c, g, or t
  modified_base (453)..(453): a, c, t, g, unknown or other
  misc_feature (453)..(453): n is a, c, g, or t
  modified_base (529)..(529): a, c, t, g, unknown or other
  misc_feature (529)..(529): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggtgcacttattatggatgacggttaccgctacagtccatctcgtgaggaggagactcacatccaccaaggaccaaccccaaaacaacggtacgtccttacaaatgaccacatcggaccctgtcgacacagccacatatttcngtncacactctagtaggancaccgtggtanctgacctaaacgtcggttaccgaccccgtcgggggccccgggtaacccttggggtacccaccggtcctcccttccncggttcccgtaacccacccgaaaccggggccccaacgttcccgggtccctttcccccggtccggg

SEQ ID NO: 325577 - DNA, 565 bp, Homo sapiens
  misc_feature: GZ8MTXP01C5W2B.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagccccaggaaaggccctggaatgggttgcacttatttatgggatgacggttaccgctacagtccatctctgaggaggagactcacatccaccaagacaccccaaaacaagtgtctacaatgaccaccatgaccctgtgacacagccacatatttctgtgcacactctataggagcacctggtgtctgcctaaactcgggttaccgaccccgtgggggcccccgggaaacccttggggtccaccggttcctccttccgcgcccctccgacccgaacggggccccagttcccgggtcccttcccccgtcgg

SEQ ID NO: 325578 - DNA, 744 bp, Homo sapiens
  misc_feature: GZ8MTXP01EHD1J.22.38.D05.1.454.CMB.2.raw
  modified_base (474)..(474): a, c, t, g, unknown or other
  misc_feature (474)..(474): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgccccaggaacggccctggaagtgggtgctacttatttagttggatgacggttaccgctacagtcatctctgaggaggagactcacactaccaaccaaacggaaccaaacccccaaaaaccgaaacggtacggtaacccttaaacaaactacgaacccaccacgtacgggaccccttaggacggaaccaaccagacccaactaattactttttccgngtacgacctaactaacttacgttaagggtaacgggacgtaccgtaaccgttagggttaccgttccgtaacggaaaccccgttaaaccggttccggggttacccccggacccccggggtcccggggggtaacccccgggttaaacccgttccgggtaccccttacccggttccctcccgacccgttacccggttacccccgtaacccgaaacccgggtaacccgggtccccgtacggtttccccgggttcccccgtttcccccgggtccgg

SEQ ID NO: 325579 - DNA, 580 bp, Homo sapiens
  misc_feature: GZ8MTXP01D279J.22.38.D05.1.454.CMB.2.raw
  modified_base (310)..(310): a, c, t, g, unknown or other
  misc_feature (310)..(310): n is a, c, g, or t
  modified_base (416)..(416): a, c, t, g, unknown or other
  misc_feature (416)..(416): n is a, c, g, or t
  modified_base (424)..(424): a, c, t, g, unknown or other
  misc_feature (424)..(424): n is a, c, g, or t
  modified_base (427)..(427): a, c, t, g, unknown or other
  misc_feature (427)..(427): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggtccgtcagcccccaggaaaggccctggaatgggtgcacttattatgggatgacggttaccgntacagtccatctctgaggaggagactcaccatccaccaaggaccaacccccaaaaccaaggtgtccttacaatacgaccaccatgggaccctgtggacacagccanatatttcngtncacactctagtaggagctaccgtggtagtctgacccaaacgttcgggttccgaccccgtgggggcccccggggtaaacccttcgggtccgacccgttctccccttcgcgcccctccaccgaacgggcccagttcccggtccttcccccgtcgg

SEQ ID NO: 325580 - DNA, 555 bp, Homo sapiens
  misc_feature: GZ8MTXP01BZPFE.22.38.D05.1.454.CMB.2.raw
  modified_base (368)..(368): a, c, t, g, unknown or other
  misc_feature (368)..(368): n is a, c, g, or t
  modified_base (375)..(375): a, c, t, g, unknown or other
  misc_feature (375)..(375): n is a, c, g, or t
  modified_base (405)..(405): a, c, t, g, unknown or other
  misc_feature (405)..(405): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggtgcacttatttattgggatgacggttaccgctacagtccatctctgaggaggagactcaccatccaccaggacaccccaaaacagngtcctanatgaccacatggaccctgtgacacagccanatatttctgtgcacactctagtaggagcaccgtggtagtctgaccaaacttgggttccgaccccgtgggggccccggaacccttgggtccaccgtctcccttcgcgccctccaccgaacgggccccagttccggtccttcccccgtcggg

SEQ ID NO: 325581 - DNA, 593 bp, Homo sapiens
  misc_feature: GZ8MTXP01DJYTF.22.38.D05.1.454.CMB.2.raw
  modified_base (543)..(543): a, c, t, g, unknown or other
  misc_feature (543)..(543): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggtccgtcacgccccaggaaaggccctggatgggtgcacttatttattgggatgacggttaccgctacagtccatctctgaggaggagactcacatcccaccaaggaccaaccccaaaaccaggtcgtctacaatgaccaccatcggaccctgtgacacacgccactattattctgtgcacactctaagtacggacgcacgtggtacgtctcgaccctaaacgttcgggttacccgaccccggttcgggggaaccccgggtaacccgttcgggtcccacccggttcctcccgttccncggcccctccgaccgaacgggcccacgttccggtcccttcccccgtcggg

SEQ ID NO: 325582 - DNA, 552 bp, Homo sapiens
  misc_feature: GZ8MTXP01EZOWN.22.38.D05.1.454.CMB.2.raw
  modified_base (404)..(404): a, c, t, g, unknown or other
  misc_feature (404)..(404): n is a, c, g, or t
  modified_base (412)..(412): a, c, t, g, unknown or other
  misc_feature (412)..(412): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggttgcacttatttattgggatgacggttaccgctacagtccatctctgaggaggagactcacatccaccaagacaccccaaacagtgcttacatgacacatcggaccctgtggacacagccanatatttcngtgcacactctagtaggagcaccgtggtactctgaccaaactgggtccgaccccgtgggggccccgggtaaccttgggtcccaccggtcctccttcgcgccctccaccgaacgggcccagttccggtccttcccccgcgg

SEQ ID NO: 325583 - DNA, 576 bp, Homo sapiens
  misc_feature: GZ8MTXP01D83WP.22.38.D05.1.454.CMB.2.raw
  modified_base (425)..(425): a, c, t, g, unknown or other
  misc_feature (425)..(425): n is a, c, g, or t
  modified_base (434)..(434): a, c, t, g, unknown or other
  misc_feature (434)..(434): n is a, c, g, or t
  modified_base (437)..(437): a, c, t, g, unknown or other
  misc_feature (437)..(437): n is a, c, g, or t
  modified_base (452)..(452): a, c, t, g, unknown or other
  misc_feature (452)..(452): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggttgcacttatttattgggatgacggttaccgctacagtccatctctgaggaggagactcaccatcccaccaaacggaccaacccccaaaacaacggtacgtccttacaaatcgaccaccatcggaccctgtggacacagccanattatttcngtncacacgtctagtagnctaccgtgtactctgaccaaacgtcggttaccgaccccgtgggggaaccccggtacgttcggtccaccgtctcccttcgcgccctccaccgaacgggccccagttccgtcccgttccccgtcgg

SEQ ID NO: 325584 - DNA, 634 bp, Homo sapiens
  misc_feature: GZ8MTXP01BSS0H.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtagaaacccacacacgaccctcacgctgacctgcctaccttctctggttctcactcaactctaggtggagtgggtgtgggtctggttccgtcacggcccccgaagggaaacggcccgtagggaagtgggttgactacttatttagttgggattggacggttaccgcttacacgtccatctcgtgaggaggagactcacactaccaccaaacgacccaaaccccaaaacgaacggtacgtcctaacaactcgaacccacacgtcgaaccctgacgacacacgtacccaatattactttcgtacgtcacaactacttacgtaagtacggagcctaccgtggtacgtcacggaacctaaacgtccggttacccgacccgtcggggaaccccgtaaccttggtacccaccgtctccgttacgccttcccaacccgacgaaccggtcccacgttccggtcccttcccgccg

SEQ ID NO: 325585 - DNA, 580 bp, Homo sapiens
  misc_feature: GZ8MTXP01DPCVO.22.38.D05.1.454.CMB.2.raw
  modified_base (418)..(418): a, c, t, g, unknown or other
  misc_feature (418)..(418): n is a, c, g, or t
  modified_base (447)..(447): a, c, t, g, unknown or other
  misc_feature (447)..(447): n is a, c, g, or t
  modified_base (534)..(534): a, c, t, g, unknown or other
  misc_feature (534)..(534): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggttgcacttatttattgggatgacggttaccgctacagtccatctctgaggagagactcacatccaccaacggaccaacccccaaaacaacggtcgtccttacaatcgaccacatcggaccctgtcgacacagccanattatttctgtcgcacactctagtaaggncacctggtactctgaccaaacgttcgggttaccgaccccggttgggggaaccccggtaaccgttcggtccacccggtctcccgttcncgccctccaccgaacgggccctagttccgggtccttcccccgtcgg

SEQ ID NO: 325586 - DNA, 609 bp, Homo sapiens
  misc_feature: GZ8MTXP01C9QX7.22.38.D05.1.454.CMB.2.raw
  modified_base (424)..(424): a, c, t, g, unknown or other
  misc_feature (424)..(424): n is a, c, g, or t
  modified_base (435)..(435): a, c, t, g, unknown or other
  misc_feature (435)..(435): n is a, c, g, or t
  modified_base (556)..(556): a, c, t, g, unknown or other
  misc_feature (556)..(556): n is a, c, g, or t
  modified_base (562)..(562): a, c, t, g, unknown or other
  misc_feature (562)..(562): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctggttctcactcaactctagtggagtgggtgtgggctggttccgcacgccccaggaaacggccctggaatgggtgctacttattatggatgacgttacgctacagtccatctctgaggagagactcacataccaccaacggaaccaaaccccaaaaacgaaggtacgtccttaacgaaatacgaccaccagtacgaccctgtacgacacagaccanatatttcagtncacactactaagtaggacgctaccgtggttacgtcttacggaaccctaaacgttcgggttaccccgaaccccgtcgggggaaccccggtaaacccgttcggtacccaccggtcctaccccncgaccncccaacccgaccgaaccggtcccacgttcccgtcccgttccccgtcg

SEQ ID NO: 325587 - DNA, 576 bp, Homo sapiens
  misc_feature: GZ8MTXP01BLF92.22.38.D05.1.454.CMB.2.raw
tcagacatacgcgtcacgaccggtgctcgatttagtatctgatagttgggtttggggagtgactcctgtgccccaccattgacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagccccaggaaaggccctggaatgggtgctacttatttatgggatggacggttacgctacagtccatctctgaggagagactcacatccacaagaccaacccaaacagtcgtctacatcgacacatcgaccctgtcgacacacgaccatattactttctgtcgacacactcgtagtaggacgacctaccgtggtactcgtacgaccctaaacgtcgggttacccgaccccgttcgggggaacccccgggaacccgttccgacccgttctcctcacgcccttaccgaaccacgggccacgtcgttcctccccgttggccccg

SEQ ID NO: 325588 - DNA, 557 bp, Homo sapiens
  misc_feature: GZ8MTXP01AP8TK.22.38.D05.1.454.CMB.2.raw
  modified_base (388)..(388): a, c, t, g, unknown or other
  misc_feature (388)..(388): n is a, c, g, or t
tcagacatacgcgtcacgaccggtgctcgatttagtatctgatagttgggtttgggggaggaactgctcagttaggacccagagggaaccatggaagccccagctcagcttctcttcctcctgctactctggctcccagataccaccggagaaattgtgttgacacagtctccagccaccctgtctttgtctccggggaaagagccaccctctcctgcagggccagtcagaatgttagtagttacttagcctggtaccagcaaaagcctggccaggctcccagactcctcatctctgatacatcccaaacagggccactggcactccagccaggttcagtggcaggtggtctgggacagacttcactctcaccatcagcgacctagancctgaacgtattttgctaagtttattactgtcagtcagtcgtaaggctagtctcgggtccctaccggtactacccgtttcgggccccgtaagggggacccaagcgtggaacgactacgaaaacgtacgtggttacggcttcgcaccaattctgttcttcgcgttccccg

SEQ ID NO: 325589 - DNA, 660 bp, Homo sapiens
  misc_feature: GZ8MTXP01C2IYE.22.38.D05.1.454.CMB.2.raw
  modified_base (319)..(319): a, c, t, g, unknown or other
  misc_feature (319)..(319): n is a, c, g, or t
  modified_base (375)..(375): a, c, t, g, unknown or other
  misc_feature (375)..(375): n is a, c, g, or t
tcagacatacgcgtcacgaccggtgctcgatttagtatctgatagttggggtttggggagtgactcctgtgccccaccatggacacactttgctccacgctcctgctgctgaccatcccttcatgggtcttgtcccagatcaccctgaaggagtctggtcctacgctggtacgaaacccacacagaccctcacgctgacctgcaccttctctgggttctcactcaactctagtggagtgggtgtggctggtcctcacgccccaggaacggcctggagtgggtagtaacttatttagtgggatgtacggttaccgctacngtccatctctggagggaggagactcacatacacccaacggaccaaccccaaaacgnggtacgtacctaacaatcgacccacacgtcggacctgtacgacacacgccactatatttcgtgtcgcactactacgtacgtaggggactacctaccgttaggtacgtccgcgtacctaaaccgttcgggttaccccgaccccgggttccgggggacccccggtaacccgtcggttacccgtacccggttccttacccgtccacccggttcccttaccccgaaccggaacccggggtcccctacgttcccgggtttaccccgtttcccccggttcggggtcccccg

SEQ ID NO: 325590 - DNA, 577 bp, Homo sapiens
  misc_feature: GZ8MTXP01CH3IW.22.38.D05.1.454.CMB.2.raw
  modified_base (428)..(428): a, c, t, g, unknown or other
  misc_feature (428)..(428): n is a, c, g, or t
  modified_base (437)..(437): a, c, t, g, unknown or other
  misc_feature (437)..(437): n is a, c, g, or t
  modified_base (440)..(440): a, c, t, g, unknown or other
  misc_feature (440)..(440): n is a, c, g, or t
  modified_base (447)..(447): a, c, t, g, unknown or other
  misc_feature (447)..(447): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctggttctcactcaactctagtggagtgggtgtgggctggttccgtcacgcccccgaggaaacggccctggaatgggttgctacttatttatggatgacggttacgctacagtccatctcgtgaggaggagactcacatacccaaccaaagaccaaaccccaaaacaaggtcgtccttacaaatcgaccaccactcggaccctgtacggacactagcccanattacttcngtncacactntagtaggagcaccgtgtagtctgacctaaagtcggtaccgaccccgtggggaaccccggtaccttggtccaccgtcctccttcgcgccctccgaaccgaacgggcccacgttccggtcccttccccgcgg

SEQ ID NO: 325591 - DNA, 617 bp, Homo sapiens
  misc_feature: GZ8MTXP01B5JLM.22.38.D05.1.454.CMB.2.raw
  modified_base (423)..(423): a, c, t, g, unknown or other
  misc_feature (423)..(423): n is a, c, g, or t
  modified_base (431)..(431): a, c, t, g, unknown or other
  misc_feature (431)..(431): n is a, c, g, or t
  modified_base (434)..(434): a, c, t, g, unknown or other
  misc_feature (434)..(434): n is a, c, g, or t
  modified_base (448)..(448): a, c, t, g, unknown or other
  misc_feature (448)..(448): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctggttctcactcaactctagtggagtgggtgtggctggtccgtcagccccaggaaaggccctggaatgggtgctacttatttattggatgacggttaccgctacagtccatctctgaggagagactcacactaccaaccaaggaaccaaccccaaaaaccaaggtacgtccttaacaaatcgaccacactggaacccctgtacgacacacgccanattattcngtncacatcagtagganacacctgtacgtctcggaccaaacgtcgggttacccgaccccggttgggggaacccccggtaaacccgttcgggtacccaccggttcctcccgttacgaccgttcccctaacccgaaccccgaacgggggttccccacgttcccgggtcccctttcccccggtcccggg

SEQ ID NO: 325592 - DNA, 519 bp, Homo sapiens
  misc_feature: GZ8MTXP01BC665.22.38.D05.1.454.CMB.2.raw
  modified_base (202)..(202): a, c, t, g, unknown or other
  misc_feature (202)..(202): n is a, c, g, or t
  modified_base (443)..(443): a, c, t, g, unknown or other
  misc_feature (443)..(443): n is a, c, g, or t
  modified_base (472)..(472): a, c, t, g, unknown or other
  misc_feature (472)..(472): n is a, c, g, or t
tcagacatacgcgtcacgaccggtgctcgatttagtatctgatagttgggtttgggggaggaactgctcagttaggacccagagggaaccatggaagccccagctcagcttctcttcctcctgctactctggctcccagataccaccggagaaattgtgttgacacagtctccagccaccctgtctttgtctccggggaaanagccacctctcctgcagggccagtcagaatgttagtagttacttagcctggtaccagcaaaagcctggccaggctcccagactcctcatctctgatacatccaaacacgggccactggcatccccagccaggttcagtgcagtgggctgggacagacttcactctcaccatcagcgacctagacgcctagaagtatttgctagtttattactgtcagcagcgtagcatctggcctcgtacnccgttggcctaggggaccaagcgtggagntacaaacgactggttggcttgcacctaatctgttcttcaacgttccc

SEQ ID NO: 325593 - DNA, 687 bp, Homo sapiens
  misc_feature: GZ8MTXP01EB70U.22.38.D05.1.454.CMB.2.raw
  modified_base (315)..(315): a, c, t, g, unknown or other
  misc_feature (315)..(315): n is a, c, g, or t
  modified_base (324)..(324): a, c, t, g, unknown or other
  misc_feature (324)..(324): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctggttctcactcaactctagtggagtgggtgtgggctggttccgtcagccccaggaaaggccctggaatgggtgctacttatttatgggatgacggttaccgctacngtccatctntgaggaggagactcacataccaccaaacggaaccaaacccccaaaaccgaacgggtacggtcccttaacaaactacgacccaccgactacgggacccctgtcggaccacgagacccaataacttattttcaggtcgacctaacaccttacttaaggttaagggacgtacctaaacccgttggtaacgtccgttacgaaccctaaacgttcgggttacccggacccccggttcggggggaacccccggtaaccgttcggggtcccttaccccggttcctccccgttccgaccgttcccctaaccccaaccgtaacccggggttcccctacggttccccgggttccccttccccccggtcccggg

SEQ ID NO: 325594 - DNA, 691 bp, Homo sapiens
  misc_feature: GZ8MTXP01DM8X1.22.38.D05.1.454.CMB.2.raw
  modified_base (462)..(462): a, c, t, g, unknown or other
  misc_feature (462)..(462): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctggttctcactcaactctagtggagtgggtgtgggctggttccgtcacgcccccgaggaacggccctggaagtgggttgctactttagtttagttggatgacggttaccgctacagtccatctcgtgaggagagactcacactacccaccaaacggaacccaaacccccgaaaaaccgtaacgggtacggtaaccttaacaaactacgaccaccagtcggaccctgtacgacacacgaccaactattactttcngtacgacaactacttacctaaggtaacgggacgtacctacccggttagggtaaccgttcgttacggaacccctaaacggtttccgggggtttaccccggaccccccggggttaccggggggaaccccccgggtaacccgttcggggtaccccacccggttcctcccttcgaccgttcccctaacccgaaccgtaacgggcccctacgttccggttcccttccccgtcgg

SEQ ID NO: 325595 - DNA, 565 bp, Homo sapiens
  misc_feature: GZ8MTXP01EBYI4.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggtgcacttatttattgggatgacggttaccgctacagtccatctctgaggaggagactcaccatccaccaaggaaccaacccccaaaaaccaaggtacggtccttacaatgaccaccatggaccctgtgacacagccacatattctgtgcacactctagtaggagcacctggtatctgaccaaacgtcggttaccgaccccgtgggggccccggaaccttgggtcccaccggtctcccttcgcgccctccaccgaacgggcccattcggtcccttccccgtcgg

SEQ ID NO: 325596 - DNA, 616 bp, Homo sapiens
  misc_feature: GZ8MTXP01C7Z84.22.38.D05.1.454.CMB.2.raw
  modified_base (438)..(438): a, c, t, g, unknown or other
  misc_feature (438)..(438): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctggttctcactcaactctagtggagtgggtgtgggctggttccgtcagccccaggaaaggccctggaatgggtgctacttatttattggatgacggttaccgctacagtccatctctgaggaggagactcacatcccaaccaacggaccaaacccccaaaaccgaacgggtacggtccttaacaatacgaccaccatcgaccctgtcggacacagccaacattactttcngtgcaacactctaggtaggagccacgtggtagtctggacccaaacgttcggtacccgtaccccgtgggggtaaccccggtaacccgttgggtacccacccggtcctcccgttcgaccgcccctaacccgaacccgaacgggtccccacgttccccggtcccgtttcccccgtccgggg

SEQ ID NO: 325597 - DNA, 646 bp, Homo sapiens
  misc_feature: GZ8MTXP01B2C3K.22.38.D05.1.454.CMB.2.raw
  modified_base (441)..(441): a, c, t, g, unknown or other
  misc_feature (441)..(441): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgcccccgaggaacggccctggaatgggtgctacttatttagttgggatgacggttaccgctacacgtccatctcgtgaggaggagactcaccatacccaaccaacggaacccaaacccccaaaaccgaacgggtacggtccttaacaactacgacccaccacgtcggaccctggtacgaccacncgccaactattactttctgtcgacaactactcttaggtacggaagtccaaccgttggtacgtcgtcgacctaaacgtcgggttacccgaccccggtcgggggaacccccgggtaacccgttcgggtcccacccggttcctccttcgaccggttccctaacccgaccgaaccgggccctacgttccgggtccctttccccgccggg

SEQ ID NO: 325598 - DNA, 568 bp, Homo sapiens
  misc_feature: GZ8MTXP01C3QJT.22.38.D05.1.454.CMB.2.raw
  modified_base (431)..(431): a, c, t, g, unknown or other
  misc_feature (431)..(431): n is a, c, g, or t
  modified_base (449)..(449): a, c, t, g, unknown or other
  misc_feature (449)..(449): n is a, c, g, or t
  modified_base (504)..(504): a, c, t, g, unknown or other
  misc_feature (504)..(504): n is a, c, g, or t
  modified_base (525)..(525): a, c, t, g, unknown or other
  misc_feature (525)..(525): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagccccaggaaaggccctggaatgggtgcacttatttattggatgacggtacgctacagtccatctctgaggaggagactcacatccaccaaggacaaccccaaaaccaaggtcgtccttacgaatacgaccaccatcggaccctgtggaacacgagccaacattactttctgtcncacaactctaagtaaggngaccaccgtggtagtctgaccaaactcggttcgacccgtggggcccggtaaccgngggtccaccgttctccgttcncgccctccaccgaacgggcccagttccggtccttccccgtcgg

SEQ ID NO: 325599 - DNA, 580 bp, Homo sapiens
  misc_feature: GZ8MTXP01EBJQG.22.38.D05.1.454.CMB.2.raw
  modified_base (429)..(429): a, c, t, g, unknown or other
  misc_feature (429)..(429): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagccccaggaaaggccctggaatgggtgcacttattattgggatgacggttaccgctacagtccatctctgaggaggagactcacatccaccaaacggaccaacccccaaaaccaaggtacggtccttacaaatcgaccaccatcggaccctgtgacacagccactatatttcngtgcacactctagtaggagcaccgtggtacgtctagaccctaaacgtcgggttaccgaccccgtgggggaaccccggaaccttgggtccaccgtctacccttcacgccctccaccgaacgggccctagttccggttcccttccccgtcggg

SEQ ID NO: 325600 - DNA, 629 bp, Homo sapiens
  misc_feature: GZ8MTXP01CEC1S.22.38.D05.1.454.CMB.2.raw
  modified_base (474)..(474): a, c, t, g, unknown or other
  misc_feature (474)..(474): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagccccaggaaacggccctggaatgggtgctacttatttattggatgacggttaccgctacagtccatctctgaggaggagactcaccatcccaaccaaacggaacccaaacccccaaaaccgaacggtacggtccttaacaaactcgaaccaccactcggaccctgtcggaacacgacgaccataattactttctgtcgcaactactctaagtaggancaccgtggtactctagaccctaaacgtcgggttacccgaccccgttgggggaacccccggtaaaccgttcgggtacccacccggttcctcccgttaccgcgttcccctaacccgaccgaaccgggcccacgttcccggtcccttcccccgtcggg

SEQ ID NO: 325601 - DNA, 597 bp, Homo sapiens
  misc_feature: GZ8MTXP01BRF94.22.38.D05.1.454.CMB.2.raw
  modified_base (424)..(424): a, c, t, g, unknown or other
  misc_feature (424)..(424): n is a, c, g, or t
  modified_base (441)..(441): a, c, t, g, unknown or other
  misc_feature (441)..(441): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggtgcacttattattgggatgacggttaccgctacagtccatctctgaggaggagactcaccatccaccaaggaccaaccccaaaacagtcgtccttacaatcgaccacatggaccctgtcgacacagccacatatttctggtnacacactctagtaggancaccgtggtatctcggaccctaaacgtcgggttacccgaccccgttcgggggcccccggaacccttcggggtcccttacccggttcctcccttcgccgttccctaaccgacccgaaacgggccccctagttcccgggttccctttccccccggtgg

SEQ ID NO: 325602 - DNA, 582 bp, Homo sapiens
  misc_feature: GZ8MTXP01AXRI7.22.38.D05.1.454.CMB.2.raw
  modified_base (419)..(419): a, c, t, g, unknown or other
  misc_feature (419)..(419): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggtgcacttatttattgggatgacggttaccgctacagtccatctctgaggaggagactcaccatcccaccaaggaccaaccccaaaacaggtgtcctacaatgaccacatcggaccctgtgacacagccacatattcntcgcacactctagtagagcaccgtggtagtctgaccaaacgtcgggttccgaccccggttgggggaaccccgggaacccgttgggtacccacccggtcctcccttccgacggccctaaccgaccgtaacggggcccctagttcccggtcctttcccccggcgg

SEQ ID NO: 325603 - DNA, 643 bp, Homo sapiens
  misc_feature: GZ8MTXP01CSJ60.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctggttctcactcaactctagtggagtgggtgtgggctggttccgtcacgccccgaggaaacggcctggaagtgggtgctacttattagtggatgacgtacgctacagtccatctctggaggaggagactacacactacccaaccaaacggacccaaacccccaaaacgaacgggtacgtaacctaacaatacgaccacacgtcgaccctgtacgacacgacgccaactattactttcgagtcacaacactactaaggtacggacgctaccgtggtactcgtagaccctaaacgttccggtacccggaccccggttcggggggaacccccggtaaacccgttgggttacccaccggtttcctcccttaccgcgccccttaacccgaacccggtaaccgggccctacgttcccggttcccgtttcccccggtccggg

SEQ ID NO: 325604 - DNA, 586 bp, Homo sapiens
  misc_feature: GZ8MTXP01CSHVN.22.38.D05.1.454.CMB.2.raw
  modified_base (438)..(438): a, c, t, g, unknown or other
  misc_feature (438)..(438): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagccccaggaaaggccctggaatgggtgcacttatttattgggatgacggttaccgctacagtccatctctgaggaggagactcaccatcccaccaacggaccaaacccccaaaaccaacgggtacgtccttaacaatcgacccaccatcggaccctgtcggacacacgccaacattatttcngtgcacactctagtacggagcaccgtggtactctgacctaaactcgggttccgaccccgtcgggggccccggaacccttgggtccaccgtctccttcgcgccctcccgacccgaacgggccccacgttccggtcccttcccccgtcgg

SEQ ID NO: 325605 - DNA, 580 bp, Homo sapiens
  misc_feature: GZ8MTXP01CK3SY.22.38.D05.1.454.CMB.2.raw
tcagacatacgcgtcacgaccggtgctcgatttagtatctgatagttgggtttgggggaggaactgctcagttaggacccagagggaaccatggaagccccagctcagcttctcttcctcctgctactctggctcccagataccaccggagaaattgtgttgacacagtctccagccaccctgtctttgtctccgggggaaagagccaccctctcctgcagggccagtcagaatgttagtagttacttagcctggtaccagcaaaagcctggccaggctcccagactcctcatctctgatacatccaaacagggccactggcatccccagccaggttcagtggcaggtcgggtctgggacagacttcactctcaccatcagcgacctagacgcctagaagtatttgacttagtttattactgtcagtcaagcgtaggctatctcggccctccgtacctaccgtttcggccgtaagggggaccaagccgtaagggaacgacgttaacgaaacgtaaaccgtggttacgggcttcggaaccaccgtaattccgttgttacctttccgttaacgtttcccccg

SEQ ID NO: 325606 - DNA, 637 bp, Homo sapiens
  misc_feature: GZ8MTXP01DWZBA.22.38.D05.1.454.CMB.2.raw
  modified_base (325)..(325): a, c, t, g, unknown or other
  misc_feature (325)..(325): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggtgctacttatttatggatgacggttaccgctacagtccatctntgaggagagactcacatccaccaaggaccaaccccaaaacagtcgtcctacaatagaccaccatggaccctgtgacacagccaactatatttctagtgacacactctaagtacggagtccaaccgtggtacgtctgaccctaaaacgttcgggttacccgacccccgttcggggggcccccgggaaacccgttcggggtaccccttaacccggttcctccccgttaccaccggttaccccctcccaaaccccggaaaccgggggtccccctaacgttccccggggtttcccctttcccccccggttccgggg

SEQ ID NO: 325607 - DNA, 624 bp, Homo sapiens
  misc_feature: GZ8MTXP01B1LGO.22.38.D05.1.454.CMB.2.raw
  modified_base (398)..(398): a, c, t, g, unknown or other
  misc_feature (398)..(398): n is a, c, g, or t
  modified_base (426)..(426): a, c, t, g, unknown or other
  misc_feature (426)..(426): n is a, c, g, or t
  modified_base (429)..(429): a, c, t, g, unknown or other
  misc_feature (429)..(429): n is a, c, g, or t
  modified_base (445)..(445): a, c, t, g, unknown or other
  misc_feature (445)..(445): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgccccaggaaacggccctggaatgggtgctacttatttagtgggatgacggttaccgctacagtccatctctgaggaggagactcgcatcccacaacggaccaacccccaaaacaacgtacgtcctacaatcgaccacacncgaccctgcgacacagccatatatttcngtnacacactcagtaggancaccgtggtacgttctgaaccctaaacgtccgggttacccggaacccccggtcgggggaacccccggtaacccgttccgggtccgaaccccgttccgtcccttccgaccgttccccgtaacccgaacccgaaccgggtccccgacgttccccggggtcccctttccccccggtcccggg

SEQ ID NO: 325608 - DNA, 698 bp, Homo sapiens
  misc_feature: GZ8MTXP01DVCJF.22.38.D05.1.454.CMB.2.raw
  modified_base (479)..(479): a, c, t, g, unknown or other
  misc_feature (479)..(479): n is a, c, g, or t
  modified_base (484)..(484): a, c, t, g, unknown or other
  misc_feature (484)..(484): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtagaaacccacacagaccctcacgctgacctgcaccttctctggttctcactcaactctagtggagtgggtgtgggctggttccgtcacgcccccaggaaacggccctggaagtgggtgctacttatttatgggatgacggttaccgctacagtccatctcgtgaggaggagactcaccatcccaaccaaacggaacccaaaccccccaaaaaccgaacgggtacggtaaccctttaaacaaacttaccgaacccaccgacgtacgggtacccctgtacgggacaacacgaccctaactattaattttccngtacncaaccaacttcgtaagtaacggacgtcctaccgttggtaacgtcgtcgaacccctaaagttccgggttaccccgaccccgggttcgggggaacccccggggtaaacccgttcggggtaccccttaccggtcctccccgttccgacggcccccttaacccgaacccggtaaccggggcccctacgttccccggttccccgttcccccgtcccggg

SEQ ID NO: 325609 - DNA, 573 bp, Homo sapiens
  misc_feature: GZ8MTXP01DX78Z.22.38.D05.1.454.CMB.2.raw
  modified_base (417)..(417): a, c, t, g, unknown or other
  misc_feature (417)..(417): n is a, c, g, or t
  modified_base (426)..(426): a, c, t, g, unknown or other
  misc_feature (426)..(426): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagccccaggaaggccctggaatgggtgcacttattatgggatgacggttaccgctacagtccatctctgaggaggagactcaccatcccaccaacggaccaacccccaaaaccaaggtacggtccttacaatcgaccacatcggaccctgtgacacagccanattatttcngtgcacactctagtaggagccacctggtacgtctcggaccctaaacttcgggttaccgaccccgtgggggccccggtaaccttgggtccaccgtcctccttcgcgccctccgacgaacgggcccagttccggtcccttccccgtcgg

SEQ ID NO: 325610 - DNA, 566 bp, Homo sapiens
  misc_feature: GZ8MTXP01ARZDD.22.38.D05.1.454.CMB.2.raw
  modified_base (203)..(203): a, c, t, g, unknown or other
  misc_feature (203)..(203): n is a, c, g, or t
  modified_base (376)..(376): a, c, t, g, unknown or other
  misc_feature (376)..(376): n is a, c, g, or t
  modified_base (404)..(404): a, c, t, g, unknown or other
  misc_feature (404)..(404): n is a, c, g, or t
tcagacatacgcgtcacgaccggtgctcgatttagtatctgatagttgggtttgggggaggaactgctcagttaggacccagagggaaccatggaagccccagctcagcttctcttcctcctgctactctggctcccagataccaccggagaaattgtgttgacacagtctccagccaccctgtctttgtctccgggggaaanagccaccctctcctgcagggccagtcagaatgttagtagttactagcctggtaccagcaaagcctggccaggctcccagactcctcatctctgatacataccaacacgggccaactcggacactccccagccaggttcagtggcagtcgggtctggggacagacttacactcncacatcagcgactacgagcctagaagtntttgctagtttattactgtcagtcagtcgtagcatctcggtcctccgtactaccgtttcggaccgtacgggggaccaaggtccgtaaggaacgcgttaacgaaacgtacgtaggttcggcttcggcctacgtaactcgttacgttcttccgttaacttcccg

SEQ ID NO: 325611 - DNA, 624 bp, Homo sapiens
  misc_feature: GZ8MTXP01CSSX0.22.38.D05.1.454.CMB.2.raw
  modified_base (188)..(188): a, c, t, g, unknown or other
  misc_feature (188)..(188): n is a, c, g, or t
  modified_base (446)..(446): a, c, t, g, unknown or other
  misc_feature (446)..(446): n is a, c, g, or t
  modified_base (449)..(449): a, c, t, g, unknown or other
  misc_feature (449)..(449): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctnacgctgacctgcaccttctctgggttctcactcaactctagtggagtgggtgtgggctggttccgtcacgcccccaggaaacggccctggaatgggtgcacttattatggatgacggtaccgctacagtccatctctgaggaggagactcaccatacccaaccaacggaaccaaacccccaaaaaaccgaaggtacgtccttaacaaatacgaaccaccagtcgaccctgtacggacaacagcccaatacttatttcngtnacaacacttctaagtaggaacgctaccgtggtaactctagacccaaacgttcgggttacccgaccccggtcgggggaaccccggtaaacccgttcgggtaccacccggtcctccgttcacggttcccctccaaccgaacgggccccacgttcccgggttcccttccccgtccggg

SEQ ID NO: 325612 - DNA, 693 bp, Homo sapiens
  misc_feature: GZ8MTXP01EU0T6.22.38.D05.1.454.CMB.2.raw
  modified_base (455)..(455): a, c, t, g, unknown or other
  misc_feature (455)..(455): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgcccccaggaaaggccctggaatgggtgcacttatttatgggatgacggttaccgctacagtcatctctgaggaggagactcaccatacccaaccaaacggaacccaaacccccaaaaaccaagggtacggtccttaacaaactacgaaccaccacgtacgggaccctggtacggacacagccaataattactttacnggtcaccaactacctacttaaggttaacggggactccaacccgttgggtaacgtccgtaggacccctaaaacggttccgggtttaccccggacccccgggttacggggggcccccgggtaaacccgttcgggtccccaacccggttcctaccccgttccgacccggttcccctaacccggaccccgaaacgggggccccctaacgttccccggttccccgtttcccccccggtccggg

SEQ ID NO: 325613 - DNA, 548 bp, Homo sapiens
  misc_feature: GZ8MTXP01CA6DT.22.38.D05.1.454.CMB.2.raw
  modified_base (392)..(392): a, c, t, g, unknown or other
  misc_feature (392)..(392): n is a, c, g, or t
tcagacatacgcgtcacgaccggtgctcgatttagtatctgatagttgggtttgggggaggaactgctcagttaggacccagagggaaccatggaagccccagctcagcttctcttcctcctgctactctggctcccagataccaccggagaaattgtgttgacacagtctccagccaccctgtctttgtctccgggggaaagagccaccctctcctgcagggccagtcagaatgttagtagttacttagcctggtaccagacaaaagcctggccaggctcccagactcctcatctctgatacataccaaacgaggccacgtggcactcccagccaggttcagtggcaggtcggtctgggacagacttcactctcaccatcagcgactagancctagaagtatttgactagtttattactgtcagcagcgtaggctatcgtcgtcctccgtactaccgtttcggccgtacggggaccaaggctaagggaacgatacgaaacgtaacgtgttacgcttcgcactaacttctgttcttcaacgtttcccg

SEQ ID NO: 325614 - DNA, 630 bp, Homo sapiens
  misc_feature: GZ8MTXP01A937W.22.38.D05.1.454.CMB.2.raw
  modified_base (450)..(450): a, c, t, g, unknown or other
  misc_feature (450)..(450): n is a, c, g, or t
  modified_base (453)..(453): a, c, t, g, unknown or other
  misc_feature (453)..(453): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgccccaggaaggccctggatgggtgctacttattagtggatgacggtaccgctacagtccatctctgaggaggagactcaccactcccaaccaaacggaacccaaacccccaaaaaccgaacggttacggtaacccttaacaaatacgaacccaccactcgggaccctgtacgacacagccaatatactttcngtnacacactctagtaggagcacgtggtactcgtcgacctaaacgtcgggttacccgaccccggtcgggggaaccccggtaacccgttcgggtacccaccggttccctcccgttccgccggcccctaacccgacccgaaccgggtccccacgttcccgggttcccctttccccgtccggg

SEQ ID NO: 325615 - DNA, 567 bp, Homo sapiens
  misc_feature: GZ8MTXP01AWKAP.22.38.D05.1.454.CMB.2.raw
  modified_base (375)..(375): a, c, t, g, unknown or other
  misc_feature (375)..(375): n is a, c, g, or t
  modified_base (403)..(403): a, c, t, g, unknown or other
  misc_feature (403)..(403): n is a, c, g, or t
  modified_base (411)..(411): a, c, t, g, unknown or other
  misc_feature (411)..(411): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggtgcacttattatgggatgacggttaccgctacagtccatctctgaggaggagactcacatccaccaaggacaccccaaaacagtcgtccttanatgacacatgaccctgtgacacagccanatatttcngtgcacactctagtaggagcaccgtgtacgtctgaccctaaacgtcggttccgaaccccgtgggggaacccccggaaccgttgggtccacccgtctcccttcgacgcccctaaccacccgaacgggccccagttcccggtccctttcccccgcggg

SEQ ID NO: 325616 - DNA, 701 bp, Homo sapiens
  misc_feature: GZ8MTXP01ASHZD.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgccccaggaaaggccctggatgggtgctacttattagtggatgacggttacgctacagtccatctcgtgaggaggagactcaccatacccaaccaacggaacccaaacccccaaaacgaacgggtacggtccttaacaaactacgacccaccacgtcggaaccctggtacggaaccaacgacgacccaactaattactttcgtgtcacactacttactaaggtacggacgcctaaccgttgggtaacgttccgtacgaacccgttaaaacgttccggggttaccccggaccccccgggttacggggggaacccccgggtaaaccccgttcggggtaccccgacccggtttccctaccccgttacccgaccgttcccccgttaacccgaccccgaacgggggtccccctacggttccccgggttcccctttccccccggtccggg

SEQ ID NO: 325617 - DNA, 568 bp, Homo sapiens
  misc_feature: GZ8MTXP01C2CTH.22.38.D05.1.454.CMB.2.raw
  modified_base (281)..(281): a, c, t, g, unknown or other
  misc_feature (281)..(281): n is a, c, g, or t
  modified_base (428)..(428): a, c, t, g, unknown or other
  misc_feature (428)..(428): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagccccaggaagccctggaatgggtncacttatttattgggatgacggttaccgctacagtccatctctgaggaggagactcacatccaccaaaggacaacccccaaaacaacggtcggtccttacaaatcgaccaccatcggaccctgtggacacagccacatatttctgtncacactctagtaggagcaactggtagtctgacccaaacttcggttccgaccccgtgggggaaccccgggaacccgttgggtccaccgtctcccttcgcgcctccaaccgaagggccccagttccggtccttccccgtcgg

SEQ ID NO: 325618 - DNA, 579 bp, Homo sapiens
  misc_feature: GZ8MTXP01DT55Z.22.38.D05.1.454.CMB.2.raw
  modified_base (429)..(429): a, c, t, g, unknown or other
  misc_feature (429)..(429): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagccccaggaaaggccctggaatgggttgctacttatttatggatgacggtaccgctacagtcatctctgaggaggagactcacactccaccaacgaccaaccccaaaaccaacggtacggtcctacaatacgaccaccatcgggaccctgtgacacagccacatatttctgtncacactctagtagagcacgtgtagtctgacctaaactcggttaccgaccccgtcgggggccccggtaaccttcgggtccacccggttctccgttccttcgcccctcccgaccgaacggggcccacgttccggtcccgttccccgtccggg

SEQ ID NO: 325619 - DNA, 540 bp, Homo sapiens
  misc_feature: GZ8MTXP01EIUJO.22.38.D05.1.454.CMB.2.raw
  modified_base (371)..(371): a, c, t, g, unknown or other
  misc_feature (371)..(371): n is a, c, g, or t
  modified_base (410)..(410): a, c, t, g, unknown or other
  misc_feature (410)..(410): n is a, c, g, or t
  modified_base (413)..(413): a, c, t, g, unknown or other
  misc_feature (413)..(413): n is a, c, g, or t
  modified_base (429)..(429): a, c, t, g, unknown or other
  misc_feature (429)..(429): n is a, c, g, or t
  modified_base (456)..(456): a, c, t, g, unknown or other
  misc_feature (456)..(456): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggttgcacttatttattgggatgacggtacgctacagtccatctctgaggagagactcacatccacaagacaccccaaaacaagtgtctanaatagaccacatgaccctgtgacacagccacatatttcngtnacactactctagtagngcactgagtctgacaaactggttaccncccgtcggggcccggaacccttgggccaccgtctccttcgacgccctccaccgaacgggcccagttccggtccttccccgtcgg

SEQ ID NO: 325620 - DNA, 595 bp, Homo sapiens
  misc_feature: GZ8MTXP01DXEUZ.22.38.D05.1.454.CMB.2.raw
  modified_base (431)..(431): a, c, t, g, unknown or other
  misc_feature (431)..(431): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgccccaggaaggcctggatgggtgctacttattattgggatgacggttaccgctacagtccatctctgaggaggagactcacatacccaaccaacggaaccaaaccccaaaaccgaacgggtacgtccttaacaactacgaccaccatcggaccctgtcgacacttacgccaanattattctgtgcacactctagtagagcacgtgtcgtctcgacctaaacgtcggttacccgaccccggtcgggggaaccccgggaaccgttcggtcccaccggttcctcccttcgccgccctaacccgaccgaacgggcccacgttccgtcccgttccccgtcgg

SEQ ID NO: 325621 - DNA, 628 bp, Homo sapiens
  misc_feature: GZ8MTXP01A363O.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagccccaggaaaggccctggaatgggttgcacttatttattgggatgacggttaccgctacagtccatctctgaggaggagactcaccatcccaccaaaggacccaacccccaaaaccaacggtacggtccttaacgaatacgacccaccatcggaaccctgtcggacacagccactatatttctgtgcacactctagtaggagcaccgtggtatctagacctaaacgttcgggttacccgaccccgttcgggggaacccccgggtaacccgttcggggtaccacccggtccttccccgttccgaccggcccctaacccgacccgaaacgggggccccctacgttcccgggttccctttccccccgtccgggg

SEQ ID NO: 325622 - DNA, 635 bp, Homo sapiens
  misc_feature: GZ8MTXP01A0DKH.22.38.D05.1.454.CMB.2.raw
  modified_base (438)..(438): a, c, t, g, unknown or other
  misc_feature (438)..(438): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaacggccctggaatgggtgctacttatttatgggatgacggttacgctacagtccatctctgaggagagactcaccactacccaccgaacggaccaaccccaaaacacggtacgtccttacaactacgaccacacgtcgaccctgtacgactacgacgccatacttatttcngtcgctacacttctaagtacggacgtcctacgtggtacgttctcgacccgtaaacgttgggttaccccgacccgttcgggggaaccccggtaacccgttcgggtacccaccggttaccgtcccgttacgttacgttccccgttaaccgacccggtaacgggtcccctacgttaccccgggtccttcccccgtcgggg

SEQ ID NO: 325623 - DNA, 633 bp, Homo sapiens
  misc_feature: GZ8MTXP01BSIJ0.22.38.D05.1.454.CMB.2.raw
  modified_base (437)..(437): a, c, t, g, unknown or other
  misc_feature (437)..(437): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagccccaggaaaggccctggaatgggtgcacttatttattgggatgacggttaccgctacagtccatctctgaggaggagactcaccactcccaaccaaacggaaccaacccccaaaaccaacgggtacggtcctacaaatacgaccaccatcggaccctgtgacacagccacattatttcngtgcacactctaagtaggagccaccgtggtactctcgacctaaacgtcgggttacccgacccccggttcggggggcccccgggtaaacccgttcggggtcccttaacccggttcctccccgttcgccggttcccctaacccgaacccgtaaccggggcccctacggttcccggttcccctttcccccggtcccggg

SEQ ID NO: 325624 - DNA, 576 bp, Homo sapiens
  misc_feature: GZ8MTXP01DAW6B.22.38.D05.1.454.CMB.2.raw
  modified_base (419)..(419): a, c, t, g, unknown or other
  misc_feature (419)..(419): n is a, c, g, or t
  modified_base (431)..(431): a, c, t, g, unknown or other
  misc_feature (431)..(431): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagccccaggaaggccctggaatgggtgctacttatttagtggatgacggttacgctacagtccatctctggaggaggagactcacatacccaccaacgaccaaccccaaaacgaacggtacgtcctacaatacgaccaccatcgaccctgtacgacacagccanattatttctgtncacactactagtacgggatcaccgtgtagtctcgacctaaacgtcggttacccgaccccgtgggggaaccccggaaccgttggtacccaccgtctccttcgcgccctccaccgaacgggcccacgttccgtccgttccccgtcgg

SEQ ID NO: 325625 - DNA, 594 bp, Homo sapiens
  misc_feature: GZ8MTXP01BAUQN.22.38.D05.1.454.CMB.2.raw
  modified_base (332)..(332): a, c, t, g, unknown or other
  misc_feature (332)..(332): n is a, c, g, or t
  modified_base (432)..(432): a, c, t, g, unknown or other
  misc_feature (432)..(432): n is a, c, g, or t
  modified_base (435)..(435): a, c, t, g, unknown or other
  misc_feature (435)..(435): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctggttctcactcaactctagtggagtgggtgtgggctggttccgtcagcccccaggaaaggccctggaatgggttgcacttatttattgggatgacggttacgctacagtccatctcgtgaggnggagactcaccatcccaccaacggaccaacccccaaaaccaggtcggtcctacaatgaccaccagtcggaccctgtacggacacagaccacattatttcngtncacactctagtaggagcctacgtggtacgtctggaccaaacgttcgggttaccgaccccgttcgggggaaccccggaacccgttgggtacccaccggtcctacccgttcgcgccctccgaccgaacgggccccacgttccgggtccctttccccgcggg

SEQ ID NO: 325626 - DNA, 596 bp, Homo sapiens
  misc_feature: GZ8MTXP01DCUN5.22.38.D05.1.454.CMB.2.raw
  modified_base (420)..(420): a, c, t, g, unknown or other
  misc_feature (420)..(420): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggtgcacttatttattgggatgacggttaccgctacagtccatctctgaggaggagactcacatccaccaaggacaacccccaaaacagtgtcctacaatgaccaccatcggaccctgtcgacacagccacattatttcngtcgcacactctagtaggagcaaccgtgggtactctacgaccaaacgtcgggttaccgacccccgttggggggaacccccggaacccttggggtcccacccggttcctcccgttcacggcccctcccgaacccgaacggggcccccagttcccgggttcctttcccccccgtcggg

SEQ ID NO: 325627 - DNA, 509 bp, Homo sapiens
  misc_feature: GZ8MTXP01BE9WD.22.38.D05.1.454.CMB.2.raw
  modified_base (384)..(384): a, c, t, g, unknown or other
  misc_feature (384)..(384): n is a, c, g, or t
  modified_base (468)..(468): a, c, t, g, unknown or other
  misc_feature (468)..(468): n is a, c, g, or t
  modified_base (494)..(494): a, c, t, g, unknown or other
  misc_feature (494)..(494): n is a, c, g, or t
  modified_base (505)..(505): a, c, t, g, unknown or other
  misc_feature (505)..(505): n is a, c, g, or t
tcagacatacgcgtcacgaccggtgctcgatttagtatctgatagttgggtttgggggaggaactgctcagttaggacccagagggaaccatggaagccccagctcagcttctcttcctcctgctactctggctcccagataccaccggagaaattgtgttgacacagtctccagccaccctgtctttgtctccgggggaaagagccaccctctcctgcagggccagtcagaatgttagtagttacttagctggtaccagcaaaagcctggccaggctcccagactcctcatctctgatacatccaacaggccactggcatcccagccaggttcagtgcagtcgggtctgggacagacttcactctcaccatcagcgactaganctagagtatttgctagtttattactgtcagcagcgtaggcatctggcctccgtactcctttggccagggggaccaagctggagntacaaacgaactgacggcttgcaccnctctgttctcnctcc

SEQ ID NO: 325628 - DNA, 536 bp, Homo sapiens
  misc_feature: GZ8MTXP01ELL7J.22.38.D05.1.454.CMB.2.raw
  modified_base (524)..(524): a, c, t, g, unknown or other
  misc_feature (524)..(524): n is a, c, g, or t
tcagacatacgcgtcacgaccggtgctcgatttagtatctgatagttgggtttgggggaggaactgctcagttaggacccagagggaaccatggaagccccagctcagcttctcttcctcctgctactctggctcccagataccaccggagaaattgtgttgacacagtctccagccaccctgtctttgtctccgggggaaagagccaccctctcctgcagggccagtcagaatgttagtagttacttagcctggtaccagcaaaagcctggccaggctcccagactcctcatctctgatacatccaaacaggccactggcatcccagccaggttcagtggcagtcggctgggacagacttcactctcaccatcagcgactagacgcctagaagtatttgactagtttattactgtcagcagcgtaggcagtctcggcctccgtacgtacctttcgggccgtaaggggaccaaggccgtaaggaagactacgaaaacgaactgttcggcttgcacaatccgttnttctcttcgtcc

SEQ ID NO: 325629 - DNA, 602 bp, Homo sapiens
  misc_feature: GZ8MTXP01CW4QW.22.38.D05.1.454.CMB.2.raw
  modified_base (451)..(451): a, c, t, g, unknown or other
  misc_feature (451)..(451): n is a, c, g, or t
  modified_base (454)..(454): a, c, t, g, unknown or other
  misc_feature (454)..(454): n is a, c, g, or t
  modified_base (554)..(554): a, c, t, g, unknown or other
  misc_feature (554)..(554): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtggctggttccgtcacgccccgaggaaacggccctggaagtgggttgctacttatttagttggatgacggttaccgctacagtccatctctgaggaggagactcacatacccaccaaacgaccaaacccccaaaaccaacggttacgtcccttaacaaatacgacccaaccacgtacggaccctgtacggacacagacccataatatttcngtnacactactcttaagacggagcaccgtgtaacgtctagaccctaaacgtcgggtcccgaaccccggtcgggggaaccccggaaccttgggtcccacgtccnccttcgcgccctaaccaccgcggcccacgttccggtccttccccgcgg

SEQ ID NO: 325630 - DNA, 654 bp, Homo sapiens
  misc_feature: GZ8MTXP01DI7YK.22.38.D05.1.454.CMB.2.raw
tcagacatacgcgtcacgaccggtgctcgatttagtatctgatagttgggtttgggggaggaactgctcagttaggacccagagggaaccatggaagccccagctcagcttctcttcctcctgctactctggctcccagataccaccggagaaattgtgttgacacagtctccagccaccctgtctttgtctccggggaagagccacctctcctgcagggccagtcagaatgtagtagtacttagctgtacagacaaagcctggccaggctcccagactctcatctctgatacataccaacgacgggaccacgtggaccactaccccacgccgtaggttccaaggtcggctagggtcgggtacgtggggaacaggtacttaccactctcaccatcacgacgtactagacgtcctagaacgtagttttcgactttaagttttatttacgtagttacgacgcgaacgtcgtagggctaagttccgttaccgggtcccgttacccggttaaccttaccggtttaccgggccggttaaccgggggaaccgaacgggtccggtaaggggtacgttaacggtaaccgttaaaaccgtacgtaaggttcggggttcttacggctaccgtaacttcggtcttctttcgttaacttttccccg

SEQ ID NO: 325631 - DNA, 728 bp, Homo sapiens
  misc_feature: GZ8MTXP01CSIJP.22.38.D05.1.454.CMB.2.raw
  modified_base (469)..(469): a, c, t, g, unknown or other
  misc_feature (469)..(469): n is a, c, g, or t
  modified_base (650)..(650): a, c, t, g, unknown or other
  misc_feature (650)..(650): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctggttctcactcaactctagtggagtgggtgtgggctggttccgtcagcccccaggaaaggccctggaatgggtgctacttatttatggatgacggttaccgctacagtccatctctgaggaggagactacaccatacccaacccgaaacggacccaaacccccaaaaaacccgaacgggttacggttaacccttaacaaatacggaacccaccactcgggacccctggtcggaacacgacgacccaactattacgtttcngtacgacaacctacttccgttaaagttacggggactccgtaacccgttgggttaacgtccgttacggaaccctaaaaccgttccggggttaccccggtaacccccgggttccggggggaaccccccggggtaaacccgttccgggggttacccaaccccgggtttccctcccggttacccncggttcccccttaacccgaacccgaaaccgggggccccctaggttcccccgggtttcccgtttccccccgtcccgggg

SEQ ID NO: 325632 - DNA, 588 bp, Homo sapiens
  misc_feature: GZ8MTXP01AOVZU.22.38.D05.1.454.CMB.2.raw
  modified_base (407)..(407): a, c, t, g, unknown or other
  misc_feature (407)..(407): n is a, c, g, or t
  modified_base (415)..(415): a, c, t, g, unknown or other
  misc_feature (415)..(415): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggtgcacttattattgggatgacggttacgctacagtccatctctgaggaggagactcacatccaccaaggaccaaccccaaaacagtcgtctacaatcgaccacatcgaccctgtgacacagccanatatttcngtgcacactctagtaggagccaccgtggtacgtctcggaccctaaacgttcgggttaccgacccccgttggggggcccccgggtaaacccgttggggtcccacccggtccttcccttcgcggttcccctccacccgaacggggccccagttcccgggtcctttcccccgcggg

SEQ ID NO: 325633 - DNA, 585 bp, Homo sapiens
  misc_feature: GZ8MTXP01BJ3DS.22.38.D05.1.454.CMB.2.raw
  modified_base (416)..(416): a, c, t, g, unknown or other
  misc_feature (416)..(416): n is a, c, g, or t
  modified_base (424)..(424): a, c, t, g, unknown or other
  misc_feature (424)..(424): n is a, c, g, or t
  modified_base (427)..(427): a, c, t, g, unknown or other
  misc_feature (427)..(427): n is a, c, g, or t
  modified_base (443)..(443): a, c, t, g, unknown or other
  misc_feature (443)..(443): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggttgctacttatttattgggatgacggttaccgctacagtccatctctgaggaggagactcaccatccaccaagaccaaccccaaaacaaggtcgtccttacaatgaccacatcggaccctgtagacacagccanattattcngtncacactctagtagganccaaccgtgggtatctgaccctaaacgtcggttcccgaccccgttcgggggaaccccggtaacccgttgggtcccacggtccctcccttccgcgcccctcccaaccgaacgggccccagttcccggtcctttcccccgcggg

SEQ ID NO: 325634 - DNA, 630 bp, Homo sapiens
  misc_feature: GZ8MTXP01AC1IP.22.38.D05.1.454.CMB.2.raw
  modified_base (452)..(452): a, c, t, g, unknown or other
  misc_feature (452)..(452): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagccccaggaaacggccctggaatgggtgcacttatttattggatgacggttaccgctacagtccatctctgaggaggagactcacatcccaaccaacggaaccaacccccaaaaacaacggtacggtccttaacaaactagacccaccacgtacggacccctgtacggacaacacgaccaactattactttctgtncaactactactagtaggagcaccgtggtacgtctacgacctaaacgttcgggttacccgaaccccggtcgggggaacccccgggtaacccgttcgggtcccacccggtcctcccgttccgcgttccccgtcccaaccgaaccgggcccctagttcccggtccctttcccccgtccggg

SEQ ID NO: 325635 - DNA, 659 bp, Homo sapiens
  misc_feature: GZ8MTXP01A1U8L.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggtcgtcagccccaggaaaggccctggaatgggtgcacttatttattgggatgacggttaccgctacagtccatctctgaggaggagactcaccatacccaaccaaacggaacccaacccccaaaaaccgaacgggtacgggtaacccttaacaaactacgacccaccacgtcggaccctgtacggacacgacgcccaatattatttctgtcgacacactctagtacggagcaaccgtggtacgtctcgaccctaaacgttcgggttacccgaaccccggttcggggggcccccgggtaaacccgttgggtcccaaccccgggtcttccccgttccgccggttcccccttaacccgaaccccgaaccggggtcccctacgttccccgggttccccgtttccccccgtccgggg

SEQ ID NO: 325636 - DNA, 727 bp, Homo sapiens
  misc_feature: GZ8MTXP01BH4X3.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctggttctcactcaactctagtggagtgggtgtgggctggtccgtcagccccaggaaaggccctggaatgggttgctacttatttattgggatgacggttaccgctacagtccatctctggaggaggagactcaccatcccaccaaacggaacccaaacccccaaaaacccgaacggtacggtcccttaacaaactacgacccaaccacgtcggacccctggtacggaaccacacgacccaactacttaattttctggttcgaccaacctacttaccttaaggtaaggggtaacgccgtaacccgttgggttaacgttccgttacgtaaccccgtaaaaccgtttcgggttaccccggtaacccccggttcggggggaaccccccgggtaaaccccgttcgggggtaccccttaaccccgggttcccttaaccccgttccgaaccggccccgttaacccccgaacccgaaaccgggggcccctacgttccccgggtccccgttttccccccgtcccgggg

SEQ ID NO: 325637 - DNA, 621 bp, Homo sapiens
  misc_feature: GZ8MTXP01B7DXN.22.38.D05.1.454.CMB.2.raw
  modified_base (441)..(441): a, c, t, g, unknown or other
  misc_feature (441)..(441): n is a, c, g, or t
  modified_base (444)..(444): a, c, t, g, unknown or other
  misc_feature (444)..(444): n is a, c, g, or t
  modified_base (467)..(467): a, c, t, g, unknown or other
  misc_feature (467)..(467): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctggttctcactcaactctagtggagtgggtgtgggtctggttccgtcacgccccgaggaaacggccctggaatgggttgctacttatttatggatgacggttaccgctacagtccatctctgaggaggagactcacactaccaacccaaggaacccaacccccaaaacgaacggtacgtccttaacaatacgacctacactcgaccctgtacgacacacgccacattatttcngtncacatctagagagcacctggtanctagacctaaacgtcggttacccgaccccggttcgggggaaccccggtaacccgttgggtacccacccggttcctccccttcgccgttaccccgtccccaacccggaaccggggcccctacgttccccggttccccgtttcccccgtcccgggg

SEQ ID NO: 325638 - DNA, 627 bp, Homo sapiens
  misc_feature: GZ8MTXP01A9LPK.22.38.D05.1.454.CMB.2.raw
  modified_base (491)..(491): a, c, t, g, unknown or other
  misc_feature (491)..(491): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgccccaggaaacggccctggaagtgggtgctacttatttatgggatgacggttaccgctacagtccatctctgaggaggtgactcaccataccccaaccaaacggaacccaaacccccaaaaaccgaacgggtacggttcccttaaacaaatacgaacccaaccgacgtcgggaccctggtacggaacacacgaccaactattatttctgttacacacttactatacgggggancgtacctggtacgtctacgacctaaacgtcggttacccgaccccggtcgggggccccggaacctcgggttccacccgttctcctcacgcccttaccgaaccgacggccctacgtccggttcctccccgttgccccg

SEQ ID NO: 325639 - DNA, 669 bp, Homo sapiens
  misc_feature: GZ8MTXP01DP5T8.22.38.D05.1.454.CMB.2.raw
  modified_base (459)..(459): a, c, t, g, unknown or other
  misc_feature (459)..(459): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcacctgaaggagtctggtcctacgctggtgaaaccacacagaccctcacgctgacctgcaccttctctggttctcactcaactctagtggagtgggtgtgggctggtccgtcacgccccgaggaacggccctggaagtgggtgctacttattagtggatgtacgtaccgctacacgtcatctcgtgaggaggagactacacactacccaaccgaaacggaacccaaacccccaaaaaccgaacgggtacggtaacccttaaacgaaatacgaacccaccacgtacggaccctggacgaacacacgaccaatattatttcngtcacacactacaaggtaggacgacctaccgtagggtactcgtacgaaccctaaacggtccgggttacccgacccccgggtcgggggaacccccgggtaaacccgttcgggtacccacccggttcctacccgttccgccggttacccctaacccgaaaccccgaacggggtcccctaaggttccccggttcccgtttcccccggtccggg

SEQ ID NO: 325640 - DNA, 761 bp, Homo sapiens
  misc_feature: GZ8MTXP01DAGOY.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctggttctcactcaactctagtggagtgggtgtgggctggttccgtcacgccccgaggaaggccctggatgggtgctattatttagtggatgacggttaccgctacagtccatctctgaggagagactcaccatacccaaccaacggaaccaaacccccaaaaaccgtaacgggtacggttaacccttaacaaactacgaacccaaccacgtacggtacccctggtacggaaccaacgacgacccaaactaactttaacttttccgtaggttacgacctaaaccgtaaccgttaccttaaagggttaacgggaaaccggtacctaaccccggttagggttaacgtcccgtacggtaaacccctaaaacggttcccggggttaccccggtaaccccccgggttcggggggaaccccccgggtaaaccccgttcgggggtaccccaacccgggtttccctccccgttacccgaccgttccccgttaaccccgaaacccggaaacccggggtccccctacggttccccgggttccccctttccccccggtcccgggg

SEQ ID NO: 325641 - DNA, 671 bp, Homo sapiens
  misc_feature: GZ8MTXP01C4DYM.22.38.D05.1.454.CMB.2.raw
  modified_base (298)..(298): a, c, t, g, unknown or other
  misc_feature (298)..(298): n is a, c, g, or t
  modified_base (503)..(503): a, c, t, g, unknown or other
  misc_feature (503)..(503): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcacctgaaggagtctggtcctacgctggtacgaaacccacacagaccctcacgctgacctgcaccttctctggttctcactcaactctagtggaggtgggtggtgggtcttgggttccgtcgacgcccccgaagggaaacggcccgtaggaagtgggtnactactttagtttagtgggtatcggtacggttaccgctacagtcccatcctgtagggaggaggacacctacaaccactaccccaaaccgaaacggaacccaaaacccccaaaaacgtaacgggtaccgttaacctaacaaagtaccgaacccaaccgagttacggacccgttagacggaacacgagtacccaataattatttccngtacacaactacctattaaggtagggacaccaccgttaggtactcgtacgaccgtaaacgtcgggttacccgaccccggtcgggggaaccccgtaacccgttcggtaccacccgtcttccgccacgcccaaccaccaacgggcccagttccggtcccttccccgtcgg

SEQ ID NO: 325642 - DNA, 577 bp, Homo sapiens
  misc_feature: GZ8MTXP01BNX7W.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggttgcacttatttattgggatgacggttaccgctacagtccatctctgaggaggagactcacatccaccaaggacaacccccaaaacaaggtacgtctacaatgacaccatcggaccctgtgacacagccacatatttctgtgcacactctagtaggagcaccgtgtacgtctgaccaaactgggttaccgaccccgtgggggccccgggaacccttgggtaccacccgttccgtcccttcgttacgcccgtcccacccgaacggggccccagttcccggtcctttcccccgtcgg

SEQ ID NO: 325643 - DNA, 662 bp, Homo sapiens
  misc_feature: GZ8MTXP01A9PPZ.22.38.D05.1.454.CMB.2.raw
  modified_base (454)..(454): a, c, t, g, unknown or other
  misc_feature (454)..(454): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgccccgaggaaaggccctggaatgggttgctacttatttatgggatgacggttaccgctacagtccatctctggaggaggagactcaccatacccaccaacggaccaaacccccaaaacgaacggtacggtcctaacaatcgaccaccagtacggaccctggtacggaaccacgacgacccaactaattacttttcngtacgcaactacttactagtaacgggataccaccgttggtacgtctacggaccctaaacgttccggggttacccgaccccggttcggggggaacccccggtaaccttcggggtaccccttacccggtccctcccgttacgccggttcccctaacccgacccgaaccggggcccctacgttcccgggttcccctttccccccggtcggg

SEQ ID NO: 325644 - DNA, 612 bp, Homo sapiens
  misc_feature: GZ8MTXP01CONCE.22.38.D05.1.454.CMB.2.raw
  modified_base (284)..(284): a, c, t, g, unknown or other
  misc_feature (284)..(284): n is a, c, g, or t
  modified_base (465)..(465): a, c, t, g, unknown or other
  misc_feature (465)..(465): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaggccctggaatgggttncacttatttattgggatgacggttaccgctacagtccatctctgaggaggagactcacatacccaccaaacggaccaaacccccaaaaaccgaacggtacggtcccttaacaaatcgaccaccactcggacccctgtcggacacacgaccacattatttctgtcgcacactctagtagganccactggtatcgtagacccaaacgttcggttacccgaccccggttcgggggccccgggtaacccgttgggtccacccggtcctccttccgcggttcccctccgacccgtaacggcccctacgttcccggttccgttcccccgtcggg

SEQ ID NO: 325645 - DNA, 610 bp, Homo sapiens
  misc_feature: GZ8MTXP01AZFJE.22.38.D05.1.454.CMB.2.raw
  modified_base (426)..(426): a, c, t, g, unknown or other
  misc_feature (426)..(426): n is a, c, g, or t
  modified_base (429)..(429): a, c, t, g, unknown or other
  misc_feature (429)..(429): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggtgcacttatttatggatgacgttacgctacagtcatctctgaggaggagactcaccatccaccaaaggaccaacccccaaaacaacgggtagtccttaacaaatcgaccaccatcggaccctgtaggacacagccacatattcngtncacactctagtaggagcaccgtggtagtctggacctaaacgtcgggttaccgaccccgtgggggccccgggtaaacccttggggtcccaccggttcctcccttccgcggttccccttaacccgaacccgtaaacgggggccccctacgttcccggggttcccctttccccccggtccgggg

SEQ ID NO: 325646 - DNA, 604 bp, Homo sapiens
  misc_feature: GZ8MTXP01BXYQ0.22.38.D05.1.454.CMB.2.raw
  modified_base (441)..(441): a, c, t, g, unknown or other
  misc_feature (441)..(441): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgcccccgaggaaaggccctggaatgggttgcacttattattgggatgacggttaccgctacagtcatctctgaggaggagactcaccatcccaaccaacggaaccaaccccaaaaccgaacggtggtccttacaaactcgaaccaccactcggaccctgtacggacacagccaatattatttcngtgcacactctagtaggagcctaccgtggtactctcgaacctaaacgttcgggttacccgaccccggtcgggggaaccccgggtaacccttggtccacccgtcctcccttccgacgcccttccgacccgaacgggcccacgttcccggtcccttccccgtcgg

SEQ ID NO: 325647 - DNA, 554 bp, Homo sapiens
  misc_feature: GZ8MTXP01A62CI.22.38.D05.1.454.CMB.2.raw
  modified_base (311)..(311): a, c, t, g, unknown or other
  misc_feature (311)..(311): n is a, c, g, or t
tcagacatacgcgtcacgaccggtgctcgatttagtatctgatagttgggtttgggggaggaactgctcagttaggacccagagggaaccatggaagccccagctcagcttctcttcctcctgctactctggctcccagataccaccggagaaattgtgttgacacagtctccagccaccctgtctttgtctccgggggaaagagccaccctctcctgcagggccagtcagaatgttagtagttacttagcctggtaccagcaaaagcctggccaggctcccagactcctcatctctgatacatccaaacngggccactggcactcccagccaggttcagtggcaggtcgggtctggggacagacttcactctcaccatcagcgactagacgcctagaacgtatttgcttagtttattactgtcagcagcgtaggctagtcgtcggcctccgtactaccgtttcggccgtaggggacctaagcgtaagggaagataacgaaacgtaacgtggttcgcttcgaaccacgtaattctagttcttcgaactttcccg

SEQ ID NO: 325648 - DNA, 573 bp, Homo sapiens
  misc_feature: GZ8MTXP01BCFYD.22.38.D05.1.454.CMB.2.raw
  modified_base (552)..(552): a, c, t, g, unknown or other
  misc_feature (552)..(552): n is a, c, g, or t
  modified_base (565)..(565): a, c, t, g, unknown or other
  misc_feature (565)..(565): n is a, c, g, or t
tcagacatacgcgtcacgaccggtgctcgatttagtatctgatagttgggtttgggggaggaactgctcagttaggacccagagggaaccatggaagccccagctcagcttctcttcctcctgctactctggctcccagataccaccggagaaattgtgttgacacagtctccagccaccctgtctttgtctccgggggaaagagccaccctctcctgcagggccagtcagaatgttagtagttacttagcctgtaccagcaaagcctggccaggctcccagacctcctcatctctgatacatccaaacgacgggccacgtcggacactccccacgcctaggttccaggtggcgaggtcggggtctggggacagaccttcactctcaccatcagcgactagatcctagaagtatttgactagtttattactgtctagcagtcgtaggctagttccgtcgtcccttaccgtacctaccgtttacgggccgtacgggggacccaaggcgtaaggaacgactaacgaaacgtaactggttacgcttacgctactntctgttcttaacnctttcccg

SEQ ID NO: 325649 - DNA, 539 bp, Homo sapiens
  misc_feature: GZ8MTXP01C7UB6.22.38.D05.1.454.CMB.2.raw
  modified_base (381)..(381): a, c, t, g, unknown or other
  misc_feature (381)..(381): n is a, c, g, or t
  modified_base (390)..(390): a, c, t, g, unknown or other
  misc_feature (390)..(390): n is a, c, g, or t
  modified_base (439)..(439): a, c, t, g, unknown or other
  misc_feature (439)..(439): n is a, c, g, or t
  modified_base (474)..(474): a, c, t, g, unknown or other
  misc_feature (474)..(474): n is a, c, g, or t
tcagacatacgcgtcacgaccggtgctcgatttagtatctgatagttgggtttgggggaggaactgctcagttaggacccagagggaaccatggaagccccagctcagcttctcttcctcctgctactctggctcccagataccaccggagaaattgtgttgacacagtctccagccacccgtgtctttgtcgtccgggggaaagagccaccctctcctgcagggcagtcagaatgttagtagttactagctgtaccagcaaagctggccaggctccagactctcatctctgatacatccaacgaggccactggcactcccagccaggttcagtggcagtcggtctgggacagacttcactctcacatcagcgactagacnctagaagtntttggacggtttattacgtgtcagcagcgtagctatctggcctcgtacnccgtttggaccgtaggggaccaaggctgggaacgnttacgaaacgacgttggaggcttggaccaacctattcctagtcctttacaacgttccgttccccg

SEQ ID NO: 325650 - DNA, 630 bp, Homo sapiens
  misc_feature: GZ8MTXP01C61YC.22.38.D05.1.454.CMB.2.raw
  modified_base (416)..(416): a, c, t, g, unknown or other
  misc_feature (416)..(416): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagccccaggaaggccctggaatgggtgcacttatttatggatgacgttacgctacagtccatctctgaggaggagactcacatccaccaacgaccaaccccaaaacaaggtcgtcctacaatgaccaccatcgaccctgtacgacacagccacattattcngtcacacactctaaggtacggagacctaccgtgggtactctacggaaccctaaacgttcgggttaccccgaccccggttcggggggaacccccgggtaaacccgttcggggtacccacccggttccctcccgttccgaccggttcccctaacccgaaacccgaaccgggggccccctacggttcccgggttccccttaacccccggtcccgggg

SEQ ID NO: 325651 - DNA, 582 bp, Homo sapiens
  misc_feature: GZ8MTXP01C8R8B.22.38.D05.1.454.CMB.2.raw
  modified_base (446)..(446): a, c, t, g, unknown or other
  misc_feature (446)..(446): n is a, c, g, or t
  modified_base (449)..(449): a, c, t, g, unknown or other
  misc_feature (449)..(449): n is a, c, g, or t
  modified_base (464)..(464): a, c, t, g, unknown or other
  misc_feature (464)..(464): n is a, c, g, or t
  modified_base (476)..(476): a, c, t, g, unknown or other
  misc_feature (476)..(476): n is a, c, g, or t
  modified_base (538)..(538): a, c, t, g, unknown or other
  misc_feature (538)..(538): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctggttctcactcaactctagtggagtgggtgtgggctggtccgtcagccccaggaaaggccctggaatgggtgcacttattatggatgacggttaccgctacagtcatctctgaggaggagactcaccatacccaaccaaaggaaccaaacccccaaaaaacgaacgggtacgggtcccttaaacgaaatacgaacccaaccatacggacccctgtacggacacagccacattattcngtncacactctataggancaaccgtggtanctgacctaaacgtggttccgaccccgtggggccccggaacttcgggtcaccgtcgtccttcncgccctccaccgaacggtccccagttccggtccttcccccgcgg

SEQ ID NO: 325652 - DNA, 621 bp, Homo sapiens
  misc_feature: GZ8MTXP01A06IM.22.38.D05.1.454.CMB.2.raw
  modified_base (451)..(451): a, c, t, g, unknown or other
  misc_feature (451)..(451): n is a, c, g, or t
  modified_base (454)..(454): a, c, t, g, unknown or other
  misc_feature (454)..(454): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctggttctcactcaactctagtggagtgggtgtgggctggttccgtcacgccccaggaacggcctggagtgggtgctacttatttatggatgacggttacgctacacgtccatctcgtgaggaggagactcaccactacccaccaaacggaacccaaacccccaaaaaccgaacgggtacgtccttaacaactcgacccacacgtcggaccctgtcggaaccacgacgccaactattactttcngtnctacactcgtaagtacggacgcctaccgtggtacgtctcgaccctaaacgttcgggttaccgaccccgggttcgggggaaccccggtaaccgttggtcccaccgttcctcccttcgcgcccctaaccgaccgaacgggcccctagttcccggtcccttcccccgcgg

SEQ ID NO: 325653 - DNA, 603 bp, Homo sapiens
  misc_feature: GZ8MTXP01B6JHW.22.38.D05.1.454.CMB.2.raw
  modified_base (434)..(434): a, c, t, g, unknown or other
  misc_feature (434)..(434): n is a, c, g, or t
  modified_base (470)..(470): a, c, t, g, unknown or other
  misc_feature (470)..(470): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagccccaggaacggcctggaatgggtgctacttatttatggatgacggtacgctacagtccatctcgtgaggaggagactcaccactaccccaaccgaaacggaacccaaacccccaaaacgacgggtacgtccttacaaatcgaacccactatcgaccctgcgaacacacgacctaanattacttcgtgtcacaactactacgtaagtaggacnccacgtggtactcgtcgaccgtaaactcgggttacccgacccggtcgggggaaccccggtaccttggtcccacggtcctccttacgcgcctcccgaccgaacggccctacgttccggtccctttccccggcgg

SEQ ID NO: 325654 - DNA, 572 bp, Homo sapiens
  misc_feature: GZ8MTXP01ANLME.22.38.D05.1.454.CMB.2.raw
  modified_base (368)..(368): a, c, t, g, unknown or other
  misc_feature (368)..(368): n is a, c, g, or t
  modified_base (412)..(412): a, c, t, g, unknown or other
  misc_feature (412)..(412): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggttgcacttatttattgggatgacggttaccgctacagtccatctctgaggaggagactcacatccaccagacaccccaaaccaagngtcctacatgaccacatgaccctgtgacacagccacatatttcngtgcacactctagtaggagcacccgtggtagtccttgccctaaactcgggttaccgacccccgtgggggaacccccgggtaacccgttcgggtccacccgtcgtcccttccgacgcccctccacccgaagggccccagttccggtccttcccccgtcggg

SEQ ID NO: 325655 - DNA, 612 bp, Homo sapiens
  misc_feature: GZ8MTXP01CUJHU.22.38.D05.1.454.CMB.2.raw
tcagacatacgcgtcacgaccggtgctcgatttagtatctgatagttgggtttgggggaggaactgctcagttaggacccagagggaaccatggaagccccagctcagcttctcttcctcctgctactctggctcccagataccaccggagaaattgtgttgacacagtctccagccaccctgtctttgtcgtccggggaaagagccaccctctcctgcagggccagtcagaatgttagtagttacttagcctggtaccagcaaaagcctggccaggcctcccagactcctcatctctgatacatcccaaacgagggccactggcactccccagccaggttcaggtggcgaggtcgggtcgtggggacaggacttccactcctacacctatcaggcgacctagacgtacctaggaagttattttgacttaaggttttactttactggtcagcagtcgtaggtctagttccgtcggtcccttcccgtaccgttacccgtttggacccgaaggggtacccaaggcgtcgggaagttacgtaaccgaaacggtaacgtggttacggcttacggaacctacctaacttctgttacccttccgttaacgtttccccg

SEQ ID NO: 325656 - DNA, 621 bp, Homo sapiens
  misc_feature: GZ8MTXP01DCAHN.22.38.D05.1.454.CMB.2.raw
  modified_base (311)..(311): a, c, t, g, unknown or other
  misc_feature (311)..(311): n is a, c, g, or t
  modified_base (441)..(441): a, c, t, g, unknown or other
  misc_feature (441)..(441): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctggttctcactcaactctagtggagtgggtgtgggctggtccgtcacgccccaggaaagccctggaatgggtgctacttagtttattgggatggacggttacnctacagtccatctctgaggagagactcacatacccaaccaacggaacccaaaccccaaaacaagggtacgtaaccttaaacaaatacgaccaccacgtcgaccctgacgacacataccacattactttcngacacaactacgtataggtacggactcgtacgtggtactcgtacgtaacccgtaacggtccggtaccccggaccccgggtccgggggaaccccggtacccgttcggtacccttcccgtcctccgccgaccgccctaacccgaaccgaaccggccctacgttccccgtcccgttccccgcg

SEQ ID NO: 325657 - DNA, 662 bp, Homo sapiens
  misc_feature: GZ8MTXP01AZ2AE.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgccccaggaacgcctggaatgggtgctacttatttagtggatggacggttaccgctacagtccatctctggaggaggagactacaccatacccaaccgaaacggaacccaaaccccccgaaaaaccgaacgggttacgggtaacccttaaacaaactacgaacccaccacgtacggacccctggtacggacacacgaccatattactttcagtcacaacactacgtaagtacggagccaccgtggtagtccgtacgacccgtaaacgttcgggttacccggaccccggtcgggggaaccccgggtaacccgttgggtccccacccggttcctcccttcgaccggttcccctaacccgaccggtaaccgggcccctagttccccggttcccgttcccccggtccgg

SEQ ID NO: 325658 - DNA, 555 bp, Homo sapiens
  misc_feature: GZ8MTXP01BUPLB.22.38.D05.1.454.CMB.2.raw
  modified_base (548)..(548): a, c, t, g, unknown or other
  misc_feature (548)..(548): n is a, c, g, or t
tcagacatacgcgtcacgaccggtgctcgatttagtatctgatagttgggtttgggggaggaactgctcagttaggacccagagggaaccatggaagccccagctcagcttctcttcctcctgctactctggctcccagataccaccggagaaattgtgttgacacagtctccagccaccctgtctttgtcgtccggggaaagagccaccctctcctgcagggccagtcagaatgttagtagttactagctggtaccagcaaaagcctggccaggctcccagactcctcatctctgatacatcccaaacacgggcccaactggcactccccagccagggttcagtggcaggtcgggtctgggacagacttcactctcaccatcagcgacctagagcctagaagtattttgcttagtttattactgtcagcagcgtaggctatcgtcggtccctcccgtacgtaccgtttcgggccgtacgggggacccaaaggccgtaagggaagactaacgaaacgaaacgtgttggcttgcacaatctgttcttcncgttccc

SEQ ID NO: 325659 - DNA, 711 bp, Homo sapiens
  misc_feature: GZ8MTXP01BZ07H.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtagaaacccacacagaccctcacgctgacctgcaccttctctggttctcactcaactctagtggagtgggtgtgggctggttccgtcacgcccccgaggaaacggccctaggaagtgggttgactactttagtttagtgggatggacggttaccgctacacgtccatctcgtaggaggaggagactacaccactacccaaccgaacggaacccaaacccccgaaaacgaagggttacgtcccttaaacaatacgaacccaccacgtacggaccctaggtacgaaccacgacgacccaactactttactttcgtcgtacgacctaactacttaccgttaaggtaacggtacgaccgtacccggttaggtacgtccgtacgaacccgtaaacgttccgggtacccgaccccgggtcgggggaaccccggtaacccgttcggggtacccacccggttcctcccgttaccgaccgccccctaacccggaacccggtaaccggggccccctacggttccccggggttcccctttcccccgggtccggg

SEQ ID NO: 325660 - DNA, 664 bp, Homo sapiens
  misc_feature: GZ8MTXP01EU39O.22.38.D05.1.454.CMB.2.raw
  modified_base (308)..(308): a, c, t, g, unknown or other
  misc_feature (308)..(308): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctggttctcactcaactctagtggagtgggtgtggctggtccgtcagccccaggaaagccctggaatgggtgcacttattagtggatgacggtacgctacngtcatctctgaggaggagactcacatacccaaccgaaacggaacccaaacccccaaaaaccgaacgggtacggttaacccttaacaaactacgaacccaaccactcgggaccccttggtacggaacacgacgaccaactaattacttttcgtaggtacaccaactacttacgtaagtaacggacgtaccaacccgttggtaacgtcctacggtaccaaacgttcggttacccggaccccgggtcgggggaaccccgggtaacccgttcggtcccttacccggtcctccgttcgccggccctccccgtaaccgaaccggggcccctacggttccggttccccgtttccccgcccggg

SEQ ID NO: 325661 - DNA, 610 bp, Homo sapiens
  misc_feature: GZ8MTXP01D5131.22.38.D05.1.454.CMB.2.raw
  modified_base (445)..(445): a, c, t, g, unknown or other
  misc_feature (445)..(445): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggtccgtcacgccccgaggaacggccctggaagtgggtgctacttatttagtggatggacggttaccgctacagtcatctctgaggaggagactcacactacccaaccgaaacgaaccaaaccccaaaacgaacggtacgtcctaacaaatacgaccaccactcggaccctgtacgacacacgtaccatattactttcngtcacaactactctaagtaggcgacctaccgttggtactctcgaaccgtaaacgtcgggttacccgaccccggtgggggaaccccggtaaccgttcgggtcccacccgtctcccttcgccgccctccgaccgtaacgggcccagttcccggtcccttccccgcgg

SEQ ID NO: 325662 - DNA, 707 bp, Homo sapiens
  misc_feature: GZ8MTXP01DZA5S.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagccccaggaaaggccctggaatgggttgctacttatttattgggatgacggttacgctacagtccatctctgaggaggagactcaccatacccaccaaacggaaccaaacccccaaaaaccgaaacggttacgggtccttaacaaactcgaaccaaccactcgggaccccttggtacggaacaacacggacccaactaactttacttttcctggttacgaccaaacctaaccttaccttaaagggttaacggggacggtaccctaacccgttagggttaacggtccttacggaaccccgtaaaacgttccggggtttaccccggaacccccgggttcggggggaacccccgggtaaacccgttcggggtacccaacccggtccctcccgttccaccgccccgtcccaacccgaacgggccccacgttcccgggtcccttcccccgtccggg

SEQ ID NO: 325663 - DNA, 734 bp, Homo sapiens
  misc_feature: GZ8MTXP01D3TAD.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtacgaaacccacacagaccctcacgctgacctgccacctctctgggttctcactcaactctagtggagtgggtggtgggcgtggtccgtcgacgccccaaggaaggcccgtggaagtgggtgctactttagttagttggatggtacggttaccgctacacgtccatctcgtggaggaggagactcaccactaccccgaaccgaaacggaacccaaacccccgaaaaaccgaacgggttacgtcccgttaaacaaacgtacgaacccaaccgaacgtacggggtacccctagggtacggaaccaacgacgacctaactaatttactttcgtgtacgaccaactaactacgtaagggttacggacgtacctaaccggttggtaacgtcgtaacgtaacccgtaaacggttccgggttacccggaacccccgggtcgggggaaccccgggtaaaccgttcggggttacccacccggttaccttccccgttaccgcccgttaccccgtaaccgaaaccccggaacgggtacccctcggtttccccggtcccgtttcccccggtcccgggg

SEQ ID NO: 325664 - DNA, 701 bp, Homo sapiens
  misc_feature: GZ8MTXP01EXGR2.22.38.D05.1.454.CMB.2.raw
  modified_base (452)..(452): a, c, t, g, unknown or other
  misc_feature (452)..(452): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgccccaggaaaggccctggaatgggtgctacttatttagtgggatgacggttaccgctacagtcatctctgaggagagactcacatccaccaagaaccctaaaccccaaaaccgaaggtacggtccttaacaaactacgacccaccactcggacccctaggtcgaaccacgaacgcccaactaattacttttcgnggttcacctaacctaacttccgttaaggtacggggtaacgtaccgtaacccgttgggttaaaccgtccgtacgtaacccgtaaaaccggttcgggtttaccccggaacccccgggttccggggggaacccccgggtaaaccccgttcggggtaacccttcccggtcctccccgttacgccggttcccctaacccgaaccggaaccggggcccctacggttccccggttccccgtttcccccggtccggg

SEQ ID NO: 325665 - DNA, 649 bp, Homo sapiens
  misc_feature: GZ8MTXP01BZQ0M.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtagaaacccacacagaccctcacgctgacctgccaccttctctggttctcactcaactctagtggagtgggtgtgggctggttccgtcacgccccgaggaaacggcccgtaggaacgtgggtgtctacttagtttagtggatggtacggttaccgctacacgtcatctcgtagaggagagactacacactacccaccaaacgaaccaaaccccaaaacgaagtacgtaacctaacaaatacgaacccacacgtacgggaccctagtacgaacacgacacccaatacttattctgtcacactacttactaggtaggactacctaccgtggtacgtctacgtaacccgtaaacgttccgggttacccgaccccggttcgggggaaccccggtaaccttcgggtaccttacgtccggtcttcccgttcgaccgcccctacccgaaccgaccgggacccttacgttcccggttcccgtcccccgg

SEQ ID NO: 325666 - DNA, 613 bp, Homo sapiens
  misc_feature: GZ8MTXP01DL01A.22.38.D05.1.454.CMB.2.raw
  modified_base (279)..(279): a, c, t, g, unknown or other
  misc_feature (279)..(279): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctggtctcactcaactctagtggagtgggtgtgggctggtccgtcacgccccaggaacggcctggatgggtnctacttattagtggatgacggtaccgctacagtccatctcgtgaggagagactcaccactacccaaccgaaacggaacccaaacccccaaaacccgaagggttacgtaaccttaacaaactacgacccaccacgtcgggaccctgtacgaacacacgcccattattatttcagtcgacactactactaggaggacgtcctacgtggtatctacgaaccctaacgtcggttacccgaccccggttcggggccccggtaaccgttggtcccaccgtctaccttcgccgcctaacccgacgaacggtcccctagttcccggttcccttccccgccgg

SEQ ID NO: 325667 - DNA, 533 bp, Homo sapiens
  misc_feature: GZ8MTXP01ACSTX.22.38.D05.1.454.CMB.2.raw
  modified_base (311)..(311): a, c, t, g, unknown or other
  misc_feature (311)..(311): n is a, c, g, or t
tcagacatacgcgtcacgaccggtgctcgatttagtatctgatagttgggtttgggggaggaactgctcagttaggacccagagggaaccatggaagccccagctcagcttctcttcctcctgctactctggctcccagataccaccggagaaattgtgttgacacagtctccagccaccctgtctttgtctccgggggaaagagccaccctctcctgcagggccagtcagaatgttagtagttacttagcctggtaccagcaaaagcctggccaggctcccagactcctcatctctgatacatccaaacnggccactggcatcccagccaggttcagtgcagtcgggtctgggacagacttcactctcaccatcagcacctagagcctgaagtatttgctagtttattactgtcagcagcgtaggcagtctcggcctccgtacaccgtttcggcctaggggaccaagcctaaggagatacgaaacgtaactggttacggcttcgcacctaactctcgttcttccgcttcccg

SEQ ID NO: 325668 - DNA, 630 bp, Homo sapiens
  misc_feature: GZ8MTXP01BEOGL.22.38.D05.1.454.CMB.2.raw
  modified_base (477)..(477): a, c, t, g, unknown or other
  misc_feature (477)..(477): n is a, c, g, or t
  modified_base (606)..(606): a, c, t, g, unknown or other
  misc_feature (606)..(606): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtacgaaacccacacagaccctcacgctgacctgcctaccttctctggttctcactcaactctagtggagtgggtgtggctggtccgtcacgccccgaggaacggcctggaagtgggtgctacttagttagtggatgtacggttaccgctacacgtccatctcgtaggaggaggagactacacactacccaaccgaaacgaacccaaaccccaaaaccgtaacggtacgtccctacaacaactacgaccacacgtcggacctgaggacacacgcatattacttctagctacaactctactagaacgggcnccgtaacgtgttacgtcgtacgacctaaacggttccggtacccggaccccggtccgggggaccccgttaacgtccggttccacccggtcttacccgttcaaccgtcctaccccgaacggcccgtacccncggttcccgttcccgttcccccgg

SEQ ID NO: 325669 - DNA, 671 bp, Homo sapiens
  misc_feature: GZ8MTXP01C1RZA.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtacgaaacccacacacgaccctcacgctgacctgcaccttctctggttctcactcaactctagtggagtgggtgtggctcggtccgtcacgccccgaggaacggcctaggaagtgggtgctactttatttagtggatcgacggttacgctacagtccatctcgtgaggaggacgactcacactacccaaccgaacgaccaaaccccaaaacgtaacggtacgtaacctaacaactacgaaccaccacgtacgaccctgtacgacacgacgaccatattactttcacgtcgactacctactactagacggtacgtacgtaccgtggtactccgtacgtaacccgtaaacgttccgggttaccccggaccccggtccgggggtaacccccggtaacccgttcgggtacccacccgttcccgtcccttaccgccgacccctaacccggaaacccggtaaccgggtcccctaacggttccccggttcccgttccccccggttccggg

SEQ ID NO: 325670 - DNA, 703 bp, Homo sapiens
  misc_feature: GZ8MTXP01EGDH4.22.38.D05.1.454.CMB.2.raw
  modified_base (233)..(233): a, c, t, g, unknown or other
  misc_feature (233)..(233): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggngtgggtgtgggctggtccgtcacgccccaggaaggcctggaatgggtgcacttatttatgggatgacggttaccgctacagtccatctctggaggaggagactcaccatacccaccgaaacgaaccaaacccccaaaaaccgtaacgggtacgtaacccttaacaaactacgacccaaccacgtacgggaccctggtacggacaacgacgcccaactattactttctggtcaccaactaaccttaccgtaaggtaacgggacgaccgtacccgtaggggttacgtcgtcggtaacccttaaaacgtccgggttaccccggacccccgggttcggggggaaccccccgggtaaacccggttcgggtaccccgttacccggtcccttcccgttacccgccggttcccctaaccccgaacccgtaaccggggccccctacgttcccgggttccccgtttcccccgtcccgggg

SEQ ID NO: 325671 - DNA, 663 bp, Homo sapiens
  misc_feature: GZ8MTXP01BSEX9.22.38.D05.1.454.CMB.2.raw
  modified_base (582)..(582): a, c, t, g, unknown or other
  misc_feature (582)..(582): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctggttctcactcaactctagtggagtgggtgtggctggttccgtcagcccccaggaaaggccctggaatgggtgcacttatttatggatgacggttaccgctacagtccatctcgtgagggagacgactcacacacccaacgaacgaaccccaaaccccgaaacgtaacggtccgtaactaacaactacgaccacgacgtaccgactgacgacacacgaccatattcttatgtacacaactacttacgtaggtacggactccgtacggttcggtagtccgtaccgtaaaccgtaacggttccggtaccccggtacccggggtcccgggggaaccccggtaaccgttccggtaacccgttccgttccccgtaccnccgttacccgttcccctaaccccgaacccgggaaccggtaccccgtcggttcccccgttccccgtttccccggtccccggg

SEQ ID NO: 325672 - DNA, 609 bp, Homo sapiens
  misc_feature: GZ8MTXP01BUXGL.22.38.D05.1.454.CMB.2.raw
  modified_base (410)..(410): a, c, t, g, unknown or other
  misc_feature (410)..(410): n is a, c, g, or t
  modified_base (423)..(423): a, c, t, g, unknown or other
  misc_feature (423)..(423): n is a, c, g, or t
  modified_base (431)..(431): a, c, t, g, unknown or other
  misc_feature (431)..(431): n is a, c, g, or t
  modified_base (453)..(453): a, c, t, g, unknown or other
  misc_feature (453)..(453): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctggttctcactcaactctagtggagtgggtgtgggctggtccgtcagcccccaggaaacggccctggaagtggtgcacttattatgggatgacggttaccgctacagtccatctctgaggagagactcacatacccaccaacggaaccaaaccccaaaacaacggtacgtcctaacaaatacgaccaccacgtcgaccctgngacacacgaccanattattcngtgcacacttactagtaggacncctaccgtggtactcctgacccgaaacgttcgggttacccgaccccgggttcgggggaaccccggtaacccttcgggtacccacccgttcctcccttaccgcgcccctaaccgacccggaacgggcccctacgttcccggtcccctttccccgcgg

SEQ ID NO: 325673 - DNA, 643 bp, Homo sapiens
  misc_feature: GZ8MTXP01D603O.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggtccgtcacgccccaggaaacggccctggaagtgggttgctacttatttagttgggatgacggttaccgctacagtccatctctgaggaggagactcacactacccaaccaaacggaacccaaacccccaaaaaccgaacggtacggtccttaaacaaactacgaacccaaccacgtacgggaccctgtacggaacacgacgacccaatattactttctgtacacactactctaaggtacggagcctaccgtggtacgtccgtacgaaccctaaacgttcggttacccgaccccggttcgggggaaccccggtaaccgttcgggtccacccggtcctacccttcgcgccctaaccgaccgaaccgggcccacgttcccggtccctttccccgcggg

SEQ ID NO: 325674 - DNA, 628 bp, Homo sapiens
  misc_feature: GZ8MTXP01CD4O8.22.38.D05.1.454.CMB.2.raw
  modified_base (434)..(434): a, c, t, g, unknown or other
  misc_feature (434)..(434): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggcttgttccgtcagcccccaggaaaggccctggaatgggttgctacttatttattgggatgacggttaccgctacagtccatctctgaggaggagactcaccatcccaaccaaggaccaacccccaaaaccacggtacggtcctacaaatcgaccacagtcgaccctgtggacacacgccacattatttcngtcgctacactctagtaggagccaccgtggtacgtctacgacccgaaacgttcgggttacccgaccccggttcggggggcccccgggtaaccccgttcggggtcccacccggttcctcccgttacccgacgcccctcccgaacccgaacggggcccctaggttccccgggttccccgttcccccccgggccccg

SEQ ID NO: 325675 - DNA, 542 bp, Homo sapiens
  misc_feature: GZ8MTXP01A2D5X.22.38.D05.1.454.CMB.2.raw
  modified_base (388)..(388): a, c, t, g, unknown or other
  misc_feature (388)..(388): n is a, c, g, or t
  modified_base (394)..(394): a, c, t, g, unknown or other
  misc_feature (394)..(394): n is a, c, g, or t
  modified_base (399)..(399): a, c, t, g, unknown or other
  misc_feature (399)..(399): n is a, c, g, or t
  modified_base (406)..(406): a, c, t, g, unknown or other
  misc_feature (406)..(406): n is a, c, g, or t
  modified_base (412)..(412): a, c, t, g, unknown or other
  misc_feature (412)..(412): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggttgcacttattattgggatgacggttaccgctacagtccatctctgaggaggagactcacatccaccaagacaccccaaacagtgtctacatgacacatgacctgngacacngccanatattcngtgcanactcataggagcacctggtacgtctgaccaaactcggttccgaccccgtgggggccccggaaccttgggtccaccgtctcccttcgcgccctccaccgaagggccccagttccggtccttcccccgtcgg

SEQ ID NO: 325676 - DNA, 661 bp, Homo sapiens
  misc_feature: GZ8MTXP01DPD54.22.38.D05.1.454.CMB.2.raw
  modified_base (457)..(457): a, c, t, g, unknown or other
  misc_feature (457)..(457): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctggttctcactcaactctagtggagtgggtgtgggctggtccgtcacgccccgaggaaacggccctggaagtgggtgctacttatttagttggatgacggttaccgctacacgtcatctcgtggaggaggagactcaccactaccaaccaaacggaacccaaacccccaaaaacgtaacgggttacgtcccttaacaaatacgaaccaccacgtcggacccttggacgaacacagaccatattatttcnggtcacacattactaagtacggactcctacgtaggtactctacgacctaaacgttcgggtaccccgtaccccgggtccgggggaaccccggtaacccgttcgggtcccttaacccggttcctccccgttaccgccgcccctaacccgaacccggtaaccgggccccttaacggttcccggtttccccgttcccccggtcccggg

SEQ ID NO: 325677 - DNA, 548 bp, Homo sapiens
  misc_feature: GZ8MTXP01DOP4V.22.38.D05.1.454.CMB.2.raw
  modified_base (412)..(412): a, c, t, g, unknown or other
  misc_feature (412)..(412): n is a, c, g, or t
  modified_base (505)..(505): a, c, t, g, unknown or other
  misc_feature (505)..(505): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggttgcacttatttattgggatgacggttaccgctacagtccatctctgaggaggagactcacatccaccaagacaccccaaaacagtgtctacaatgacacatggaccctgtgacacagccacatatttcngtgcacactctaagtaggagcacctggtagtctgacccaaactggttaccgacccgtgggggccccggaaccttgggtccaccgtctccttcncgccctccaccgaacgggcccagttccggtcctttccccgcgg

SEQ ID NO: 325678 - DNA, 682 bp, Homo sapiens
  misc_feature: GZ8MTXP01EYUZY.22.38.D05.1.454.CMB.2.raw
  modified_base (179)..(179): a, c, t, g, unknown or other
  misc_feature (179)..(179): n is a, c, g, or t
  modified_base (482)..(482): a, c, t, g, unknown or other
  misc_feature (482)..(482): n is a, c, g, or t
  modified_base (487)..(487): a, c, t, g, unknown or other
  misc_feature (487)..(487): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtagaaacccanacagaccctcacgctgacctgcaccttctctggttctcactcaactctagtggagtgggtgtgggctggtccgtcacgcccccgaaggaaacggccctggaatgggtgctacttatttatgggatggacggttaccgctacagtccatctcgtgaggaggagactacaaccataccccaaccgaaacggaacccaaaaccccccaaaaaaccgaacgggttacggtccctttaaacaaacgtacgaacccaaccgaacgtcgggaaccctgtacggaccacgacgaccataacttattttccnggtanaccaactacttacgtaagtagggactaccgaccgtggtaacgtcgtacgaacccgtaaaacgttccggttcccggaacccccgttcggggggaacccccggtaaacccgttcggggtaccttcccggtcctaacccttcgacgccctaacccgaccgaaccggccctacgttcccgttcccgttccccgtccggg

SEQ ID NO: 325679 - DNA, 555 bp, Homo sapiens
  misc_feature: GZ8MTXP01D7GJC.22.38.D05.1.454.CMB.2.raw
  modified_base (405)..(405): a, c, t, g, unknown or other
  misc_feature (405)..(405): n is a, c, g, or t
  modified_base (413)..(413): a, c, t, g, unknown or other
  misc_feature (413)..(413): n is a, c, g, or t
  modified_base (416)..(416): a, c, t, g, unknown or other
  misc_feature (416)..(416): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggtccgtcagccccaggaagccctgatggtgcacttattatggatgacggttaccgctacagtccatctctgaggaggagactcacatccaccaaagaccaaccccaaaacgaacgtacgtcctacaatcgaccacatcggaccctgcgacacagccanatatttcngtncactatctagtaggagcaccgtggtatctagaccctaaactcggttacccgaccccgtcgggggcccggtaacccttgggtccaccgtcctcccttcacgccctaacaccgaacggccacgttccggtccttccccgcg

SEQ ID NO: 325680 - DNA, 598 bp, Homo sapiens
  misc_feature: GZ8MTXP01D7IFK.22.38.D05.1.454.CMB.2.raw
  modified_base (430)..(430): a, c, t, g, unknown or other
  misc_feature (430)..(430): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaaacccacacagaccctcacgctgacctgcaccttctctgggttctcactcaactctagtggagtgggtgtgggctggtccgtcacgccccaggaaaggcctggaatggtgcacttattattgggatgacggttaccgctacagtccatctctgaggaggagactcacatccacaacgaaccaaccccaaaaccaacggtacgtcctaacaactacgaccaccatcggaccctgtcgaacacagccatattattctgtncactactctaagtacggagcaccgtggtacgtctacgacctaaacgtcggttaccgaccccggttcgggggaaccccgggaaccttcgggtcccgttaccggtcctcccttcgccgttccctcccgaaccgaacgggccctacgttccggttcccttccccgtccggg

SEQ ID NO: 325681 - DNA, 680 bp, Homo sapiens
  misc_feature: GZ8MTXP01AG8AK.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctggttctcactcaactctagtggagtgggtgtgggctggttccgtcacgccccgaggaacggccctggaagtgggttgctacttatttagttgggatggacggttaccgctacacgtcatctcgtggaggaggagactcacactacccaaccaacggaacccaaacccccgaaaaccgaacgggtacggttaacccttaacaacgtacgaacccaaccacgtacgggacccttaggtacggaacacgacgacccatattactttctgtacgacaactacttactaggtacggacgtccaaccggttgggtactcgtacgacccgtaaacgttcgggttacccgaccccgggtcgggggaaccccgggtaacccttcggggtacccttacccggttcctcccttcccgacgttcccctcccgaaccgtaaccggggcccctacggttccccggtcccgttcccccggtccggg

SEQ ID NO: 325682 - DNA, 659 bp, Homo sapiens
  misc_feature: GZ8MTXP01CD2IW.22.38.D05.1.454.CMB.2.raw
  modified_base (315)..(315): a, c, t, g, unknown or other
  misc_feature (315)..(315): n is a, c, g, or t
  modified_base (444)..(444): a, c, t, g, unknown or other
  misc_feature (444)..(444): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctggttctcactcaactctagtggagtgggtgtgggctggttccgtcacgccccgaggaacggcctggagtggtgctacttattagttggatgacggttaccgctacngtccatctctggaggaggagactcaccactacccaaccaaacggacccaaaccccaaaacgaacgggtacgtaacctaacaactacgaccacactcggaccctgtacgacacacgaccatattatttcngacaccactactacgtagtacggacactaccggtaggtacgtcgtacgtaacccgtaaacgttccgggttaccccgccccggtccggggggtaaccccggtaaacccgttcggggtaccccttacccggttaccctcccgttaccgccgacccctaacccgaacccgaaccgggtccccctacggttcccgggttcccccttcccccggtccggg

SEQ ID NO: 325683 - DNA, 599 bp, Homo sapiens
  misc_feature: GZ8MTXP01DCCV6.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctggttctcactcaactctagtggagtgggtgtgggctggttccgtcagccccaggaaaggccctggaatgggttgcacttatttattgggatgacggttaccgctacagtccatctctgaggagagactcacatccaccaaaggaccaaccccaaaaccaacggtagtccttacaatcgaccacatcggaccctgtggacacgagccaacatatttctgtgcacactctagtaggagcaaccgtggtacgtctgaccctaaacgttcgggttacccgaaccccggttcgggggaaccccggaacccttgggttacccaccggttcctccttaccgcggcccctccaacccgaacggggccccacgttcccgggtcccttcccccgtccggg

SEQ ID NO: 325684 - DNA, 632 bp, Homo sapiens
  misc_feature: GZ8MTXP01EDD1L.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggtccgtcacgccccaggaaggccctggaatgggtgctacttatttatggatgacggttaccgctacagtccatctctgaggaggagactcaccactacccaaccaaacggaacccaaacccccaaaaaaccgaacgggttacggtaaccctaacaaactacgaccaaccatacgggacccctgtacggacacaacgccaactattactttctgtcacaactacttctaagtacggagccaaccgttggtactcgtcgacctaaacgttcgggttacccgaccccgtcgggggccccggtaaccgttcggggtaccacccggtcctcccttcgccgccctaacccaccgaacgggccctacgttccggttcccgttccccgtccgg

SEQ ID NO: 325685 - DNA, 713 bp, Homo sapiens
  misc_feature: GZ8MTXP01BY1P4.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggtccgtcacgcccccaggaaaggccctggaatgggtgcacttatttagttggatgacggttaccgctacagtccatctctgatgagagactcaccactcaacaaacggaccaaacccccaaaaaaaaccacggtcggtaccttaaacaatacgaacccaccaagtcggacccctgtaggaaccacgacgacctaacctattaactttccaggttcaccaaactaccgttactaaagttaacgggacggaccctaaaccgttgggtaaacggtccttacggaaccctaaaaccgttcgggttaccccgaacccccggttaacggggggaccccccgggttaaacccgttcggggccctaaccccggttccttcccccggttcaaacccggtcccccttaccccgaaccccggtaaaccggggccccccttaaacggttccccggggtttcccctttccccccccggg

SEQ ID NO: 325686 - DNA, 673 bp, Homo sapiens
  misc_feature: GZ8MTXP01AMUPB.22.38.D05.1.454.CMB.2.raw
  modified_base (437)..(437): a, c, t, g, unknown or other
  misc_feature (437)..(437): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtacgaaacccacacagaccctcacgctgacctgcaccttctctgggttctcactcaactctagtggagtgggtgtgggctggtccgtcacgccccaggaacgcctggaatggtgctacttattagtgggatgacggttaccgctacacgtccatctctgaggagagactcaccatacccaccgaacgaacccaaaccccaaaacgaacggtacgtcctacaatcgaccacactacggaccctgtacgacacgacgaccatattatttcngtcgacaactactacgtaaggtaggacgtcctaacccgttgggtaactcctacggtaaccctaaacggttccgggttaccccggaccccgggtcggggggaacccccgggtaacccgttccggggtcccttaacccggttcccgtaccccttaccgccggttacccccgtaacccgaaccccggtaaccggggtccccctacggttccccggggttccccttccccccggtccggg

SEQ ID NO: 325687 - DNA, 733 bp, Homo sapiens
  misc_feature: GZ8MTXP01DAF5K.22.38.D05.1.454.CMB.2.raw
  modified_base (478)..(478): a, c, t, g, unknown or other
  misc_feature (478)..(478): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtagaaacccacacagaccctcacgctgacctgctaccttctctggttctcactcaactctagtggagtgggtgtgggctggttccgtcacgccccgaaggaaacggcccgtaggaagtgggtgctacttagttagtggatgacgttaccgctacacgtccatctcgtgaggagagactacacactacccaaccaaacggaacccaaacccccaaaacgaacgggttacgtaacccttaaacaaacgtacgaaccaccacgtacggaacccctgacgaaccacgacgacctaactatttactttccaggtnaccaactacgttacctaagggttacgggaacgtccgtaacccgttaggtacgttaccgtccggtaaacccgtaaaaccggttcggggtttacccccgaacccccggggttccggggggaaccccccggtaaacccggttccgggtacccttacccggttcccgtaccccttacgcccgccccgttaacccgaaccccggtaaccggggtcccctaacgggttccccgggtttccccctttcccccggtcccgggg

SEQ ID NO: 325688 - DNA, 590 bp, Homo sapiens
  misc_feature: GZ8MTXP01EAC7R.22.38.D05.1.454.CMB.2.raw
  modified_base (434)..(434): a, c, t, g, unknown or other
  misc_feature (434)..(434): n is a, c, g, or t
  modified_base (453)..(453): a, c, t, g, unknown or other
  misc_feature (453)..(453): n is a, c, g, or t
tcagacatacgcgtcacgaccggtgctcgatttagtatctgatagttgggtttggggagtgactcctgtacccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggtcgcagccccaggaagcctggaatggtgctacttatttagtggatgacggttaccgctacaatccatctctgaggaggagactcacatcaaccccaacggaccaaaccccaaaaacgacggtacgtacccttaacgaactagacccaccagtcggacctgtagacacacgccacattatttctgtcncacactactagtagggganctacctggtactctcgacgaaaaccgttcgggtccgaaccccggtcgggggccccgggtaacctgggttcccaccgttcgtcctcacgcccttaccgaaccaacgggcccacttcgggttccttccccgttcgcccg

SEQ ID NO: 325689 - DNA, 652 bp, Homo sapiens
  misc_feature: GZ8MTXP01CTZV2.22.38.D05.1.454.CMB.2.raw
  modified_base (458)..(458): a, c, t, g, unknown or other
  misc_feature (458)..(458): n is a, c, g, or t
  modified_base (481)..(481): a, c, t, g, unknown or other
  misc_feature (481)..(481): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtggctggttccgtcacgcccccgaggaacggccctggaagtgggttgctacttatttagttgggataggtacggttaccgctacacgtcatctctggaggaggagactcacactacccaaccaaacggacccaaaccccaaaaccgaacgggtcggtcctacaaatacgaccaccacgtcggaccctgtacgaacacacgaccaactattacttttcngtcacactactctagtacgggancctacgtggtacgtcgtacgaccctaaacgtcgggttacccggaccccggttcggggggaacccccggtaaccgttcggggtacccacccggtcctcccgttaccgcgttccccgtaacccgacccggtaacgggcccctacgttccccgggtcccctttcccccggcggg

SEQ ID NO: 325690 - DNA, 746 bp, Homo sapiens
  misc_feature: GZ8MTXP01EH704.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtacgaaacccacacagaccctcacgctgacctgcaccttctctgggttctcactcaactctagtggagtgggtgtgggctggtccgtcacgccccgaggaaacggccctaggaagtgggtgctacttatttagtgggatggacggttaccgctacacgtccatctctgaggagagactcacactacccaaccaaacggaacccaaacccccgaaaaaccgaacgggttacggtaacccttaaactaaactaccgaacccaaccgacgtccgggtaccccttggacggaaccaacgacgaccctaacgttaaactttacgttttctacggttacaccctaaactaaccgttaccgttaaagggtaacggggaacgtaccgtaacccggttagggtaccgttccgtacggtaaacccgtaaaccggttccggggttaaccccggacccccggggttcggggggaacccccggtaacccgttcggggaccccttaacccggtcctacccgttaccgaccggttcccctaacccgaaccggaaccggcccctacgttcccggtccccgtttccccggtccgg

SEQ ID NO: 325691 - DNA, 655 bp, Homo sapiens
  misc_feature: GZ8MTXP01DV26R.22.38.D05.1.454.CMB.2.raw
  modified_base (455)..(455): a, c, t, g, unknown or other
  misc_feature (455)..(455): n is a, c, g, or t
  modified_base (458)..(458): a, c, t, g, unknown or other
  misc_feature (458)..(458): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggtccgtcacgccccaggaaggccctggaatgggtgctacttatttattgggatgacggttaccgctacagtccatctctggaggaggagactcaccatacccaaccaacggaccaaacccccaaaaaccgaacggtacggtcccttaacaaatacgacccaaccactcgggaacccctggtcggaacaacagccaactaattatttcngtncaacactctaaggtacggagcctaccgtggtagtctacgaaccctaaacgtgggtttacccgacccccggttcggggggaacccccgggtaaacccgttcgggtacccacccggttccttcccgttaccgccggacccctaacccaaaccccgaacggggccccacgttcccggttccccgttcccccggtcccggg

SEQ ID NO: 325692 - DNA, 633 bp, Homo sapiens
  misc_feature: GZ8MTXP01D2L1Q.22.38.D05.1.454.CMB.2.raw
  modified_base (442)..(442): a, c, t, g, unknown or other
  misc_feature (442)..(442): n is a, c, g, or t
  modified_base (462)..(462): a, c, t, g, unknown or other
  misc_feature (462)..(462): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagacccctcacgctgacctgcaccttctctgggttctcactcaactctagtggagtgggtgtgggctggttccgtcacgcccccgaaggaaacggccctggaagtgggttgctactttatttagtgggatggacggttaccgctacagtccatctcgtggaggaggagactcaccatacccaaccaaacggacccaaacccccaaaaccgacgggttacgtcccttaacaaactacgacccaccagtcggacctgtcgaacncagccaatattatttctgtnaccatactctaagtaggactccgaccgttggtacgtctagacctaaacgttccgggttaccgaccccggtcgggggaaccccgtaccgttcggtcccttaccgtccttccttacgccgccctaacccgaccgaacgggtccccaggttcccggttcccgttcccccgtcgg

SEQ ID NO: 325693 - DNA, 647 bp, Homo sapiens
  misc_feature: GZ8MTXP01BCY7I.22.38.D05.1.454.CMB.2.raw
  modified_base (423)..(423): a, c, t, g, unknown or other
  misc_feature (423)..(423): n is a, c, g, or t
  modified_base (434)..(434): a, c, t, g, unknown or other
  misc_feature (434)..(434): n is a, c, g, or t
  modified_base (437)..(437): a, c, t, g, unknown or other
  misc_feature (437)..(437): n is a, c, g, or t
  modified_base (457)..(457): a, c, t, g, unknown or other
  misc_feature (457)..(457): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgatggtgaaacccacacagaccctcacgctgacctgcaccttctctgggttctcactcaactctagtggagtgggtgtgggctggttccgtcagcccccaggaaaggccctggaatgggttgcacttatttattgggatgacggttaccgctacacgtcatctctgaggagagactcacatccaacaacggaaccaaccccaaaaccaacggtcgtcctacaactacgaccacatcggaccctgtacggacacgagccanaattactttcngtncactactacctagtacggancctaccgttggtacgtctacgaccctaaacgttcgggttacccgacccccggttcggggggaacccccgggtaaacccgttcgggtcccttaacccggttccttcccggttccacggttccccttaacccgacccgtaaaccgggggcccctaacggttccccggggttcccttttccccccggtccggg

SEQ ID NO: 325694 - DNA, 708 bp, Homo sapiens
  misc_feature: GZ8MTXP01CVG7C.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctggttctcactcaactctagtggagtgggtgtgggctggttccgtcacgcccccgaggaaacggccctggaagtgggtgctactttatttagtgggatggtacggtaccgctacacgtccatctcgtgaggaggagactcacactacccaaccgaaacgacccaaaccccaaaacgtacggtacgtcctaacaactacgaccaaccgatcggaccctgtacggaaccacgacgaccaactattaactttctcggtagacctaactaacgttcctaagggttaacgggacgtaccgtaacccggttagggtaccgtcgtaaccgtaacccgtaaaaccggttccgggtttaccccggacccccgggttccggggggaacccccgggtaaacccgttcgggtaccccttaccggttccctccccgttaccgccgttaccccgtaacccgaaccccggtaacggggcccctacggttcccgttccccgttcccccggtccggg

SEQ ID NO: 325695 - DNA, 680 bp, Homo sapiens
  misc_feature: GZ8MTXP01A0M6C.22.38.D05.1.454.CMB.2.raw
tcagacatacgcgtcacgaccggtgctcgatttagtatctgatagttgggtttgggggaggaactgctcagttaggacccagagggaaccatggaagccccagctcagcttctcttcctcctgctactctggctcccagataccaccggagaaattgtgttgacacagtctccagccaccctgtctttgtcgtccgggggaaagagccaccctctcctgcagggccagtcagaatgttagtagttacttagcctggtaccagacaaagcctggccaggctcccagactctcatctctgatacactaccaaacgacgggccacgtcggacactccccagccgtaggttcgaggtggcgaggtcgggtcgtaggggacagtaccttacgacctctacaccgataccgacggtaccgaaccgtaggacgtaccgtaggtaaagttagttttcgactttaacggttttacttacgttcgtacgacgacgtagtacggttaggccgtaacgttccgtaccgggtaccccttacccggttaacccgttacccggtttacggggaccccggtaacgggggtaaccccaagggtcccgttaagggaacgttaacgttaaccgaaacgtaacgttggttacggcttacggaacctactaattccgtgttaccttcgttaactttccccg

SEQ ID NO: 325696 - DNA, 714 bp, Homo sapiens
  misc_feature: GZ8MTXP01DONG7.22.38.D05.1.454.CMB.2.raw
  modified_base (454)..(454): a, c, t, g, unknown or other
  misc_feature (454)..(454): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgccccaggaaggccctggaagtgggtgctacttattagttgggatgacggttaccgctacacgtccatctcgtgaggaggagactcacactacccaaccaacggaacccaaacccccaaaaccgaacgggtacgtccctaacaactacgaccaccagtacggaccctgtacggacacacgacctaatattactttcngtcacactacgttctaagggtaacggcgtaccgtaccgttagggtacgttaccgtacggtaaaccccgtaaaaccggttccggggttaccccgggaaccccccgggttcggggggaacccccccgggtaaacccgttcgggggtaccccttaccccgggttccctcccgttacccgccgttacccccgttaacccgaaacccgggaaccgggttcccccgtacggttccccgggtttcccccgttcccccggttcccggg

SEQ ID NO: 325697 - DNA, 607 bp, Homo sapiens
  misc_feature: GZ8MTXP01BKSQS.22.38.D05.1.454.CMB.2.raw
  modified_base (317)..(317): a, c, t, g, unknown or other
  misc_feature (317)..(317): n is a, c, g, or t
  modified_base (437)..(437): a, c, t, g, unknown or other
  misc_feature (437)..(437): n is a, c, g, or t
  modified_base (463)..(463): a, c, t, g, unknown or other
  misc_feature (463)..(463): n is a, c, g, or t
  modified_base (539)..(539): a, c, t, g, unknown or other
  misc_feature (539)..(539): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaacggccctggaatgggtgcacttatttatgggatgacggttaccgctacngtccatctctgaggaggagactcaccatcccaccaaacggaccaacccccaaaaccgacgggtacgtccttagaatcgaccaccagtcggaccctgtcgacacacgaccatatatttacngtcgacacactacgtaagtagggacncaccgttggtaagtctgacctaaacgttcgggttccgaccccggtgggggaaccccggtaaccgttcgggtacccnccggtcctccgttccacggcccctccgacccgaacgggccccagttcccgggtcctttcccccgcggg

SEQ ID NO: 325698 - DNA, 698 bp, Homo sapiens
  misc_feature: GZ8MTXP01CP1F6.22.38.D05.1.454.CMB.2.raw
  modified_base (286)..(286): a, c, t, g, unknown or other
  misc_feature (286)..(286): n is a, c, g, or t
  modified_base (464)..(464): a, c, t, g, unknown or other
  misc_feature (464)..(464): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctggttctcactcaactctagtggagtgggtgtggactggttccgtcacgccccgaggaacggccctggaagtgggttnctacttatttagttggatgacggttaccgctacacgtcctatctcgtagacggaggacgacctacaccactacccaaccgaaacggaacccaaacccccaaaacgacgggttacgtaacccttacgaaactacgaccacacgtacgaccctgtacgacacagccaactattactttcncgtgacctaacctacttaccgtagttaacgggacgtaccgtaccgttacggtcgtaccgtacgtaaccccgtaaacgttccggggttaccccgaaccccgggttccgggggaaccccccggttaacgttccggggttcccacccggttcctcccgttacccgttacgccccgttaacccgaacccggtaaccgggtcccctacggttcccgggttcccctttcccccgggtcgg

SEQ ID NO: 325699 - DNA, 624 bp, Homo sapiens
  misc_feature: GZ8MTXP01CDKY1.22.38.D05.1.454.CMB.2.raw
  modified_base (432)..(432): a, c, t, g, unknown or other
  misc_feature (432)..(432): n is a, c, g, or t
  modified_base (441)..(441): a, c, t, g, unknown or other
  misc_feature (441)..(441): n is a, c, g, or t
  modified_base (445)..(445): a, c, t, g, unknown or other
  misc_feature (445)..(445): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgccccaggaaacggccctggaatgggtgctacttatttatgggatggacggttaccgctacagtccatctctgaggaggagactcaccatcccaaccaacggaaccaacccccaaaaccgaacggtacgtcctaacaatacgaccaccatacggaccctgtacggacacagccanattacttcngtcncacactctagtaggacgcaaccgtggtacgtcctagaccctaaacgttcgggttccgaccccgttcgggggaaccccggtaaccgttcgggtaccttacccgtcctcccgttaccgcgccccttaacccgaacccgaaccgggcccctagttccccgggttccccttcccccgtccggg

SEQ ID NO: 325700 - DNA, 684 bp, Homo sapiens
  misc_feature: GZ8MTXP01AVA7Z.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtagaaacccacacagaccctcacgctgacctgcaccttctctggttctcactcaactctagtggagtgggtggtgggctggttccgtcacgccccgaggaaacggccctggaatgggtgctactttattagtgggatgacggttaccgctacagtccatctcgtaggaggaggagactacaccactaccccaaccaacgaacccaaacccccaaaaccgaacggtacgtcctaacaactacgaccacacgtcggtaccctagtacggacacgacgaccaatacttatttccgtagtcacctactacttaccgtaaggtaacgggagtccgtaacccgttgggtaacgttccgtacgaaccgttaaaccgttccggggttaccccgacccccgggttcggggggaacccccgtaaccggttcggtacccgacccggttcctcccgttcgaaccgttccccctaaccgacccgaaccggggtcccctacggttcccgttccccgttcccccggtcggg

SEQ ID NO: 325701 - DNA, 702 bp, Homo sapiens
  misc_feature: GZ8MTXP01CRRKV.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctggttctcactcaactctagtggagtgggtgtgggctggttccgtcgacgcccccgaggaacggccctggaagtgggttgctacttatttagtggatgacggttaccgctacacgtccatctcgtgaggaggagactcacactacccaaccaacggaccaaaccccaaaacgaacggtacgtcccttaacgaaactacgacccaacgacgtacgaccctagtacggaaccacgacaccctaactattaactttccgtagtacacctaaccacttacgtaacggttaacgggaacgtcctaacccggtagggttaacgtacccgtttcgaaaccccgttaaacgtccggggtttaaccccgaccccggggttccgggggaaccccccgggtaaaccgttccgggtacccgttacccggttccctacccgttaccgccgttcccctaacccgaccgtaaccggccctacgttcccggtaaccccgtttccccgcgg

SEQ ID NO: 325702 - DNA, 554 bp, Homo sapiens
  misc_feature: GZ8MTXP01BYDYT.22.38.D05.1.454.CMB.2.raw
tcagacatacgcgtcacgaccggtgctcgatttagtatctgatagttgggtttgggggaggaactgctcagttaggacccagagggaaccatggaagccccagctcagcttctcttcctcctgctactctggctcccagataccaccggagaaattgtgttgacacagtctccagccaccctgtctttgtctccggggaaagagccaccctctcctgcagggccagtcagaatgttagtagttacttagcctgtaccagcaaaagcctggccaggctcccagactctcatctctgatacataccaacgagggccactggccactccccagccaggtttcagtggcagtcgggtctggggacagacttcactctcaccagtcagcgactagacgcctagaacgtattttggctaagtttattaactgtcagcaagtcgtagggctagttcctcggtccttcccgtactaccgtttggcccgtagggggacctagcgtggagatcgaaacgtacgtgttcggcttcgcacaattcagttccttcgttaacttcccg

SEQ ID NO: 325703 - DNA, 614 bp, Homo sapiens
  misc_feature: GZ8MTXP01DWFD7.22.38.D05.1.454.CMB.2.raw
  modified_base (421)..(421): a, c, t, g, unknown or other
  misc_feature (421)..(421): n is a, c, g, or t
  modified_base (424)..(424): a, c, t, g, unknown or other
  misc_feature (424)..(424): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggtgcacttatttatggatgacggttaccgctacagtccatctctgaggaggagactcacatccaccaaggacaaccccaaaacaggtacgtcctacaatcgaccaccatcggaccctgtacgacacagccacatatttcngtncacactcagtaggagcaccgtggtatctagacccaaacgttcggttaccgaaccccggttcgggggaacccccgggtaaacccttcggggttcccaacccgggttcctcccttccgaccggttccccttcccgaacccgaaacgggggcccctaacgttcccgggttccccttttccccccgtcccgggg

SEQ ID NO: 325704 - DNA, 615 bp, Homo sapiens
  misc_feature: GZ8MTXP01CIT14.22.38.D05.1.454.CMB.2.raw
  modified_base (404)..(404): a, c, t, g, unknown or other
  misc_feature (404)..(404): n is a, c, g, or t
  modified_base (435)..(435): a, c, t, g, unknown or other
  misc_feature (435)..(435): n is a, c, g, or t
  modified_base (438)..(438): a, c, t, g, unknown or other
  misc_feature (438)..(438): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagccccaggaaacggccctggaatgggtgcacttatttatggatgacggttaccgctacagtccatctctgaggaggagactcaccatacccaccaaacggaccaaacccccaaaaacgaacggtacggtcctacaaatcgaccaccancgaccctgtgacacacgccactattatttcngtncacactctaagtacggatccaccgttgggtactctgaccctaaacgttcggttcccggaccccgttcgggggaaccccggtaacccttgggtcccaccggttccctcccttaccgcgcccctaaccgaacccgaaccggggcccctaggttccccggttcccgttcccccgtccggg

SEQ ID NO: 325705 - DNA, 664 bp, Homo sapiens
  misc_feature: GZ8MTXP01AKEFL.22.38.D05.1.454.CMB.2.raw
  modified_base (312)..(312): a, c, t, g, unknown or other
  misc_feature (312)..(312): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctggttctcactcaactctagtggagtgggtgtgggctggtccgtcacgccccgaggaagcctggagtggtgctacttagttagtggatgacggttaccgctacncgtcatctcgtgaggaggagactacacactacccaaccgaacgaacccaaacccccgaaaacgtaacgggtacgtaaccttaacaaacgtacgacccaccgtacgtacggtaccctggtacggaccacgacgacccaatacttactttctgtacgctaccgtacttcgtaaggtaggacgcctaacgtggtactcgtacgtaactaaacggttcggtacccggaccccggtcgggggaaccccgtaaccgttcgggttcccacccggttcctacccgcgcccgttaccccgtccccgaacccggtaaccgggcccctacggttccccgggttccccgttcccccggtccggg

SEQ ID NO: 325706 - DNA, 689 bp, Homo sapiens
  misc_feature: GZ8MTXP01AE12C.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctggttctcactcaactctagtggagtgggtgtgggctggttccgtcacgccccaggaaggccctggatgggtgcacttattatgggatgacggttaccgctacagtcatctctgaggaggagactcacatacccaaccaacggaacccaaacccccaaaaccgaacgggtacggtccttaacaactacgaccaccacgtcggaccctgtaggaccacacgcccatattatttctgtacgacaccacttacgtaaggttaacgggacgtaccgtacccgtttgggttaccgtacgttacggaaccccgtaaaaccgttcgggggtttaaccccggaccccccggggtttcggggggaaccccccgggtaaaccccgttcggggtaccccttacccggttccctccccttccgaccgttacccctccccggaaccgtaaccggggcccctacggttccccggttcccgttccccccggtcggg

SEQ ID NO: 325707 - DNA, 578 bp, Homo sapiens
  misc_feature: GZ8MTXP01CJ46N.22.38.D05.1.454.CMB.2.raw
  modified_base (425)..(425): a, c, t, g, unknown or other
  misc_feature (425)..(425): n is a, c, g, or t
  modified_base (441)..(441): a, c, t, g, unknown or other
  misc_feature (441)..(441): n is a, c, g, or t
tcagacatacgcgtcacgaccggtgctcgatttagtatctgatagttgggtttgggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgccaccttctctgggttctcactcaactctagtggagtgggtgtgggctggttccgtcagccccaggaaaggccctggaatgggtgctacttatttatggatgacggttaccgctacagtccatctctgaggagagactcacatcccaccaaggaccaaccccaaaacaggtcgtcctacaatcgaccacatcggaccctgtcgacacacgcacattattctgtcncacactctagtaggancaccgttggtacgtcgtgacccaaacgtcgggttaccgaccccgtgggggccccgggtaacccgttcgggtccacccggttctcccttcgttacgccctccgaccaacgggcccattccggttcccttccccgtcgg

SEQ ID NO: 325708 - DNA, 713 bp, Homo sapiens
  misc_feature: GZ8MTXP01DRELN.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgcccccgaggaaacggccctaggaagtgggtgctacttatttagtggatgacggttacgctacagtcatctctgaggaggagactcaccactacccaaccgaaacggaacccaaacccccgaaaaaccgaacgggttacggttaacccttaaacaaactacgaacccaaccgacgtacggaccctgtacggaaccacgacaccaactaatttactttctgtacgacctaactaaccttacttaaggtaacggggacgtacctaaccgttgggttaactccgtacgtaacccgtaaacgttccgggttaccccggaaccccgggtccgggggaacccccgggtaaacccttcggggtacccttacccggttcctcccgttccgaccgttccccgtaaccgaaacccggaaccggggtcccctacgttcccgggttccccgtttcccccggtccgggg

SEQ ID NO: 325709 - DNA, 612 bp, Homo sapiens
  misc_feature: GZ8MTXP01BFFTW.22.38.D05.1.454.CMB.2.raw
  modified_base (413)..(413): a, c, t, g, unknown or other
  misc_feature (413)..(413): n is a, c, g, or t
  modified_base (440)..(440): a, c, t, g, unknown or other
  misc_feature (440)..(440): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagccccaggaaaggccctggaatgggtgcacttattattgggatgacggttaccgctacagtccatctctgaggaggagactcacatccaccaagaccaaccccaaaaccacggtacgtccttacaatcgaccacatcggaccctgcgacacagccanatatttctgtgcacactctagtagganctaccgtggtacgtctagacctaaacgtcgggttacccgaccccggttcgggggcccccggtaaacccgttcgggtccccaacccggttccctcccgttccgcggttcccctaaccccgaacccgaaccggggcccctacgttcccggggttccctttccccccgtccgggg

SEQ ID NO: 325710 - DNA, 715 bp, Homo sapiens
  misc_feature: GZ8MTXP01CAJY4.22.38.D05.1.454.CMB.2.raw
  modified_base (446)..(446): a, c, t, g, unknown or other
  misc_feature (446)..(446): n is a, c, g, or t
  modified_base (456)..(456): a, c, t, g, unknown or other
  misc_feature (456)..(456): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggtccgtcacgccccaggaaaggccctggaatgggttgctacttatttagttgggatgacggttaccgctacagtccatctctgaggaggagactcaccactacccaaccaaaggaacccaaacccccaaaaaccgaacggtacggtccttaaacaaactcgaaccaccactacgggaccctgtacgacacacgaccaanattactttcngtcacaacactactaagtaggacgtacctacccgttgggttaacgtcctacggtaacccgtaaaacgttccggggtttaccccggacccccgggttccggggggaacccccgggggtaaaccccgtttcgggggtaccccttaaccccgggttccgttcccccttaccggaccggacccccttaaccccgaaaccccggttaaccggggaccccctacgggttcccccgggttccccgtttcccccccggtccccgggg

SEQ ID NO: 325711 - DNA, 624 bp, Homo sapiens
  misc_feature: GZ8MTXP01CNHWH.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgcccccaggaaacggccctggaatgggtgctacttatttagtgggatgacggttaccgctacagtccatctctgaggaggagactcaccatacccaaccaacggaccaaacccccaaaaaccgaacggttacggtcctaacaaactcgaccacatcgaccctgtagacacacgccaatattactttctgtcgacactacttactagtaggactcaccgtggtacgtctagacccaaacgttcgggttacccgaaccccggtcgggggccccggtaaacccgttcgggtccacccggtcctccgttccgccgttccctaacccgacccgaacgggcccctacgttcccggttcccgttcccccgtcgg

SEQ ID NO: 325712 - DNA, 633 bp, Homo sapiens
  misc_feature: GZ8MTXP01BZCBV.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctggttctcactcaactctagtggagtgggtgtgggctggttccgtcacgccccgaggaaacggccctggaagtgggtgctacttatttagtggatgacggttaccgctacagtccatctcgtagaggaggagactcacatacccaccaacggaaccaacccccaaaacgaacggtacgtccttacaactcgaccacactcgggacccttgacggacacgaacgtccaactattactttctgtcacaacactctagtaggacgctaccgtggtacgtctacgacctaaacgttcgggtcccgaaccccgggttgggggaacccccggtaacccttgggtacccacccggttcctccgttaccgaccgcccctaactaccccggaacgggtccccacggttcccgttccccgttccccgtaaccggg

SEQ ID NO: 325713 - DNA, 630 bp, Homo sapiens
  misc_feature: GZ8MTXP01ET8P5.22.38.D05.1.454.CMB.2.raw
  modified_base (326)..(326): a, c, t, g, unknown or other
  misc_feature (326)..(326): n is a, c, g, or t
  modified_base (441)..(441): a, c, t, g, unknown or other
  misc_feature (441)..(441): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctggttctcactcaactctagtggagtgggtgtgggctggttccgtcacgccccaggaacggccctggaagtgggtgctacttatttagtggatgacggttaccgctacacgtcatctntgaggagagactcaccactacccaaccaacggaacccaaccccaaaaaccgtacgggtacgtccttacaactacgaccacagtcgaccctgtcgacacacgccatacttatttcngtcacactactctaggtagagtaccaccgtggtacgtctacgacctaaacgttccggtacccgccccggtcggggaaccccgggtaacccgttcgggtacccttaccggtcctacccgttcgccgcccctaacccgaacccgaaccgggtcccctacgttccccgggttccctttcccccggtcccggg

SEQ ID NO: 325714 - DNA, 654 bp, Homo sapiens
  misc_feature: GZ8MTXP01EZPMX.22.38.D05.1.454.CMB.2.raw
  modified_base (301)..(301): a, c, t, g, unknown or other
  misc_feature (301)..(301): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaaccccacacagaccctcacgctgacctgcaccttctctggttctcactcaactctagtggagtgggtgtgggctgggttccgcagcccccaggaaaggccctggaatgggttgcacttatttattgggntgacggttaccgctacagtccatctctgaggaggagacctcacccatcccaacccaaggacccaaccccccaaaaccagggttcggtcctacaaatcgaccacatcggacccctgtacggacacacgacccactaataacttttcctgtcgccaacactctaagtacggacgccaccgtgggtagtcgtcgacccaaacgttcgggttacccgaccccggttcggggggaacccccgggtaaaccccgttcggggtcccaacccggtccgttccccttccgacccgttccccgtaaccccgacccggtaaccgggtcccctacgttccccggttccccgttcccccggtcggg

SEQ ID NO: 325715 - DNA, 724 bp, Homo sapiens
  misc_feature: GZ8MTXP01ARMZ4.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctggttctcactcaactctagtggagtgggtgtgggctggtccgtcagcccccgaggaaacggccctaggaatgggttgctacttatttagttggatgacggttaccgctacagtccatctcgtgaggaggagactcacatcccaaccgaacggaacccaaacccccaaaaccgaacgggttacgggtccctaacgaactcgaacccaccacgtcggaaccctgtacggaaccacgacgtaccaactattaacttttcgtcgtacgactaaccacgttaccgtaaggttacggggaacgtccgtaaaccccgtggggttacgtaccgtacggtaaccccgtaaaacggttccgggttaaccccgggtacccccggttccggggggaacccccgggtaaacccgttccggggtacccttacccgggtccctcccttacccgccggaccccttaacccgaacccggaaaccgggtcccctaacggttccccggttaacccccgttcccccggtcccggg

SEQ ID NO: 325716 - DNA, 740 bp, Homo sapiens
  misc_feature: GZ8MTXP01BUVB3.22.38.D05.1.454.CMB.2.raw
  modified_base (293)..(293): a, c, t, g, unknown or other
  misc_feature (293)..(293): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtacgaaacccacacacgaccctcacgctgacctgcctaccttctcgtggttctcactcaactcgtagtggagtgggtgtgggtctggtccgtcacgccccgaggaaacggccctggaagtgggtntctactttatttagtgggatcggtaccggttaccgctacacgtccatctgtaggaggaggacgactaccgaacctactaccccaaaccgaaacggaacccaaacccccaaaacgtacggtacgtaactaacaactacgaccactacgtacggtaccctggtacgaccacgaacgaccctaataactttacttttaccgtggttacgacctaacctacgttaaccgtaagggtagggaaccgtaccgtaccgttagggttacgtccgtaacgtacccgtaaacggttccgggttaccccggtaccccgggtcccgggggtaaccccggtaacccgttccgggtaccccgacccgttcccgtcccgttaccgccgttacccccgtaacccgaacccgggtaaccggtcccctacggttcccccggttcccgttccccccggtcccgggg

SEQ ID NO: 325717 - DNA, 562 bp, Homo sapiens
  misc_feature: GZ8MTXP01AND3D.22.38.D05.1.454.CMB.2.raw
  modified_base (417)..(417): a, c, t, g, unknown or other
  misc_feature (417)..(417): n is a, c, g, or t
  modified_base (425)..(425): a, c, t, g, unknown or other
  misc_feature (425)..(425): n is a, c, g, or t
  modified_base (439)..(439): a, c, t, g, unknown or other
  misc_feature (439)..(439): n is a, c, g, or t
  modified_base (456)..(456): a, c, t, g, unknown or other
  misc_feature (456)..(456): n is a, c, g, or t
  modified_base (504)..(504): a, c, t, g, unknown or other
  misc_feature (504)..(504): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggtgcacttatttattgggatgacggttaccgctacagtccatctctgaggaggagactcaccatcccaccaaggaccaaccccaaaacgaggtacggtcctacaatgaccacatcggaccctgtcgacacagccanatatttcngtgcacactctagnggagcacgtggtagtcngacccaaacgtcggttccgaccccgtggggcccggaaccttgggtccncccgtctcccttcgcgccctccacccgaacggcccagttccgtccgttccccgtcggg

SEQ ID NO: 325718 - DNA, 685 bp, Homo sapiens
  misc_feature: GZ8MTXP01CWHFO.22.38.D05.1.454.CMB.2.raw
  modified_base (454)..(454): a, c, t, g, unknown or other
  misc_feature (454)..(454): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtggggctggttcccgtcacgcccccaggaaacggccctggaagtgggttgctactttatttagttgggatggacggttaccgctacagtccatctctggaggaggagactcaccactcccaaccaaacgacccaaacccccaaaaccgaacgggtacgtccttaacaactcgaccaccagtcggaccctgacgacacacgccactattatttcngtacgactactacttacgtaaggtacgggacgtacctacccgttggttaacgtcgtacgaacccgtaaaccgttcgggttacccggaacccccggttcggggggaacccccgggtaacccgttcgggtaccccgttacccggttaccgtccccttaccgcccgttacccctaaccccgaaccgtaaccggggtcccctacggttcccggttccccgttccccccgtccggg

SEQ ID NO: 325719 - DNA, 608 bp, Homo sapiens
  misc_feature: GZ8MTXP01DDV4O.22.38.D05.1.454.CMB.2.raw
  modified_base (316)..(316): a, c, t, g, unknown or other
  misc_feature (316)..(316): n is a, c, g, or t
  modified_base (368)..(368): a, c, t, g, unknown or other
  misc_feature (368)..(368): n is a, c, g, or t
  modified_base (400)..(400): a, c, t, g, unknown or other
  misc_feature (400)..(400): n is a, c, g, or t
  modified_base (409)..(409): a, c, t, g, unknown or other
  misc_feature (409)..(409): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgccccaggaagcctggatgggtgcattattatggatgacggtacgctacagtccatctntgaggagagactcacatcccaccaagaccaaccccaaaacaagtcgtcctanaatcgaccacatcgaccctgtgacacagccanattatttcngtcacaacactacgtagtaacgggactaccgaccgttggtactcgtacgaaccctaaacgttccgggttacccggacccccggttacgggggaacccccggtaacccgttcgggtacccacccggttctcccttacgaccgcccctaacccaaccccgaacgggcccccagttccccgggttcccttcccccgtccggg

SEQ ID NO: 325720 - DNA, 602 bp, Homo sapiens
  misc_feature: GZ8MTXP01ALTV4.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctggttctcactcaactctagtggagtgggtgtgggctggttccgtcacgcccccaggaaaggccctggaatgggttgcacttatttattgggatgacggttaccgctacagtccatctctgaggaggagactcaccatccaaccaacggacccaacccccaaaaccaacggtcggtcctacaatcgaccaccatacggaccctgtacggacacacgccactattattctgtgcacactctaggtaggacgccaccgttggtaactcgtacgacctaaacgtcgggttacccgacccccggtgggggaaccccggtaacccttgggtcccaccggtcctcccttcgacgttcccctccaccgaacggcccacgttccgggtccttccccgtcggg

SEQ ID NO: 325721 - DNA, 626 bp, Homo sapiens
  misc_feature: GZ8MTXP01BJIDP.22.38.D05.1.454.CMB.2.raw
  modified_base (310)..(310): a, c, t, g, unknown or other
  misc_feature (310)..(310): n is a, c, g, or t
  modified_base (441)..(441): a, c, t, g, unknown or other
  misc_feature (441)..(441): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggtccgtcagccccaggaaaggccctggaatgggtgcacttattatggatgacggttacgctangtcatctctgaggaggagactcacataccaccaaaggaccaaccccaaaacgaggtacgtccttacaactcgaccaccagtcgaccctgtagacacgagccatattatttctgtcacacactcagtaggancctaccgtggtagtcctacgaccctaaacgttcgggtacccgaccccggttcgggggaacccccggtaaccgttcgggtacccacccggttcctcccgttaccgccgccccgttaaccccgaaccccggtaacggggtccccctaacggtttccccggggttccccttttccccccggtccgggg

SEQ ID NO: 325722 - DNA, 599 bp, Homo sapiens
  misc_feature: GZ8MTXP01C02NL.22.38.D05.1.454.CMB.2.raw
  modified_base (417)..(417): a, c, t, g, unknown or other
  misc_feature (417)..(417): n is a, c, g, or t
  modified_base (431)..(431): a, c, t, g, unknown or other
  misc_feature (431)..(431): n is a, c, g, or t
  modified_base (434)..(434): a, c, t, g, unknown or other
  misc_feature (434)..(434): n is a, c, g, or t
  modified_base (452)..(452): a, c, t, g, unknown or other
  misc_feature (452)..(452): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgccccgaggaaggcctggaatggtgcacttattatggatgacggttacgctacagtccatctctagaggaggagactcacatacccaccaaacggaccaaaccccaaaacgaacggtacgtccttacaaactacgaccacactcggaccctgtcgacacngaccacattattcngtncacactactagtacgganccaaccgtggtactctcggaaccctaaagttcgggttacccgaccccggtcgggggaacccccggtaaccgttcgggtaccacccgttcacccttccgacgcccctaaccaaccgtaacggcccagttcccggtccttcccccgcgg

SEQ ID NO: 325723 - DNA, 679 bp, Homo sapiens
  misc_feature: GZ8MTXP01A7FUE.22.38.D05.1.454.CMB.2.raw
  modified_base (205)..(205): a, c, t, g, unknown or other
  misc_feature (205)..(205): n is a, c, g, or t
tcagacatacgcgtcacgaccggtgctcgatttagtatctgatagttgggtttgggggaggaactgctcagttaggacccagagggaaccatggaagccccagctcagcttctcttcctcctgctactctggctcccagataccaccggagaaattgtgttgacacagtctccagccaccctgtctttgtcgtaccgggggaaanacgcccaccctctcctgcagggccagtcagaatgttagtagttactagcctggtaccagacaaaagcctggccaggcctcccagacctcctcatctctgatacactaccaacgacggccacgtcggacactccccagccctaggttcaggttggcgtaggttcggggtcgtaggggactacggtacctttaccaaccttcctaccaacccagtaccgaacggccgtaaaccgtagacgtccgtaggtaaagttagttttacggacttaagttttaacttacgtgtacagtacagtccgttaggctacgttccgtcgggtaccccttaccgtaccgttacccggttacgggacccggtaacgggggaaccctaagggtccggtaagggtaacgttaacgtaaaccgaaacggtaacgtcggttcggcttacgaacctactaacgttcttcgttaccttccgttaacctttccccg

SEQ ID NO: 325724 - DNA, 592 bp, Homo sapiens
  misc_feature: GZ8MTXP01AFR0A.22.38.D05.1.454.CMB.2.raw
  modified_base (417)..(417): a, c, t, g, unknown or other
  misc_feature (417)..(417): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctggttctcactcaactctagtggagtgggtgtgggctggttccgtcagccccaggaaggccctggaatgggtgctacttatttatgggatggacggttaccgctacagtccatctctgaggaggagactcaccatcccaccaaggaccaacccccaaaacacgggtcgtcctacaatcgaccacatcgaccctgtcgacacacgccaanattattctgtcgcactactactagtaggacgcaccgttggtacgtcagtaccctaaacgttcgggttacccgccccgttcgggggaacccccggtaaccgttgggtcccacccggttcctccttcgacgccctaaccaccgaacgggccccacgttcccggtcccttccccgcgg

SEQ ID NO: 325725 - DNA, 750 bp, Homo sapiens
  misc_feature: GZ8MTXP01CNK8D.22.38.D05.1.454.CMB.2.raw
  modified_base (283)..(283): a, c, t, g, unknown or other
  misc_feature (283)..(283): n is a, c, g, or t
  modified_base (314)..(314): a, c, t, g, unknown or other
  misc_feature (314)..(314): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctggttctcactcaactctagtggagtgggtgtgggctggtccgtcacgccccaggaacggccctggaagtgggtnctacttatttagtggatgacggtacgctacngtccatctcgtgaggaggagactacaccactaccccaaccaaacggacccaaacccccaaaacgtacgggttacgtcctaacaactacgaccacacgttacgaccctgtacggaacacgacgtaccactaaatttctttccgtagtacgacctaacctacgttaccgtaaagggtaacgggtaacgtccttaacccggttaggggttacgttcccgttacggtaaacccctaaaacgggtttccgggttaaccccgggaaacccccggggttccggggggtaaccccccccggggttaaacccttcgggggtaccccttaaccccggttcccttaccccggttacccgaccggttaccccccgttaacccggaaaccccggaaccgggtccccctaagggtttcccccggttccccgtttccccccggtcccgggg

SEQ ID NO: 325726 - DNA, 652 bp, Homo sapiens
  misc_feature: GZ8MTXP01A76PD.22.38.D05.1.454.CMB.2.raw
  modified_base (325)..(325): a, c, t, g, unknown or other
  misc_feature (325)..(325): n is a, c, g, or t
  modified_base (390)..(390): a, c, t, g, unknown or other
  misc_feature (390)..(390): n is a, c, g, or t
  modified_base (400)..(400): a, c, t, g, unknown or other
  misc_feature (400)..(400): n is a, c, g, or t
  modified_base (412)..(412): a, c, t, g, unknown or other
  misc_feature (412)..(412): n is a, c, g, or t
  modified_base (472)..(472): a, c, t, g, unknown or other
  misc_feature (472)..(472): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtacgaaacccacacacgaccctcacgctgacctgcaccttctctggttctcactcaactctagtggagtgggtgtgggtctggttccgtcacgccccaggaacggccctggaatgggtgctacttatttagtggatggacggttaccgctacagtcntctctgaggagagactacactacacccaacgacaacccaaaccaacggtacgtaccgtaactaanacaccacacncgacgcgtcganacacgaccacatattcttgtcgacacactacttagagggacgactaccgtaggtacgtcncggtaacctaaccggttacgttcccgggtaccccggtaccgggggccccggggtaacccgtcccggttccggtaccccggttccttaccccgccgttacccgccccgttaccccgaaccccggaaccgggtccccgtaaccgttccccggttcccgtccccccgttccgggtccccccgg

SEQ ID NO: 325727 - DNA, 702 bp, Homo sapiens
  misc_feature: GZ8MTXP01CG6GC.22.38.D05.1.454.CMB.2.raw
tcagacatacgcgtcacgaccggtgctcgatttagtatctgatagttgggtttgggggaggaactgctcagttaggacccagagggaaccatggaagccccagctcagcttctcttcctcctgctactctggctcccagataccaccggagaaattgtgttgacacagtctccagccaccctgtctttgtcgtccgggggaaagacgcccaccctctcctgcagggccagtcagaatgttagtagttacttagcctggtaccagacaaaagcctggccaggctcccagactctcatctctgatacactccaaacgagggccacgtggacactaccccgagcccagggtttccaggtcggctagggttccggggtcgtagggggacacgtacctttaccacctctaccaacctatccgaacggccgaaccgtagacgtacctaggtaacgttatttggactttaagttttattactggtactacgatacggtacgttacggggtctaagttccgtaccggtacccgttacccgttaaccgttaccggttttcgggacccgggtaacgggggtaacccgtaacggtcggttaacgggaacgttaacgttaaaccgaaaacggtaaaccgttgggttacggttcgttacggtaaccgaacccgtttaacgtccttcggtttaccttccgttaaccgtttcccccg

SEQ ID NO: 325728 - DNA, 693 bp, Homo sapiens
  misc_feature: GZ8MTXP01B5WGA.22.38.D05.1.454.CMB.2.raw
  modified_base (319)..(319): a, c, t, g, unknown or other
  misc_feature (319)..(319): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcacctgaaggagtctggtcctacgctggtagaaacccacacagaccctcacgctgacctgcaccttctctgggttctcactcaactctagtggagtgggtgtggctggtccgtcacgccccaggaaacggccctggaagtgggtgctacttatttagttggtatgacggttaccgctacngtccatctctgaggaggagactcacatcccaaccaacggaacccaaccccaaaaccgagtacggtctacaatacgaccacacgtcgaccctgtcgacgacacgaccatattatttcctaggtcactacctactactaaggtacgggacgtacctaccgttgggtactccgtacgtaacccgtaaaccggttccggggttaccccgtaaccccccggggtcgggggtaacccccggggtaaacccccgttcgggggtccccttaaccccgggttcctcccccgttacccgttaccggacccccgttaaccccgaccccggaaaccggggtccccctacggttcccccggttccccgtttcccccccgtcccgggg

SEQ ID NO: 325729 - DNA, 670 bp, Homo sapiens
  misc_feature: GZ8MTXP01D5MVW.22.38.D05.1.454.CMB.2.raw
  modified_base (462)..(462): a, c, t, g, unknown or other
  misc_feature (462)..(462): n is a, c, g, or t
  modified_base (466)..(466): a, c, t, g, unknown or other
  misc_feature (466)..(466): n is a, c, g, or t
  modified_base (591)..(591): a, c, t, g, unknown or other
  misc_feature (591)..(591): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggtccgtcacgccccaggaacggccctggaagtggtgctacttattagttggatgacggtaccgctacagtccatctctgaggaggagactcaccactacccaccaaacggaacccaaacccccgaaaaaccgtaacggtacggtaacccttaacaaactaccgaacccaccacgtacggacccgtagtacggacacgagaccactattactttcngtcncactactctaagtagacgtacaccgtggtactcgtacgacctaaacgtcgggttacccggaaccccggtccgggggaaccccggtaacccgttcggggtcccttacccggttcctccccgttccncgacccccgttcccgaaccccggtaaaccgggggtccccctacggttccccgggttaaccccttcccccccggtccggg

SEQ ID NO: 325730 - DNA, 577 bp, Homo sapiens
  misc_feature: GZ8MTXP01D67BS.22.38.D05.1.454.CMB.2.raw
  modified_base (313)..(313): a, c, t, g, unknown or other
  misc_feature (313)..(313): n is a, c, g, or t
  modified_base (418)..(418): a, c, t, g, unknown or other
  misc_feature (418)..(418): n is a, c, g, or t
  modified_base (421)..(421): a, c, t, g, unknown or other
  misc_feature (421)..(421): n is a, c, g, or t
  modified_base (450)..(450): a, c, t, g, unknown or other
  misc_feature (450)..(450): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatggtgcacttattatggatgacggttaccgctacngtccatctctgaggaggagactcaccataccaccaaagaccaaccccaaaacaggtagtcctacaatacgaccacatcgaccctgtgacacagccatatatttcngtncacactctaagtacgagctaccgtggtancttgacccaaagttcgggttaccgaccccgtgggggaaccccggtaacccttgggtcccttaccgtcctccgttccgcgccctaacccaccgaaccgggcccacgttccgtcccgtttccccgcggg

SEQ ID NO: 325731 - DNA, 623 bp, Homo sapiens
  misc_feature: GZ8MTXP01A2XQI.22.38.D05.1.454.CMB.2.raw
  modified_base (429)..(429): a, c, t, g, unknown or other
  misc_feature (429)..(429): n is a, c, g, or t
  modified_base (432)..(432): a, c, t, g, unknown or other
  misc_feature (432)..(432): n is a, c, g, or t
  modified_base (435)..(435): a, c, t, g, unknown or other
  misc_feature (435)..(435): n is a, c, g, or t
  modified_base (544)..(544): a, c, t, g, unknown or other
  misc_feature (544)..(544): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgccccaggaaggccctggaatgggtgcacttatttatggatgacgtacgctacagtcatctctgaggagagactcaccatcccaccaacggaccaaacccccaaaaccgaacggtacggtcctaacaactcgaccaccacgtcgaccctgtcgacacagccactatatttcngtncanactcgtacgtaggacgcaccgtggtacgtcttacggaccctaaacgtcgggttacccgaccccggtcgggggtaacccgggtaacccgttgggtacccacccggttccncccgttaccgaccggttcccctaacccgaaccccgaacgggtccccgtacgttcccgggtccctttcccccggtccggg

SEQ ID NO: 325732 - DNA, 687 bp, Homo sapiens
  misc_feature: GZ8MTXP01C4Y6X.22.38.D05.1.454.CMB.2.raw
  modified_base (337)..(337): a, c, t, g, unknown or other
  misc_feature (337)..(337): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgcacgccccaggaacggccctggaagtgggtgctacttatttagtggatgacggttacgctacacgtcatctcgtggaggagganactcacactacccgaacccaaacggacccaaaccccccgaaaaacgtacgggtacggttaacccttaacaaactacggaaccaccacgtcgggaaccctgtacggaaccacacgccctaactattactttctgtacgaccacgtaactctaaggtaacgggacgtaccgtaccgtaggtacgtcgtacgaccctaaacggttccgggttcccggaccccgggttcgggggaaccccgggtaacccgttcgggtcccacccggttccctacccgttacgccgttccccgtaacccgaacccgaaccggggcccctacggttccccgggttccccgtttcccccggtccggg

SEQ ID NO: 325733 - DNA, 672 bp, Homo sapiens
  misc_feature: GZ8MTXP01DZF7V.22.38.D05.1.454.CMB.2.raw
  modified_base (330)..(330): a, c, t, g, unknown or other
  misc_feature (330)..(330): n is a, c, g, or t
  modified_base (464)..(464): a, c, t, g, unknown or other
  misc_feature (464)..(464): n is a, c, g, or t
  modified_base (467)..(467): a, c, t, g, unknown or other
  misc_feature (467)..(467): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgccccgaggaaacggccctggaatgggtgctactttattagttgggatgacggttacgctacacgtccatctntgaggaggagactcacactacccaaccaaacggaaccaaacccccaaaaccgaacgggtacggtccttaaacaacgtacgaacccaccacgtcgggaccctgtacggaacacgacgaccaactaattactttcngtnaccactaacttctaaggtacggacgtacctaaccgttggtaacgtccgttacgaaccctaaacgttcgggttacccgaccccggttcgggggaaccccggtaaccgttcgggtacccttacccggtcctcccttaccgcggttcccctaaccgaaacccgtaacggggcccctacggttccccgggttcccttcccccgtccggg

SEQ ID NO: 325734 - DNA, 644 bp, Homo sapiens
  misc_feature: GZ8MTXP01EFU1I.22.38.D05.1.454.CMB.2.raw
  modified_base (468)..(468): a, c, t, g, unknown or other
  misc_feature (468)..(468): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggtctcggttccgtcacgccccgaggaaacggcccgtggaagtgggtgctacttagtttagtggatggacggttaccgctacacgtccatctgtggaggaggagactcaccactacccaaccgaacggaacccaaacccccaaaaaccgaacgggtacggttaacctaactaaactacgacccaccacgtcggaccctgtacgacacgacgccaatattactttcncggtacaccactacttacgtaaggtaggacgactaccgtggtactcgtacgaaccgtaaacgttcggtaccccgcccggtcgggggaaccccgtaccgttggtcccttaccgtcctcccttcgcgccctaacccgaccgtaacggtccctacgttcccggtccctttccccggcgg

SEQ ID NO: 325735 - DNA, 602 bp, Homo sapiens
  misc_feature: GZ8MTXP01DFQHS.22.38.D05.1.454.CMB.2.raw
  modified_base (394)..(394): a, c, t, g, unknown or other
  misc_feature (394)..(394): n is a, c, g, or t
  modified_base (416)..(416): a, c, t, g, unknown or other
  misc_feature (416)..(416): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagccccaggaaaggccctggaatgggtgcacttattattggatgacggttacgctacagtcatctctgaggaggagactcacatccaccaaggacaccccaaaacaacggtcgtccttacaatagaccacatcgacccngtgacacagcacatattctgtncacactctagtagagcaccgtgtagtctcgacctaaaactcggtttaccgaccccgttgggggccccgggaaacccttcggggttaccaacccggttccttcccttacccaacggttcccctaacccaaaccccgtaacggggccccctaacgttccccgggttcccttttccccccgtcccgggg

SEQ ID NO: 325736 - DNA, 637 bp, Homo sapiens
  misc_feature: GZ8MTXP01EUOJB.22.38.D05.1.454.CMB.2.raw
  modified_base (446)..(446): a, c, t, g, unknown or other
  misc_feature (446)..(446): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagccccaggaaaggccctggaatgggtgcacttatttatggatgacggttaccgctacagtccatctctgaggaggagactcacactccaccaaacggaaccaaacccccaaaaaccgaacgggtacggtccttaacaactacgaccaccacgtcggacccctggtacgacacacgaccatattactttcngtcacactactactaggtacggacgtcctaccgtaggtacctcgtacgaaccgtaaacgtcgggttacccgtaccccggtcgggggaaccccggtaaccgttcgggtacccttacccggtcctcccgttcgaccgccctaacccgaccgtaacgggcccctacgttcccggttcccctttccccggcccgg

SEQ ID NO: 325737 - DNA, 577 bp, Homo sapiens
  misc_feature: GZ8MTXP01B3JAR.22.38.D05.1.454.CMB.2.raw
  modified_base (433)..(433): a, c, t, g, unknown or other
  misc_feature (433)..(433): n is a, c, g, or t
  modified_base (442)..(442): a, c, t, g, unknown or other
  misc_feature (442)..(442): n is a, c, g, or t
  modified_base (464)..(464): a, c, t, g, unknown or other
  misc_feature (464)..(464): n is a, c, g, or t
  modified_base (533)..(533): a, c, t, g, unknown or other
  misc_feature (533)..(533): n is a, c, g, or t
  modified_base (538)..(538): a, c, t, g, unknown or other
  misc_feature (538)..(538): n is a, c, g, or t
  modified_base (540)..(540): a, c, t, g, unknown or other
  misc_feature (540)..(540): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtcgaaacccacacagaccctcacgctgacctgcaccttctctggttctcactcaactctagtggagtgggtgtgggctggtccgtcagccccaggaaacggccctggaagtgggtgcactttagtttagttgggatggacggttaccgctacagtccatctctgaggaggagactcacatacccaaccaacggaccaaacccccaaaaccgaaggtacgtcctaacaatacgaccaccacgtcgaccctgacgacacagaccaanattatttcngtgcaactactcgtagacgggncctacgtggtatccgtagacccaaagttcggtccgacccgtcgggggaacccgaccttggccaccgtcncttcncnccctccaccgaacgcccattccgtcccttccccgcgg

SEQ ID NO: 325738 - DNA, 635 bp, Homo sapiens
  misc_feature: GZ8MTXP01EWISK.22.38.D05.1.454.CMB.2.raw
  modified_base (311)..(311): a, c, t, g, unknown or other
  misc_feature (311)..(311): n is a, c, g, or t
  modified_base (439)..(439): a, c, t, g, unknown or other
  misc_feature (439)..(439): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggtccgtcagcccccaggaaaggccctggaatgggtgctacttattattgggatgacggtaccgntacagtccatctctgaggtagagactcaccactccaccaaaggaccaacccccaaaaccaaggtacgtccttaacaatcgaccaccacgtcgggacccttgacggacacgacgccactaatattttcngtgcactactctaagtaggagcaaccgtggtatctgacccaaacgttcggttacccgaccccgtcggggggaaccccggtaaacccgttcggggtcccttacccggttcctccccgttaccgacggcccccttaacccgaacccgtaaacggggccccctacggttccccgggtccccttttccccccggtccggg

SEQ ID NO: 325739 - DNA, 561 bp, Homo sapiens
  misc_feature: GZ8MTXP01DYTYA.22.38.D05.1.454.CMB.2.raw
  modified_base (388)..(388): a, c, t, g, unknown or other
  misc_feature (388)..(388): n is a, c, g, or t
  modified_base (407)..(407): a, c, t, g, unknown or other
  misc_feature (407)..(407): n is a, c, g, or t
  modified_base (414)..(414): a, c, t, g, unknown or other
  misc_feature (414)..(414): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagccccaggaaggccctggaatggtgcacttattattgggatgacggttaccgctacagtcatctctgaggagagactcacatccaccaacggacaaccccaaaacaacggtaggtcctacaatcgaccacangaccctgtgacacagccanatattcngtgcacactctagtaggagcacctggtagtctggacctaaacgtcggttcgaccccgtggggaaccccggtaccttgggtccaccggtctccttacgcgccctccgaccgaacgggtccccagttcccggttccttccccgtccggg

SEQ ID NO: 325740 - DNA, 623 bp, Homo sapiens
  misc_feature: GZ8MTXP01EMEPD.22.38.D05.1.454.CMB.2.raw
  modified_base (435)..(435): a, c, t, g, unknown or other
  misc_feature (435)..(435): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggtccgtcagccccaggaaaggccctggaatgggttgcacttattattgggatgacggttaccgctacagtcatctctgaggaggagactcaccatccaccaaacggaccaacccccaaaaccaacggtacggtccttaacaactacgaccaccatcgggacccctgtcggacacagccacatatttcngtgcacactctagtaggagcaaccgtggtacgtctagacccaaagtcgggtttaccgaccccgttgggggccccgggtaaacccttggggtcccttaacccggttcctacccgttccgacggttcccctaacccgaacccgaacggggtccccctagttcccggggttccctttcccccggtccgggg

SEQ ID NO: 325741 - DNA, 556 bp, Homo sapiens
  misc_feature: GZ8MTXP01BI43R.22.38.D05.1.454.CMB.2.raw
  modified_base (426)..(426): a, c, t, g, unknown or other
  misc_feature (426)..(426): n is a, c, g, or t
  modified_base (516)..(516): a, c, t, g, unknown or other
  misc_feature (516)..(516): n is a, c, g, or t
  modified_base (521)..(521): a, c, t, g, unknown or other
  misc_feature (521)..(521): n is a, c, g, or t
  modified_base (537)..(537): a, c, t, g, unknown or other
  misc_feature (537)..(537): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctggttctcactcaactctagtggagtgggtgtgggctggttccgtcacgccccaggaacggccctggaatgggtgcacttattatggatgacgtacgctacagtccatctctgacggagagactcaccatcccaccaaaggaccaaacccccaaacaacgggtacgtccttacaatcgaccacatcggaccctgtcgacacacgccatacttattccngtgaccacgacttctaaggtaggacgccaccgtgtacgtctagacctaacgtcggtccgacccgtcgggaacccgaccttggccacgtcncttcngccctcacaacggccncgttccgtccttcccgcgg

SEQ ID NO: 325742 - DNA, 594 bp, Homo sapiens
  misc_feature: GZ8MTXP01C00MQ.22.38.D05.1.454.CMB.2.raw
  modified_base (276)..(276): a, c, t, g, unknown or other
  misc_feature (276)..(276): n is a, c, g, or t
  modified_base (413)..(413): a, c, t, g, unknown or other
  misc_feature (413)..(413): n is a, c, g, or t
  modified_base (429)..(429): a, c, t, g, unknown or other
  misc_feature (429)..(429): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtacgaaacccacacagaccctcacgctgacctgcaccttctctggttctcactcaactctagtggagtgggtgtggctggtccgcagccccaggaagcctggatggtncattattatggatgacgtacgctacagtccatctgtagaggagagactcacactacccaaccaaacggaaccaaacccccaaaacgaacggtacgtcctaacaatacgaaccacactcggaccctgtcgacacgacnccaactattactttcngtcgacactactctaggtaacggagtccaccgttgtagtcctgaccctaaacgttcgggtacccgacccggttcgggggaaccccggtaacgttcggtaccaccgttctccgttcgcgaccctccgaaccgtaacgggcccacgttccggtcccgttcccgtcgg

SEQ ID NO: 325743 - DNA, 685 bp, Homo sapiens
  misc_feature: GZ8MTXP01ENV1Q.22.38.D05.1.454.CMB.2.raw
  modified_base (255)..(255): a, c, t, g, unknown or other
  misc_feature (255)..(255): n is a, c, g, or t
  modified_base (317)..(317): a, c, t, g, unknown or other
  misc_feature (317)..(317): n is a, c, g, or t
  modified_base (322)..(322): a, c, t, g, unknown or other
  misc_feature (322)..(322): n is a, c, g, or t
  modified_base (459)..(459): a, c, t, g, unknown or other
  misc_feature (459)..(459): n is a, c, g, or t
  modified_base (594)..(594): a, c, t, g, unknown or other
  misc_feature (594)..(594): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtcgaaacccacacagaccctcacgctgacctgccaccttctctggttctcactcaactctagtggagtgggtggtggctgggttccncacgccccgaaggaacggcctaggaagtgggtgctacttattagtgggatggacggttaccnctacngtccatctcgtggaggaggagactacacactaccccaaccaaacgaacccaaaccccaaaacgtaacggtacggtcccttaacaactacgaccacgacgtcgtaccctgcgaacacgagaccaacgtattactttcngtacacactactacgtaaggacggtacgacctaccgtggtacgtcctcgaacccgtaaacgttccgggtacccgtccccgggtagggggtaacccccgtaacgttcggtacccgttaacccgttcccgttacccnccggaccggttccccttaaacccggaaccccggtaaaccggggtcccccttagggttcccccggtttccccgttttcccccggtcccgggg

SEQ ID NO: 325744 - DNA, 700 bp, Homo sapiens
  misc_feature: GZ8MTXP01DPVQ9.22.38.D05.1.454.CMB.2.raw
  modified_base (279)..(279): a, c, t, g, unknown or other
  misc_feature (279)..(279): n is a, c, g, or t
  modified_base (306)..(306): a, c, t, g, unknown or other
  misc_feature (306)..(306): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgccaccttctctggttctcactcaactctagtggagtgggtgtgggctggtccgtcagccccaggaaggccctggatggtnctacttattatggatgacgtcgctacntcatctcgtgaggaggagacctcacgactacccgaaccaacggacccaaacccccaaaacgaacgggttcgtaaccttaacgaactacggtaacccaccgactcgggaaaccccttggtacggaaccacgaacgccctaaactactttaacttttcgtcggttacgaccaactaaccgttccgttaagtaacggggcgtaaccctaccggttagggtaaccgttccgtacgaaaccccgttaaacgttccgggttaccccgggtaacccccggtcgggggaacccccggtaaccgttcggggtacccttacccggttcctcccttaccgccgttacccctccccgaaaccggaaccgggtccccacggttcccgttccccgttcccgtcccggg

SEQ ID NO: 325745 - DNA, 732 bp, Homo sapiens
  misc_feature: GZ8MTXP01B7NQC.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtacgaaacccacacacgaccctcacgctcgacctgcctaccttctcgttgggttctcactcaactcgtaggtggtaggtggggtggtgggtcttcgggttccgtcgacgaccccgaagggaacggcccgtaggaagtgggttgactactttagtttagttgggtagttcggtaaccggttaccgactacacgtacctatcgtcgtaggaggaggacgactacaccactacccaaccgaaacgaacccaaaccccaaaacgtaacggtacgttaacctaacaaactacgaccactacgtacgacctgacgacacacgactaatattacttctgacacctaactacttacgtaagggttacggactccgtaccgttggtaacgttcgaacgtaacccgtaacggtccgggttaccccggaccccgggtccgggggtaaccccggtaacccgttcgggtaaccccttaccggtacccttccaccggttacccgttaccccgtaacccggtaaacccggaacccggggtcccctaccggttcccggttcccccgtttccccgccgggg

SEQ ID NO: 325746 - DNA, 646 bp, Homo sapiens
  misc_feature: GZ8MTXP01BE4E9.22.38.D05.1.454.CMB.2.raw
  modified_base (370)..(370): a, c, t, g, unknown or other
  misc_feature (370)..(370): n is a, c, g, or t
  modified_base (380)..(380): a, c, t, g, unknown or other
  misc_feature (380)..(380): n is a, c, g, or t
  modified_base (389)..(389): a, c, t, g, unknown or other
  misc_feature (389)..(389): n is a, c, g, or t
  modified_base (407)..(407): a, c, t, g, unknown or other
  misc_feature (407)..(407): n is a, c, g, or t
  modified_base (410)..(410): a, c, t, g, unknown or other
  misc_feature (410)..(410): n is a, c, g, or t
  modified_base (427)..(427): a, c, t, g, unknown or other
  misc_feature (427)..(427): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtagaaacccacacagaccctcacgctgacctgcaccttctctgggttctcactcaactctagtggagtgggtgtgggctggtccgtcagccccaggaaggccctggaatgggtgctacttatttatggatgacggttacgctacagtccatctctgaggagagactcacataccaccaagacaaccccaaacagtcgtctanatgaccacancgaccctgngacacagccatatattcngtnacacactctagtaggancaccgtggtactcgtagtaccctaaacgttcggggttaccccgtaaccccggtcgggggtaacccccgggtaaacccgttccggggtacccttaaccccgggtttccctcccgtttacccgcccgttacccccgtttaaccccgaaacccccggaacgggggtaccccccctaacgggttcccccgggtttcccccgtttcccccccgttccccggggg

SEQ ID NO: 325747 - DNA, 643 bp, Homo sapiens
  misc_feature: GZ8MTXP01AUTJ2.22.38.D05.1.454.CMB.2.raw
  modified_base (287)..(287): a, c, t, g, unknown or other
  misc_feature (287)..(287): n is a, c, g, or t
  modified_base (338)..(338): a, c, t, g, unknown or other
  misc_feature (338)..(338): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcgccttctctggttctcactcaactctagtggagtgggtgtgggctggttccgtcacgcccccaggaaacggccctaggaatgggttnctacttattagtggatgacggttaccgctacagtccatctctgaggagganactcaccatcccaaccgaaacgacccaaacccccaaaacgacggttacgtcccttaacaactcgacccaccagtcggacccctgtacgaacacacgacctacattattcctgtacgctacactctaaggtaggacgtcacccgttaggtacgttcgtacgacccgtaaacgttcgggttaccccggaacccccgggtcgggggaaccccgggtaacccgttccgggtcccgttacccgtcctcccttacgccgccctaacccgacccgaaccggcccctacgttcccggtccttcccccgtccgg

SEQ ID NO: 325748 - DNA, 695 bp, Homo sapiens
  misc_feature: GZ8MTXP01DDW4B.22.38.D05.1.454.CMB.2.raw
  modified_base (217)..(217): a, c, t, g, unknown or other
  misc_feature (217)..(217): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtagaaacccacacagaccctcacgctgacctgccaccttctctggttcncactcaactctagtggagtgggtgtgggctggttccgtcacgcccccaggaacggcctggaagtgggtgctactttatttatgggatcggaccggttaccgctacacgtccatctcgtggaaggaggacgactaccaaccactaccccaaccgaaacggaacccaaaccccccgaaaaacgtaacgggttacgttaaccctaacaaacgtacgaaccaccacgtcgggaccctgtcggaacacgacgaccaactatttactttctgtcgacctactactaccgtaaggtacggactacgaccgttggtaacgtccgttacgaaccgtaaacgttccggggttacccggaccccgggtccgggggtaaccccggtaacccgttcggtacccgccgttccctcccttaccgttccggccccttaacccggaccgtaaccgggtccccacggtttcccggtccccgttccccgtcccgggg

SEQ ID NO: 325749 - DNA, 676 bp, Homo sapiens
  misc_feature: GZ8MTXP01A9YVC.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgactgacctgcaccttctctggttctcactcaactctagtggagtgggtgtgggctggtccgtcacgccccgaggaaggccctggaagtgggtgctacttatttatggatgacggttacgctacagtcatctcgtggaggaggagactcacactacccaccaaacggaaccaaacccccaaaacgaacggtacggtcccttaaacaactacgaacccacgtacgtacggtaccctggtacggaacaacgacgaccctaactattaacttttctggttcactaacctacttaccgtaaaggttaacgggacgtacctaaccggttgggtactaccgtagaaccctaaacgttccgggttacccggaccccggtccgggggaaccccgggtaacccgttgggtacccaccggttcctcccgttacgcgttcccctaacccgaaccggtaacgggccctacggttccccggtccctttccccggccggg

SEQ ID NO: 325750 - DNA, 655 bp, Homo sapiens
  misc_feature: GZ8MTXP01DN0DY.22.38.D05.1.454.CMB.2.raw
  modified_base (445)..(445): a, c, t, g, unknown or other
  misc_feature (445)..(445): n is a, c, g, or t
  modified_base (448)..(448): a, c, t, g, unknown or other
  misc_feature (448)..(448): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctggttctcactcaactctagtggagtgggtgtgggctggttccgtcacgccccgaggaaaggccctggaagtgggtgctacttatttagtggatgacggtacgctacagtccatctctgaggaggagacctcaccactacccaaccaaacggaacccaaaccccaaaaaccgaagggtacgtcctaacaaatacgaacccacatcggaccctgtacgacacagaccatattatttcngtncacactctaagtaggacgtacctaccgtgtacgtctacgacccgtaaacgttcgggttaccccgaccccggttccgggggaacccccggtaaacccgttcggggtacccacccgttcccgttcccttaccggacccttccccgtaaccccgaaacccggaaccggggtacccctcgttcccggttcccccgttcccccggtcccggg

SEQ ID NO: 325751 - DNA, 644 bp, Homo sapiens
  misc_feature: GZ8MTXP01B83RS.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagccccaggaaaggccctggaatgggtgctacttatttatggatgacggtaccgctacagtccatctctgaggaggagctcacatccaccaacggaccaaccccaaaacaaggtacgtcctacaatcgaccacactcggaccctgtagacacacgccacattacttctgtgcaactactcctaagtagggacgtccaaccgttggtaacgtcctaggaccctaaacgttcgggttaccccgaacccccggttcggggggaacccccgggtaacccttcggggtacccaacccgggttcctcccgttccgttaaccggcccctaaccccgaaccggaacccggggccccctaaggtttcccccggttccccgttttccccccgtccgggg

SEQ ID NO: 325752 - DNA, 719 bp, Homo sapiens
  misc_feature: GZ8MTXP01CIYQT.22.38.D05.1.454.CMB.2.raw
  modified_base (317)..(317): a, c, t, g, unknown or other
  misc_feature (317)..(317): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtacgaaacccacacacgaccctcacgctgacctgccaccttctctggttctcactcaactctagtggagtgggtgtggctggttccgcacgccccgaggaacggcctggaagtgggtgctacttatttgtggatgacggtaccgctacngtcatctcgtaggaggaggacgactcaccataccccaaccgaaacggaacccaaaccccccgaaaacgtacgggttacgtaacccttaaacaaactaccgaaccacctaacgtcgggaccccttggtaacgaccaacacgacccaactaactttactttcctagtacgacctaacctacttacgtaaagggttacggaacgaccctaaccggttaggttacgtacccgtacggaaaccccgtaaacgtttccggggttaccccggaccccgggttcccgggggaacccccgggttaaacccgttcgggttacccacccggttcctcccgttaccgaccgttcccctaacccgacccggtaaccgggcccctacggttcccgttccccgttcccccgtccggg

SEQ ID NO: 325753 - DNA, 711 bp, Homo sapiens
  misc_feature: GZ8MTXP01B6F3W.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtcgaaacccacacagaccctcacgctgacctgcaccttctctggttctcactcaactctagtggagtgggtgtgggctggttccgtcacgcccccgaggaaacggccctaggaagtgggttgctactttagtttagtgggatggacggttaccgctacagtccatctcgtaggaggaggacgactaccacactaccccaaccgaaacggaacccaaacccccaaaaaccgtaacggttacggtaacccttaaacaaactaccggaacccaaccgacgtaccgggaccccttggtacggaaccacgacgaccctaactatttactttcgtcgtcacaactacttactaaggttacgggacgtcctaacgttggtacgtccgtagtaaaccccgtaaacgttccgggttacccgtaccccgggttcgggggaacccccgggtaacccttcgggtaacccttcccggttacctcccgttcgaccgttcccctaaccgaacccggaacgggtacccctcggttccggttccccgttccccggtccgg

SEQ ID NO: 325754 - DNA, 664 bp, Homo sapiens
  misc_feature: GZ8MTXP01AMH71.22.38.D05.1.454.CMB.2.raw
  modified_base (441)..(441): a, c, t, g, unknown or other
  misc_feature (441)..(441): n is a, c, g, or t
  modified_base (484)..(484): a, c, t, g, unknown or other
  misc_feature (484)..(484): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtagaaacccacacacgaccctcacgctgacctgcaccttctctgggttctcactcaactcgtagtggaggtgggtgtgggtctggttccgtcacgccccgaggaaacggcccgtaggagtgggttgctactttagtttagttgggattggtacggtaccgctacagtcatctctgaggagagactcacatacccaccgaacgaacccaaccccaaaacgacgtacgtctacaatacaccacagcgacctgacgacacacgccatattacttcngtcgacactactactaggtacggacgacctacgtggtacgtcncgtaacccgtaacgttcggggttaccccgaccccggggttccggggggaacccccggtaacccgttccggggtacccttaacccgtcccgttccccttacgccggttacccccttaacccggaacccggtaaccgggacccccgttcggttccccggttcccgtttccccccggtccggg

SEQ ID NO: 325755 - DNA, 640 bp, Homo sapiens
  misc_feature: GZ8MTXP01BXCYE.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgccccgaggaaggccctggaagtgggtgctacttatttagttggatgacggttaccgctacagtccatctctggaggaggagactcaccactacccaaccaaacggaacccaaacccccaaaaacccgaacgggttacggtcccttaacaaactacgaacccaaccagtacggaccctgtcggaacacgacgccaactattatttctgtagcactactctaaggtacggagccacgttggtacgtctcgaccctaaacgttcgggttacccgaccccggtcgggggaaccccggtaacccgttgggtcccacccggtcctccttcgacgttccctaacccgaccgaaccgggccctacgttcccggttcccttccccgtcggg

SEQ ID NO: 325756 - DNA, 693 bp, Homo sapiens
  misc_feature: GZ8MTXP01AFQ63.22.38.D05.1.454.CMB.2.raw
  modified_base (445)..(445): a, c, t, g, unknown or other
  misc_feature (445)..(445): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctggttctcactcaactctagtggagtgggtgtgggctggtccgtcacgccccaggaagcctggatggtgcacttattagtggatgtacggttaccgctacagtccatctcgtgaggagagactcacactcccaaccaacggacccaaacccccaaaacgaacgggtacgtccttaacaatacgaaccaccagtacggaccctggtacggaaccacgagacccaactaattactttcngttacgacctaacctacttacctaaaggttacgggaacgtccgtaaccgttagggttacgtcctacggaaccctaaacgttccggggtttacccgacccccgggtcgggggaaccccccgggtaaccgttcggggtacccttacccggtttccctacccgttccgaccggacccccttaacccggaaccccgaacgggggtccccctacggttcccgggttaacccccgttccccccggtaaccgggg

SEQ ID NO: 325757 - DNA, 712 bp, Homo sapiens
  misc_feature: GZ8MTXP01BV9AJ.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctggttctcactcaactctagtggagtgggtgtgggctggtccgtcacgccccaggaacgccctggaatgggtgcacttatttagttgggtatgacggttaccgctacacgtccatctctgaggaggagactcaccactcccaaccaacgaacccaaacccccaaaaaccgaagggttacgtcctaacaaactcgaccaaccatacgggacccttggacggaaccaacgacgaccctaataactttactttcagttcgaccaacacctttaccgtaaggtacgggtaacggacctaacccgttaggggttacgttcccgtacggaaccccgtaaaaccgttccggggttaccccggaaccccccgggttcggggggaaccccccgggtaaaccgttccgggggtacccttaacccggttccctcccgttaccgcccgttcccttaaccccgaaacccggaaccgggtccccacggttcccggtccccgtttccccgtccccgggg

SEQ ID NO: 325758 - DNA, 611 bp, Homo sapiens
  misc_feature: GZ8MTXP01AOSPQ.22.38.D05.1.454.CMB.2.raw
  modified_base (446)..(446): a, c, t, g, unknown or other
  misc_feature (446)..(446): n is a, c, g, or t
  modified_base (544)..(544): a, c, t, g, unknown or other
  misc_feature (544)..(544): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtcgaaacccacacacgaccctcacgctgacctgcctaccttctctggttctcactcaactctagtggagtgggtgtgggctggtccgtcacgccccgaggaacgccgtggaatgggtgctacttagtttagtggatggacggttacgctacacgtcatctcgtagaggaggagactcacatacccaaccgaacgaacccaaaccccaaaacgaacggttcgtctaacgaatacgaccacgatcggacctgtacgacacagccatattacttctgtacncacacttacgtaagtaggacgtctacggtgtacgtcctaaggaccctaacgtcgggttacccgaccccgggtcgggggccccgtaacgttcggtaccncccggtctccttcgcgccccgtaaccaccggaaccggccctacgttcccggtccgttccccgtcggg

SEQ ID NO: 325759 - DNA, 635 bp, Homo sapiens
  misc_feature: GZ8MTXP01BDMU5.22.38.D05.1.454.CMB.2.raw
  modified_base (396)..(396): a, c, t, g, unknown or other
  misc_feature (396)..(396): n is a, c, g, or t
  modified_base (431)..(431): a, c, t, g, unknown or other
  misc_feature (431)..(431): n is a, c, g, or t
  modified_base (440)..(440): a, c, t, g, unknown or other
  misc_feature (440)..(440): n is a, c, g, or t
tcagacatacgcgtcacgaccggtgctcgatttagtatctgatagttgggtttgggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggtgcacttattattgggatgacggttacgctacagtccatctctgaggagagactcacatccaacaacggaccaaccccaaaacaacggtacgtccttacaatcgaaccaccanacggaccctgtagacaacagccacattattctgtnacacacttntaggtacgagacacgtcggtacgtctgacccaaacgttcgggttcccgaaccccgttcggggggaaccccggtaaaccccgttcgggtcccgttacccggttctccccgttaccgccggccccttaacccgaaccccgtaaaacgggggtccccctaacggttcccgggtttcccctttcccccggtccccgggg

SEQ ID NO: 325760 - DNA, 765 bp, Homo sapiens
  misc_feature: GZ8MTXP01A4G2I.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctggttctcactcaactctagtggagtgggtgtgggctggtccgtcacgccccgaggaaacggccctggaagtgggtgctactttatttagtggatggacggttaccgctacagtccatctctggaggaggacgactcaccactaccccaaccgaaacggaacccaaaccccccgaaaaaccgtaacgggttaccggtaaccctttaaacaaacgttaccggaacccaaccgtaacgtaccggggtaaccccttggtacgggaaccaaccaacgaccctaaactaacttaactttttcgacggttcgaccctaactaccgttactaacggggttacgggaacgtaccgtacccggttaggttaaccgtccgtaaccggtaacccgtaaaaccggttccggggttaccccgaacccccgggttcgggggaaccccccgggtaacccgttcggggtaccccttaacccggttccctacccgttacccgaccgttccccgtaacccgaacccggtaaccggggcccctacggttccccgggtcccctttcccccggccggg

SEQ ID NO: 325761 - DNA, 689 bp, Homo sapiens
  misc_feature: GZ8MTXP01D1LV6.22.38.D05.1.454.CMB.2.raw
  modified_base (282)..(282): a, c, t, g, unknown or other
  misc_feature (282)..(282): n is a, c, g, or t
  modified_base (334)..(334): a, c, t, g, unknown or other
  misc_feature (334)..(334): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgccaccttctctggttctcactcaactctagtggagtgggtgtggctggtccgtcacgccccaggaacggcctggaagtgggtncactttattatggatggacggttaccgctacagtccatctctggaggagganactcaccactacccaaccgaacggaacccaaacccccaaaaaccgaacgggttacggtcccttaacaaactacgaacccaccacgtcgggaccctggtacggaaccacgacgacccaactaatttaacttttctgtagaccaacctacgttactaaggttaacggacgtcctaacgttggtaacgtcgtacgaaccctaaacgttcggggttacccgaacccccgggtcgggggaacccccggtaacccgttcgggtaccccgttacccgtcccgtccgttaccgaccgttccccgtaacccgaacccggtaaccggtcccctacgttcccggttccccgtttcccccggccggg

SEQ ID NO: 325762 - DNA, 673 bp, Homo sapiens
  misc_feature: GZ8MTXP01C4VM9.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctggttctcactcaactctagtggagtgggtgtgggctggttccgtcacgccccaggaacggccctggaagtggtgctacttatttagtggatggacggttaccgctacgacgtccatctcgtggaggaggagactcacactacccaaccaacgaaccaaacccccaaaaccgtaacggttacgtccttaacaactacgaccaccagtcggaccctgtacgaacacgacgaccaactattatttctgtcaccactactctaaggtacggacgtactacccgttggtactcgtacgtaacccgtaaacgttccggggttaacccgacccccgggttccgggggaacccccgggtaacccgttcggggtcccacccggttcctccccgttccgccgttaccccttaaccccgaacccggaaccgggtcccctacgttccccgggttccccgttcccccggtaaccggg

SEQ ID NO: 325763 - DNA, 650 bp, Homo sapiens
  misc_feature: GZ8MTXP01EOTPR.22.38.D05.1.454.CMB.2.raw
  modified_base (327)..(327): a, c, t, g, unknown or other
  misc_feature (327)..(327): n is a, c, g, or t
  modified_base (466)..(466): a, c, t, g, unknown or other
  misc_feature (466)..(466): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgccccaggaaagccctggagtggtgctaacttatttagttggatggacggttacgctacagtcatctcgngaggaggagactacacactacccaaccaacggaacccaaacccccaaaaaccgaacgggtacggtaaccctttaacaaactacgacccaaccagtacggaccctgtacggaccaacgacgaccaataactttactttcngtcgaccactactactaaggtacggacgcctaccgtggtacgtctcgaacctaaacgtcggttacccggaccccgggtcggggccccgggtaacccttcgggtacccacccggtcctacccttcgccgttccccgaaccaccggaaccgggtcccacgttccggttccccgttccccgtccggg

SEQ ID NO: 325764 - DNA, 529 bp, Homo sapiens
  misc_feature: GZ8MTXP01BX5VA.22.38.D05.1.454.CMB.2.raw
  modified_base (217)..(217): a, c, t, g, unknown or other
  misc_feature (217)..(217): n is a, c, g, or t
  modified_base (307)..(307): a, c, t, g, unknown or other
  misc_feature (307)..(307): n is a, c, g, or t
  modified_base (328)..(328): a, c, t, g, unknown or other
  misc_feature (328)..(328): n is a, c, g, or t
  modified_base (366)..(366): a, c, t, g, unknown or other
  misc_feature (366)..(366): n is a, c, g, or t
  modified_base (368)..(368): a, c, t, g, unknown or other
  misc_feature (368)..(368): n is a, c, g, or t
  modified_base (374)..(374): a, c, t, g, unknown or other
  misc_feature (374)..(374): n is a, c, g, or t
  modified_base (378)..(379): a, c, t, g, unknown or other
  misc_feature (378)..(379): n is a, c, g, or t
  modified_base (382)..(382): a, c, t, g, unknown or other
  misc_feature (382)..(382): n is a, c, g, or t
  modified_base (390)..(390): a, c, t, g, unknown or other
  misc_feature (390)..(390): n is a, c, g, or t
  modified_base (396)..(396): a, c, t, g, unknown or other
  misc_feature (396)..(396): n is a, c, g, or t
  modified_base (398)..(399): a, c, t, g, unknown or other
  misc_feature (398)..(399): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctnactcaactctagtggagtgggtgtgggctggttccgtcagcccccaggaaaggcctggaatggtgcatattatggatgacgttacgctanagtcatctctgaggagagacncacatccacaaggacacccaaaacaagtagctacaaananacacangacnnganacacacanatattntnncacactatagagagacacgtgtgtcacgacaacgtacgtaccgtccgccgggccggaccgttacgtcgaccgtcctccttcgcacctaaccgaccgaaccggaccgacgttccgtcccgttccccgtccg

SEQ ID NO: 325765 - DNA, 553 bp, Homo sapiens
  misc_feature: GZ8MTXP01EWSCI.22.38.D05.1.454.CMB.2.raw
  modified_base (203)..(203): a, c, t, g, unknown or other
  misc_feature (203)..(203): n is a, c, g, or t
  modified_base (423)..(423): a, c, t, g, unknown or other
  misc_feature (423)..(423): n is a, c, g, or t
  modified_base (426)..(426): a, c, t, g, unknown or other
  misc_feature (426)..(426): n is a, c, g, or t
tcagacatacgcgtcacgaccggtgctcgatttagtatctgatagttgggtttgggggaggaactgctcagttaggacccagagggaaccatggaagccccagctcagcttctcttcctcctgctactctggctcccagataccaccggagaaattgtgttgacacagtctccagccaccctgtctttgtctccgggggaaanagccacctctcctgcagggccagtcagaatgttagtagttacttagcctggtacagacaaaagcctggccaggcctcccagactcctcatctctgatacataccaacgaggccaactggcactcccagcctaggttcagtggcaggtgggtctgggacagacttcactctcacatcagcgacctagacgctagaagtatttgacttagtttattactgtnagnagcgtaggctagtcgtcggccctccgtaccgttcgttcggaccggtacggggaccaggcgtaaggaagactacgaaaacgtactggcggcttgcctactaattcgtcttactttcgttcgttaaccc

SEQ ID NO: 325766 - DNA, 666 bp, Homo sapiens
  misc_feature: GZ8MTXP01B8M64.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagccccaggaaaggccctggatgggtgctacttattatgggatgacggtaccgctacagtccatctctggaggaggagacctacacactaccaaccaacggaccaaacccccaaaacgaacggtacgtcctacaaatcgaccaccactcggaccctgtacggacacacgaccaacattactttctgtagaccaacacttactagtaacgggacgcctaccgtggtacgtccgcggtaccctaaacgttccgggtttacccgacccccgggttcgggggaacccccggtaaaccccgttgggtaccccacccggttaccgtccccttacgttccggccccttaaccccgaaccccggaaacgggtccccccgtaggttcccccggttccccgtttcccccccggtcccgggg

SEQ ID NO: 325767 - DNA, 710 bp, Homo sapiens
  misc_feature: GZ8MTXP01AYQ2T.22.38.D05.1.454.CMB.2.raw
  modified_base (431)..(431): a, c, t, g, unknown or other
  misc_feature (431)..(431): n is a, c, g, or t
  modified_base (461)..(461): a, c, t, g, unknown or other
  misc_feature (461)..(461): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtagaaacccacacagaccctcacgctgacctgccaccttctctggttctcactcaactctagtggagtgggtgtgggctggttccgtcacgccccgaggaacggtccctaggaagtgggtgtactacttagttagtggatgacggttaccgctacacgtcatctcgtagaggagacgactcacataccccaaccaacggaaccaaacccccaaaacgaacgggttacgtaacctaacaaactcgaaccaccactcggtacccngtacgacacgacgactactatatttctgtnactactactcgtaaggtcgggaactccgtaccgtaggtacgtcgtaccgtaaccctaaacggttccgggttacccgacccccgggtcggggggtaacccccgtaaacccggttccggtaacccgttccccggtacccgtttcccccgttcccgttaccccgttacccccgtaacccggtaaaccccggtaaccccgggtaccccgtacccgggttacccccggtttcccccgttccccccgggtccggg

SEQ ID NO: 325768 - DNA, 664 bp, Homo sapiens
  misc_feature: GZ8MTXP01BKZVV.22.38.D05.1.454.CMB.2.raw
  modified_base (290)..(290): a, c, t, g, unknown or other
  misc_feature (290)..(290): n is a, c, g, or t
  modified_base (320)..(320): a, c, t, g, unknown or other
  misc_feature (320)..(320): n is a, c, g, or t
  modified_base (455)..(455): a, c, t, g, unknown or other
  misc_feature (455)..(455): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggccctacgctggtacgaaaacccacacacgaccctcacgctgacctgcctaccttctcgtggttctcactcaactctaggtggagtgggtgtgggtctcggtccgcacgccccgaggaacggcctggagtggtnctacttattagtggatgtacgtacgctacncgtcatcgtcgtaggaggagacgactacaacactacccaaccgaaacggaacccaaaccccaaaacgacgtacgtctaacaactaccgaccacacgacgaccctagtacgaacacacgaccctaatattactttncgtacacctaacgtactacgtaagggtaacgacgtactaccggttgtacgtcgtacgaacccgttaacgtccgggttaccccgaccccgggtccggggaaccccgtaaccgttcgggtaccccttacccggtccttcccgacgccgttaccccgtaacccgaacccggtaaccgtccccgtcgttccccgggtcccttccccgggtccg

SEQ ID NO: 325769 - DNA, 601 bp, Homo sapiens
  misc_feature: GZ8MTXP01BSSCS.22.38.D05.1.454.CMB.2.raw
tcagacatacgcgtcacgaccggtgctcgatttagtatctgatagttgggtttgggggaggaactgctcagttaggacccagagggaaccatggaagccccagctcagcttctcttcctcctgctactctggctcccagataccaccggagaaattgtgttgacacagtctccagccaccctgtctttgtcgtccgggggaaagagccaccctctcctgcagggccagtcagaatgttagtagttacttagctggtaccagacaaaagcctggccaggcctcccagacctcctcactctctgactacactaccaacgacgggccacgtcggaccactccccgacgcccgtaggttccaggtggcgtaggtcggggtcgtaggggacagtacttaccactctcaccatccagcgactagacgtcctagtaagtattttgacgttaagttttacttactgtacagcaggtcgtaggctagtccgtcggtccttcccgtactaccggtttcggaccgtaggggaccaaggcgtaaggtacgagtacgaaacgtacgtggttacgcgttcgaactacctgttctcgttacttcgaactttccccg

SEQ ID NO: 325770 - DNA, 689 bp, Homo sapiens
  misc_feature: GZ8MTXP01BT92C.22.38.D05.1.454.CMB.2.raw
  modified_base (320)..(320): a, c, t, g, unknown or other
  misc_feature (320)..(320): n is a, c, g, or t
  modified_base (498)..(498): a, c, t, g, unknown or other
  misc_feature (498)..(498): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctggttctcactcaactctagtggagtgggtgtgggctggttccgtcacgccccaggaaacggccctggaagtgggtgctacttatttagttggatggacggttaccgctacncgtcatctctgaggaggagactcaccactacccaaccgaaacggaacccaaacccccaaaaacccgtaacgggtacggtcccttaaacgaaactacgaacccaaccaacgtcgggacccctggtacggacaacacgcccaatattactttctgtcacaactactactagtaacggacnccacgttggtacgttcgacgtaacccgtaaacgtccgggtttacccggacccccggttcggggggaacccccgggtaaccccgttcggggtaaccccttcccggtccctaccccgttacgcccggcccctaaccccgaaccgaacccggggcccctacggttccccgggttccccttcccccggtcccggg

SEQ ID NO: 325771 - DNA, 660 bp, Homo sapiens
  misc_feature: GZ8MTXP01AQGP6.22.38.D05.1.454.CMB.2.raw
  modified_base (252)..(252): a, c, t, g, unknown or other
  misc_feature (252)..(252): n is a, c, g, or t
  modified_base (451)..(451): a, c, t, g, unknown or other
  misc_feature (451)..(451): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgccaccttctctgggttctcactcactctagtggagtggtgtggctggtcgtcncgccccaggaacgcctggagtggtgctacttagtttagttgggtagtgtacggttaccgctacagtccatcgtcgtgaggaggacgactaccaccactaccccaaccgaaacggaaaccccaaacccccgaaaaccgtaacgggtacggtaacccttaacgaaactacgacccacacgtacggaccctagacgacaacncgaccctatacttactttcctaggtcacaacctacttacgtaaggtacggacgtcctaccgtggttaacgtcctacggaccctaaacgttccgggtacccgccccggtcgggggaaccccgtaaccgttcgggtacccaccggtccttcccgcgccgttacccgcccgaccgaaccggccctacgttcccgttccccgttccccgtcgg

SEQ ID NO: 325772 - DNA, 681 bp, Homo sapiens
  misc_feature: GZ8MTXP01BD98M.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgcccccgaggaaacggccctggaagtgggtgctactttattagttgggatggacggttaccgctacagtccatctcgtgaggaggagactcacatacccaaccgaaacggaacccaaacccccaaaaaccgtaacgggtacggtccttaacaaactacgaccaccagtcgaccctgtacggacacacgccaatacttatttctgtcacactacttactaaggtaggacgtacctaccgttgggtactccgtacggtaaccctaaaacggttccggggttaccccgacccccgggttcggggggccccccggggtaaacccgttcggggtaccccacccggttccctccccgttacgcccgttcccgtaacccgaacccgtaaccgggcccctacggttcccggttcccgtttcccccggtcggg

SEQ ID NO: 325773 - DNA, 623 bp, Homo sapiens
  misc_feature: GZ8MTXP01CDBW0.22.38.D05.1.454.CMB.2.raw
  modified_base (285)..(285): a, c, t, g, unknown or other
  misc_feature (285)..(285): n is a, c, g, or t
  modified_base (461)..(461): a, c, t, g, unknown or other
  misc_feature (461)..(461): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctggttctcactcaactctagtggagtgggtgtgggctggttccgtcacgcccccaggaaacggccctggaatgggtnctacttatttagtggatgacggttacgctacagtccatctctgaggaggagactcaccatcccaaccaacggaaccaacccccaaaacgacggtcgtcctacaaatcgaccaccacgtcgaccctgtacgacacacgccactattactttctagtcgcacactactacgtaggacnctacccgtggtacgtcctacgaccctaaacgttccgggttacccgccccggtcgggggaacccccgggtaaccgttcggtacccacccgttcctcccgttccgacgcccctaacccacccgtaacgggcccctacggttcccgttcccgttccccgtccggg

SEQ ID NO: 325774 - DNA, 662 bp, Homo sapiens
  misc_feature: GZ8MTXP01DBHK4.22.38.D05.1.454.CMB.2.raw
  modified_base (285)..(285): a, c, t, g, unknown or other
  misc_feature (285)..(285): n is a, c, g, or t
  modified_base (343)..(343): a, c, t, g, unknown or other
  misc_feature (343)..(343): n is a, c, g, or t
  modified_base (476)..(476): a, c, t, g, unknown or other
  misc_feature (476)..(476): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtacgaaacccacacagaccctcacgctgacctgcaccttctctggttctcactcaactctaggtggagtgggtgtggctggttccgtcacgccccaggaacggcctggaagtgggtnctactttatttagttggatggacggttaccgctacacgtccatcgtctggaggagganactacacactaccccaaccaaacggaacccaaacccccgaaaaccgaacgggttaccgtccttaacaaacgtaccgaacccacacgtcgggaccctggtcggacaacgacgaccactatttactttcgtgtcnccactacttaccgtaaggtacggacgtacctaaccgttggtactcgtacgtaacctaaaccgttcgggtacccgaccccggggtccgggggaaccccgggtaaccgttcgggtacccttaccgtcctccttaccgcgccctaaccgaccgaacggccctagttcccggttcccgttccccgtccgg

SEQ ID NO: 325775 - DNA, 719 bp, Homo sapiens
  misc_feature: GZ8MTXP01CEY2B.22.38.D05.1.454.CMB.2.raw
  modified_base (292)..(292): a, c, t, g, unknown or other
  misc_feature (292)..(292): n is a, c, g, or t
tcagacatacgcgtcacgaccggtgctcgatttagtatctgatagttgggtttgggggagtgactcctgtgccccaccatggacacactttgctccacgctcctgctgctgaccatcccttcatgggtcttgtcccagatcaccctgaaggagtctggtcctacgctggtacgaaaaccccacaccagacccctcaccgctgacctgccaccttctcgtggttctcactcaactctagtggagtgggtgtgggctggtccgtcacgccccgaggaacgccgtaggagtggtnctacttattagtgggatggacggttaccgctacacgtacctatctcgtaggaggaggacgacctaccaccactaccccaaccgaaacggaaccccaaacccccgaaaaccgtacgggttaccgtaacctaaacaacgtaccgaacccaaccacgtacggaccctaggtacggaacacgacgacctactattactttctgtcaccaactaccttaccgttaagggtaacggacgtacccgtaccggttagggttaaccgtccgtacgtaacccgtaaaccggttccgggttaacccccggtaccccgggtacccgggggtaacccccgggtaacccgttccggtcccgttacccggttcctcccacgcccttccccgaacccgaccggaaccgggtcccctcggttcccgtccccgttcccggcccgg

SEQ ID NO: 325776 - DNA, 696 bp, Homo sapiens
  misc_feature: GZ8MTXP01CR4SJ.22.38.D05.1.454.CMB.2.raw
  modified_base (487)..(487): a, c, t, g, unknown or other
  misc_feature (487)..(487): n is a, c, g, or t
  modified_base (638)..(638): a, c, t, g, unknown or other
  misc_feature (638)..(638): n is a, c, g, or t
tcagacatacgcgtcacgaccggtgctcgattttagtatctgatagttgggtttggggagtgactcctgtgccccaccatggacacactttgctccacgctcctgctgctgaccatcccttcatgggtcttgtcccagatcaccctgaaggagtctggtcctacgctggtacgaaacccacacacgaccctcacgctgacctgccaccttctctggttctcactcaactctagtggagtgggtgtggctggttccgtcacgccccgaggaacggcccgtggagtgggttataactttagtttagttgggatggtacggttaccgctaacacgtccattctcgtggaaggaggacgactacaacactacaaccccaacggaaccaaaccccgaaaacgtcggtaacgtaccttaacgaactacgaaacccacacgtacggaccctagtacgaccaacgtacgaccctaactacttaacgttttcccgngttaccggacctaaacctaccttaacgttaacggttaacggggacgtacccgttaccgtagggttaccgttccgtaccggaacccgtaaacgttccggggtacccgtacccccggtcgggggccccgtaaccgtcggcctaccgttctccncgaccgccgttacccaaccggaaccggcctacgtccgttacccttcccgcggtccccg

SEQ ID NO: 325777 - DNA, 715 bp, Homo sapiens
  misc_feature: GZ8MTXP01DEFI8.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtacgaaacccacacagaccctcacgctgacctgcaccttctctggttctcactcaactctagtggagtgggtgtgggctggttccgtcacgccccgaggaacggccctggaagtgggtgctacttatttagttgggatacggtacggttaccgctacagtcctatctcgtggaggaggagactacaccactacccaaccgaaacggaacccaaacccccaaaaaccgaacgggttacggtccttaacaactacgaaccaccacgtcggaccctgtacggaacacacgacctaactattactttctagtcacctaactactaccgtaagtacgggacgtctaacccgtggttaacgtctacgtaaccctaaacgttcgggttacccggaccccggttcggggggaacccccggtaacccgttcggggtacccttacccggttacctccccgttaccgttcccggacccccttaacccggaaaccccggtaaccggggtccccctaaccggtttccccggggttcccccttttccccccgggtcccggg

SEQ ID NO: 325778 - DNA, 680 bp, Homo sapiens
  misc_feature: GZ8MTXP01BCMHQ.22.38.D05.1.454.CMB.2.raw
  modified_base (437)..(437): a, c, t, g, unknown or other
  misc_feature (437)..(437): n is a, c, g, or t
  modified_base (443)..(443): a, c, t, g, unknown or other
  misc_feature (443)..(443): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctggttctcactcaactctagtggagtgggtgtgggctggttccgtcacgcccccaggaaacggccctggaagtgggttgctacttatttatgggatgacggttaccgctacagtccatctcgtgaggaggagactcaccatacccaaccaacggaacccaacccccaaaacgaacggtacgtcctaacaatacgaccacagtcgaccctgtacgacacacgccatattntttacntgcacacttactaaggtaggacgaccaaccgttgggtaactccgtacgtaccctaaaacggttccgggtttacccggaaccccccggttcggggggaacccccgggtaaacccgttcgggttaccccgaccccggttccgttccccttacgacccggccccttaaccccgaaacccggtaaaccgggggtccccctaacgtttccccgggttcccccgtttcccccccggtccgggg

SEQ ID NO: 325779 - DNA, 667 bp, Homo sapiens
  misc_feature: GZ8MTXP01D0NJA.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgccccgaggaaacggccctggaagtgggtgctacttagttattggatgacggttaccgctacagtccatctcgtgaggagagactacacatacccaccaaacggaacccaaaccccaaaaccgaacggtacgtcctaacaaactacgaccaccagtcgggaccctggtagaccaacgacaccaactattactttcgagtcgacctactaacctcgttaaggtaacgggacgtcctacccgttagggtactccgtacgaaacccgtaaacggttccgggttaccccggaccccgggttcgggggaacccccggtaacccgttggtacccttacccgtcctcccgttaccgcgttccccgtaaccgaacccgaacgggcccctaggttcccggttcccgttcccccgtcggg

SEQ ID NO: 325780 - DNA, 716 bp, Homo sapiens
  misc_feature: GZ8MTXP01EOUPT.22.38.D05.1.454.CMB.2.raw
  modified_base (204)..(204): a, c, t, g, unknown or other
  misc_feature (204)..(204): n is a, c, g, or t
  modified_base (294)..(294): a, c, t, g, unknown or other
  misc_feature (294)..(294): n is a, c, g, or t
tcagacatacgcgtcacgaccggtgctcgatttagtatctgatagttgggtttgggggaggaactgctcagttaggacccagagggaaccatggaagccccagctcagcttctcttcctcctgctactctggctcccagataccaccggagaaattgtgttgacacagtctccagccaccctgtctttgtcgtccgggggaaanacgccaccctctcctgcagggccagtcagtaatgttagtagttacttagcctaggtaccagacaaagcctggccaggctcccagacctcncatctctgatacataccaaacgcggccacgtggactactccccgacgccgtaggttacaggtcggacgtaggtcggggtcgtaggggacacgtacccttaaccaccttctaccaacctactaccgaacggacccgtaaacccgttaagggaccgtaccgtaaggtaaagttacgttttacgaccgtttaaaggttttaactttacgtacgggttaccacggaccgtaaggtacccggtaggtaccttaacgttcccgttccggttaccccttacccgttaacccgttaccggttttaccggggacccggtaaacgggggaaccctaacgggtccgttaagggaacgttaacgtaaaccgaaacgtaacgtggttacggcttacgaacctactaacttctcttaccttcgttaaccttccccg

SEQ ID NO: 325781 - DNA, 686 bp, Homo sapiens
  misc_feature: GZ8MTXP01BC9BJ.22.38.D05.1.454.CMB.2.raw
  modified_base (283)..(283): a, c, t, g, unknown or other
  misc_feature (283)..(283): n is a, c, g, or t
  modified_base (453)..(453): a, c, t, g, unknown or other
  misc_feature (453)..(453): n is a, c, g, or t
  modified_base (465)..(465): a, c, t, g, unknown or other
  misc_feature (465)..(465): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggtccgtcacgccccaggaaaggccctggaatgggtnctacttatttagtgggatgacggttaccgctacagtccatctctgaggaggagactcaccgatacccaccgaaacggacccaaacccccaaaaaccgagggtcgggtccttaacaagtacgaacccaccgatcgggaaacccctggtacggaaccaacgacggccctaanacttaattttcnggttagacccaacacttaccgaaggttacgggaacggtccaacccgttagggtaacgtccgtacgaccctaaaaccgttcgggttacccgacccccgggttgggggaacccccgggtaaacccttcggggtaccaccccggttctaccccgttcgacggttcccctaaccgaaccgtaaccggggccccagttccccgggtccctttccccccgtccgggg

SEQ ID NO: 325782 - DNA, 672 bp, Homo sapiens
  misc_feature: GZ8MTXP01A6MZT.22.38.D05.1.454.CMB.2.raw
  modified_base (619)..(619): a, c, t, g, unknown or other
  misc_feature (619)..(619): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgccaccttctctgggttctcactcaactctagtggagtgggtgtgggctggtccgtcacgccccaggaaacgccctggaactgggtgctactttagttagttgggatgtacggttaccgctacagtccatctgtggaggaggagactacaccactaccgaaccaaacgaacccaaacccccaaaacgaacgggttacggtaacccttaacaaacgtaccgaacccaaccgtacgtacgggtaaccctggtacggaccaacgacgaccctaactaatttaactttctcgtcactaaccaacttcgtaaggtacggacgtaccgtaccgttaggtacgtccgtacggtaccctaaacgtcgggttacccgaccccgggtcggggaaccccggtacccgttcggtcccacgtcctccttccgcncccgtaaccaccggaaccgggccctaggttcccgttcccgttccccgtccggg

SEQ ID NO: 325783 - DNA, 705 bp, Homo sapiens
  misc_feature: GZ8MTXP01CW6BD.22.38.D05.1.454.CMB.2.raw
  modified_base (236)..(236): a, c, t, g, unknown or other
  misc_feature (236)..(236): n is a, c, g, or t
  modified_base (283)..(283): a, c, t, g, unknown or other
  misc_feature (283)..(283): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtacgaaacccacacacgaccctcacgctgacctgctaccttctctggttctcactcaactctagtggngtgggtgtgggctggttccgtcacgcccgaggaacgcctgagtggtnctattattgtggatgacggttaccgctacagtccatctcgtggaggaggacgactacacactacccaacccgaaacggaacccaaacccccgaaaacgaacgggtacgtaacctaacactacgaccacacgtacgaccctaggtcgaaccagtacgacctaactatttacgtttctgttacgaccacttaaccttcgtaaagggtacggactccgaacgttggttaaccgtcgtaacgacccgtaaacggttccggtaccccggtaccccgggtcgggggtaacccccgggtaaccgttcccggtacccgacccgggttcccttcccgttaccggttacccgcccccgttaacccggaccccgggaacccgggtccccgtaccggttccccgggtttccccctttccccgggaaccccgggg

SEQ ID NO: 325784 - DNA, 736 bp, Homo sapiens
  misc_feature: GZ8MTXP01BLX6M.22.38.D05.1.454.CMB.2.raw
tcagacatacgcgtcacgaccggtgctcgatttagtatctgatagttggggtttgggagtgactcctgtgccccaccatggacacactttgctccacgctcctgctgctgaccatcccttcatgggtcttgtcccagatcaccctgaaggagtctggtcctacgctggtcgaaacccacacagaccctcacgctgacctgccaccttctctcggttctcactcaactcgtaggtggagttgggtgtggtctggttcctcacgccccgaaggaacgcctaggacgtggtcgtactacttatttagtgggtattcggtaaccggttaccgactacgtacgtcctatctcgtagaggtaggactactcaacctactaccccgaaccaaacgaaacccctaaacccccgaaaacgtaacggttaccgtaaccttaaaccaaacgttaccgaaccctaacctacgtacgtacccgtggtacgaaccgacgtacaccagtattacgtttcagtcactactactactaggtacggactaccgtaaccgttgtaacgtccgtacgtaaaccctaaacgtttccgggttaccccggaccccgggtttccggggggaacccccgtaacccggtttcggtaaaccccgttcccgttccctccccgttccgaccggttacccccgtccccgaaacccggaaccgggccccttacggttccccgggtttccccttaaccccggtcccgg

SEQ ID NO: 325785 - DNA, 589 bp, Homo sapiens
  misc_feature: GZ8MTXP01B0KHY.22.38.D05.1.454.CMB.2.raw
  modified_base (280)..(280): a, c, t, g, unknown or other
  misc_feature (280)..(280): n is a, c, g, or t
  modified_base (309)..(309): a, c, t, g, unknown or other
  misc_feature (309)..(309): n is a, c, g, or t
  modified_base (408)..(408): a, c, t, g, unknown or other
  misc_feature (408)..(408): n is a, c, g, or t
  modified_base (414)..(414): a, c, t, g, unknown or other
  misc_feature (414)..(414): n is a, c, g, or t
  modified_base (430)..(430): a, c, t, g, unknown or other
  misc_feature (430)..(430): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctggttctcactcaactctagtggagtgggtgtgggctggttccgtcacgccccaggaagccctggaatggtnctacttattagtggatgacggtacgctanagtccatctctgaggaggagactcaccatcccaaccaacggaaccaaacccccaaaacgacggtacgtccttaacaaatcgaaccacatcggaccctgngacacngacacattattctgtncacactacagtagagctacgtggtacgtctacgacctaaacgtcggttaccgaccccggttgggggaaccccggtaaccgttcgggtaccttaccgtcctcgccacgcccgtaaccaccgaacgggtccctacgttcccggttcccgttcccccgtggg

SEQ ID NO: 325786 - DNA, 716 bp, Homo sapiens
  misc_feature: GZ8MTXP01A5J1V.22.38.D05.1.454.CMB.2.raw
  modified_base (659)..(659): a, c, t, g, unknown or other
  misc_feature (659)..(659): n is a, c, g, or t
tcagacatacgcgtcacgaccggtgctcgatttagtatctgatagttgggtttggggagtgactcctgtgcccgaccatggacacactttgctccacgctcctgctgctgaccatcccttcatgggtcttgtcccagatcaccctgaaggagtctggtcctacgctggtacgaaacccacacacgaccctcacgctcgacctgcctaccttctcgtggttctcactcaactctaggtggtaggtggggtggtggggtcgtcgggttcccgtacgaccgaccccgaagggaacggcccgtaggaagtgggtcgtactacgtttagtttagttagggtagtaggtaccggttaccgtactacgtacgtcctattcgtcgtaggaaggtaggacgtacctacaccaactaccccgaaccaaacggaacccaaaaccccgaaacgtaacggttacggtaactaacgaaacgtaccgaaccaccgtacgtacggtacccgtggtacgaaccacgaacgtaccctataacttacttacgtgtacacaactacgttactaaggtaggactacctaacgtggtactcgtacgtacccgtaaacgtcgggtaccccgaccgggtccggggaaccccgtaaccgttcgaccttaccgtcctccgttacnccgttacccaaccgacccggtaacgccccgtagttcccgtccccttcccggtcccgg

SEQ ID NO: 325787 - DNA, 569 bp, Homo sapiens
  misc_feature: GZ8MTXP01EO4PP.22.38.D05.1.454.CMB.2.raw
  modified_base (362)..(362): a, c, t, g, unknown or other
  misc_feature (362)..(362): n is a, c, g, or t
  modified_base (372)..(372): a, c, t, g, unknown or other
  misc_feature (372)..(372): n is a, c, g, or t
  modified_base (386)..(386): a, c, t, g, unknown or other
  misc_feature (386)..(386): n is a, c, g, or t
  modified_base (398)..(398): a, c, t, g, unknown or other
  misc_feature (398)..(398): n is a, c, g, or t
  modified_base (402)..(402): a, c, t, g, unknown or other
  misc_feature (402)..(402): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggtccgtcagccccaggaaagccctggatggtgcacttattatggatgacggtacgctacagtccatctctgaggaggagactcacatccacaaggacaccccaaaacagtgctanatcgacacangaccctgtgacacncgcatatattcngtcncacactctagtaggagcaccgtgtagtctagacctaaacgtcgggtacccgccccggtgggggaaccccggtaaccgttgggtcccaacccggtcctcccgttccgacgttcccgtaacccaaccgaacgggcccctagttcccgggttcccttcccccgtaacggg

SEQ ID NO: 325788 - DNA, 666 bp, Homo sapiens
  misc_feature: GZ8MTXP01DL6S8.22.38.D05.1.454.CMB.2.raw
  modified_base (465)..(465): a, c, t, g, unknown or other
  misc_feature (465)..(465): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctggttctcactcaactctagtggagtgggtgtgggctggtccgtcacgccccaggaagcctggagtgggtgctacttatttagtgggatggacggttaccgctacacgtccatctcgtgaggaggagactcaccactacccaaccaaacggaacccaaacccccaaaaccgaacggttacggttcctaacaaactacgacccaccgactacgggaccctggtcggaaccacgacgacctaactaatttacttttcgnggtacaccaacctacttactaaggtacggacgacctaccgttggtacgtccgtacgaaccctaaacgttccgggttacccgaccccgggtcgggggaaccccggtaacccgttcggtacccaccggttcctcccttacgccgccccgtaacccgacccgaaccgggtccctacgttcccggttcccgttcccccggtccgg

SEQ ID NO: 325789 - DNA, 695 bp, Homo sapiens
  misc_feature: GZ8MTXP01AKQ49.22.38.D05.1.454.CMB.2.raw
  modified_base (287)..(287): a, c, t, g, unknown or other
  misc_feature (287)..(287): n is a, c, g, or t
  modified_base (448)..(448): a, c, t, g, unknown or other
  misc_feature (448)..(448): n is a, c, g, or t
  modified_base (473)..(473): a, c, t, g, unknown or other
  misc_feature (473)..(473): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtcgaaacccacacagaccctcacgctgacctgccaccttctctgggttctcactcaactctagtggagtgggtgtgggctggtccgtcacgccccgaggaacgccctaggaagtgggtnctactttagttacgttgggtatcggtacggttaccgactacgacgtccatctcgtgaggaggacgactcaccagtaccccaaccgaacgaaccctaaacccccaaaacgacggtacgtccttacaactacgaacccacacgtacggaccctgtacgaccanacgacctaacgtattacgtttccgngtacgacctaacgtacttaccgtaaagggtacgggtacacccgtaaccggttgggtactcgtacggtaaccctaaacggttccgggttaaccccggaccccggttccggggggaaccccgtaaccgttcgggtccccttacggtaccctccgttacccgccgttcccctaaccgaacccgaaccgggtcccctacggttcccggtccccttcccccggcggg

SEQ ID NO: 325790 - DNA, 637 bp, Homo sapiens
  misc_feature: GZ8MTXP01AILWC.22.38.D05.1.454.CMB.2.raw
  modified_base (452)..(452): a, c, t, g, unknown or other
  misc_feature (452)..(452): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggtccgtcagccccaggaacggccctggaatgggtgcacttatttatggatgacggttaccgctacagtccatctctgaggaggagactcacatcccaccaacggaacccaaacccccaaaaccgaacgggttacggtcccttaacaaactcggacccaccagtcggacccctggtacggacacacggcccaactacttactttcngttagcctaacactactagtaggacgccaccgtggtacgtctacgacccgtaaacttcgggttacccggacccccggtcgggggaaccccgggtaacccttcgggtccacccggttcctccttccgcgttccctaacccgaccgaaccggggcccctacgttcccggtcccttcccccgtccggg

SEQ ID NO: 325791 - DNA, 676 bp, Homo sapiens
  misc_feature: GZ8MTXP01D98FO.22.38.D05.1.454.CMB.2.raw
  modified_base (320)..(320): a, c, t, g, unknown or other
  misc_feature (320)..(320): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtacgaaacccacacagaccctcacgctgacctgcctaccttctctgggttctcactcaactctagtggagtgggtgtggctggtccgtcacgccccgaggaacggcctggaagtgggtgctacttatttagtggatgacggttaccgctacncgtcatctcgtggaggaggagactcacactacccaaccgaaacggaacccaaacccccgaaaaaccgaacgggttacggttccctaaacaaacttacggaacccaacctagtaccgggaccctgtacggaacacacgaccaactatttacgtttctgcgacaactacttacgtaaggttaacgggacgtaccgtaccgttggttaacgtcgtacgaacccgtaaacggttccgggtttacccggaccccgggtcgggggaaccccggtaaccgttcgggtacccttaccggtcctcccttacgcgttcccaaccgaccgaacggtcccacgttcccggttcccttccccgtcccgg

SEQ ID NO: 325792 - DNA, 643 bp, Homo sapiens
  misc_feature: GZ8MTXP01EGCAL.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggtccgtcacgccccaggaaggccctggaagtgggtgctacttatttagttgggatggacggttaccgctacagtccatctctgaggaggagactcaccactacccaaccaaacggaaccaaacccccaaaaaccgaacggtacggtccttacaaactcgacccacactcggaccctgtacgacacgacgaccaactattatttctgtcgaccactaactctaaggtaacggacgtctaccgttggtaacgtctacgaaccctaaacgttcgggtacccgaccccggtgggggaacccccggtaacccgttgggtcccaccgtcctcccgttcgttcgcccctaacccgacccggaaccgggcccctacgttcccggtccccgttccccgtcccggg

SEQ ID NO: 325793 - DNA, 667 bp, Homo sapiens
  misc_feature: GZ8MTXP01AJ6UF.22.38.D05.1.454.CMB.2.raw
  modified_base (462)..(462): a, c, t, g, unknown or other
  misc_feature (462)..(462): n is a, c, g, or t
  modified_base (599)..(599): a, c, t, g, unknown or other
  misc_feature (599)..(599): n is a, c, g, or t
  modified_base (608)..(608): a, c, t, g, unknown or other
  misc_feature (608)..(608): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgctaccttctctggttctcactcaactctagtggagtgggtgtgggctggtccgtcacgccccaggaaacggcctggaatgggtgctacttatttattgggatcggacggttaccgctacagtccatctcgtgaggtagagactcaccatccccaaccgaacgaacccaacccccaaaaaccgacgggtacgttaacccttaaacaaactacgacccaccgtatacggtaacccctgtacggacacacgaccatattactttcngtcacaccactactaacgtaggaacgccgtacccgttggtacgtcctacggacccttaaaccgtcggtttaccccgaaccccgggttcgggggaacccccggtaaccgttcgggtaccgttacccgtccgttacccncgttacccncccgttaaccccgaacgaaccgggtacccctcgttcccggttcccgttcccccgccggg

SEQ ID NO: 325794 - DNA, 726 bp, Homo sapiens
  misc_feature: GZ8MTXP01C6VHY.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtacgaaacccacacacgaccctcacgctgacctgcaccttctctggttctcactcaactctagtggagtgggtgtgggctggtccgtcacgccccgaggaacggcctggaagtgggtgctacttagtttagtggatgtacggttaccgctacacgtccatctcgtggaaggaggacgactacacactaccccaaccaaacggaacccaaacccccgaaaaaccgtaacgggttcggttaaccctaaacaaactacgaacccaccagtacggaccctgtacgacaacgtcgaccaactaatttactttacgtgtacgacctaactaacttaccgtaaagttaacggggacgtaccgtaaacccgttgggttaacggtccttacggaaacccgtaaaccggttcccggggtttaccccggaccccccggggtttcggggggaacccccccgggttaaacccgttcgggtccccgaacccggtttcctaccccgttcgcccgttacccctccgaaccggaaccgggcccctacgttcccggttccccgtttccccgccggg

SEQ ID NO: 325795 - DNA, 730 bp, Homo sapiens
  misc_feature: GZ8MTXP01AQJXQ.22.38.D05.1.454.CMB.2.raw
  modified_base (293)..(293): a, c, t, g, unknown or other
  misc_feature (293)..(293): n is a, c, g, or t
tcagacatacgcgtcacgaccggtgctcgatttagtatctgatagttgggtttgggggagtgactcctgtgccccaccatggacacactttgctccacgctcctgctgctgaccatcccttcatgggtcttgtcccagatcaccctgaaggagtctggtcctacgctggtacgaaacccacacacgaccctcacgctgacctgcctaccttctcgtggttctcactcaactctaggtggaggtgggtggtgggctcggttccgtcacgccccgaggaacggcctggatgggtnctacttagttagtggatgacggttaccgctacagtccatctcgtaggaggaggacgactacacactacccaaccaacggaacccaaaccccaaacgtaacggtacgtaacctaacgaactacgaccacgacgtacggacctgtacgaacacgacgccactacttatttccgtagtacgacctacgtaactacgttaagggtacggacgtacccgtaacgttgggtaccgttcgtaccggttaaccctaaacgggtttcccgggttaccccgggtacccccgggtaccggggggtaaccccccggtaaaccgggtttcccgggtaccttacccccggttccgttccccgccggttacccggaccccttaaccccgaaacccggtaacccgggtcccctaggttccccccgggttccccgtttcccccgggccccgggg

SEQ ID NO: 325796 - DNA, 624 bp, Homo sapiens
  misc_feature: GZ8MTXP01ELG97.22.38.D05.1.454.CMB.2.raw
  modified_base (179)..(179): a, c, t, g, unknown or other
  misc_feature (179)..(179): n is a, c, g, or t
  modified_base (467)..(467): a, c, t, g, unknown or other
  misc_feature (467)..(467): n is a, c, g, or t
  modified_base (492)..(492): a, c, t, g, unknown or other
  misc_feature (492)..(492): n is a, c, g, or t
  modified_base (602)..(602): a, c, t, g, unknown or other
  misc_feature (602)..(602): n is a, c, g, or t
tcagacatacgcgtcacgaccggtgctcgatttagtatctgatagttgggtttgggggagtgactcctgtgccccaccatggacacactttgctccacgctcctgctgctgaccatcccttcatgggtcttgtcccagatcaccctgaaggagtctggtcctacgctggtgaaacccanacagaccctcacgctgacctgccaccttctctgggttctcactcaactctagtggagtgggtgtgggctggttccgtcacgccccgaggaaacggccctggaagtgggtgctacttattagtggatggacggtacgctacagtccatctcgtggaggaggagactacaccataccccaaccaaacggaacccaaacccccgaaaaccgtaacgggttacggtccttaaacaaactacgacccaccagtcggaacccttgacggaacacgacgaccaataattatttcngtcacaactactcttaaggacgganccacgtgtacgtcttcgaacctaacgtcggttcccgacccggtcgggggaaccccgtaaccgttcgggtaccttccgtactccacgcgccctaaccgacgaaccggcccngttccgggtcccttccccgcgg

SEQ ID NO: 325797 - DNA, 617 bp, Homo sapiens
  misc_feature: GZ8MTXP01DYXAR.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggtccgtcagccccaggaagcctggaatgggtgcacttattattggatgacggtacgctacagtcatctctgaggaggagactcacataccaccaaacggaccaacccccaaaacgaacggtgtccttaacaaatcgaaccaccagtcggaccctgtacggacacacgaccaatattatttctgtcgacacactctagtaggacgcaaccgtggtagtctcgacctaaacgttcgggtttacccgaccccggttcgggggaaccccgggtaaacccgttcggggtacccttacccggttcctcccgttaccgcggttcccctcccgaacccgaacgggtccccacgttcccggttcccttcccccgtcggg

SEQ ID NO: 325798 - DNA, 663 bp, Homo sapiens
  misc_feature: GZ8MTXP01A8FXY.22.38.D05.1.454.CMB.2.raw
  modified_base (467)..(467): a, c, t, g, unknown or other
  misc_feature (467)..(467): n is a, c, g, or t
  modified_base (473)..(473): a, c, t, g, unknown or other
  misc_feature (473)..(473): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgcccccaggaaacggccctggaagtgggtgctacttattatgggatgacggttacgctacagtccatctctgaggaggagactcaccatacccaccaaacggaaccaaacccccaaaaaccgaacgggttacggtcccttaacaaactacgaacccaccacgtacgggacccctggtacggaaccaacgacgcccaatacttattttccnggtacncctaaacactttacctaagttaacggacgtcctaacccgttggttaacgtcgttacgacccgtaaaacgtccggggtttacccgacccccggttggggggaacccccggtaacccgttggtacccaccggtcctccttcgcgcccctaaccgaccgtaacgggcccagttcccggtcccttccccgcggg

SEQ ID NO: 325799 - DNA, 616 bp, Homo sapiens
  misc_feature: GZ8MTXP01DYH3L.22.38.D05.1.454.CMB.2.raw
  modified_base (293)..(293): a, c, t, g, unknown or other
  misc_feature (293)..(293): n is a, c, g, or t
  modified_base (320)..(320): a, c, t, g, unknown or other
  misc_feature (320)..(320): n is a, c, g, or t
  modified_base (325)..(325): a, c, t, g, unknown or other
  misc_feature (325)..(325): n is a, c, g, or t
  modified_base (480)..(480): a, c, t, g, unknown or other
  misc_feature (480)..(480): n is a, c, g, or t
  modified_base (567)..(567): a, c, t, g, unknown or other
  misc_feature (567)..(567): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtacgaaacccacacacgaccctcacgctcgacctgctaccttctctggttctcactcaactctagtggagtgggtgtgggtctcggtccgtcgacgaccccgaggaacggccgtaggaagtggtnctacttagttagtggatgtacgtaccnctacncgtcatctcgtagaggagacgactcacactaccccaaccgaaacgaacccaaaccccaaaacgtacggtacgtccttaacaactaccgaaccaccagtcgacccttgacgaacacgacaccatattatttcagtcactactatactaggaggacnctacgtagtcgtcgtacgaacctaacggtccggtacccgccccgggtcggggaaccccggtaacttcgggtaccttaccgcttaccncgccgttcccaacgaccgaacggccctagttcccgtcccgttccgccgg

SEQ ID NO: 325800 - DNA, 673 bp, Homo sapiens
  misc_feature: GZ8MTXP01EZZWT.22.38.D05.1.454.CMB.2.raw
tcagacatacgcgtcacgaccggtgctcgatttagtatctgatagttgggtttgggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggtgcacttatttatgggatgacggttaccgctacagtccatctctgaggaggagactcaccatcccaaccaaggaacccaaacccccaaaaaccgaacgggtacggtcccttaacaatcgacccaccagtcggacccctgtacggacacacgacccaactaattacttttctgtcgaccaactacttactagtaggacgcctaacccgtggtacgtctacggaccctaaaacgttcgggttacccggacccccgttcggggggaaccccgggtaaacccgttcggggtacccttacccggttcctccccgttcgaccgttcccctaacccgaacccgaaaccgggggcccctacggttcccgggttccccgttttcccccccggtccgggg

SEQ ID NO: 325801 - DNA, 663 bp, Homo sapiens
  misc_feature: GZ8MTXP01EM3M9.22.38.D05.1.454.CMB.2.raw
  modified_base (445)..(445): a, c, t, g, unknown or other
  misc_feature (445)..(445): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacacgaccctcacgctgacctgcaccttctctggttctcactcaactctagtggagtgggtgtgggctggtccgtcacgccccaggaacggccctggaatgggtgctacttattagtggatgacggtaccgctacacgtcatctctgaggagagactcacactaccaccgaacgaaccaaaccccaaaacgaacggtacgtccgtaacaactacgaccaccgacgtcgacccttgacggaccacgacaccaactaattatttaccgngtacacctactacttacgtaggtacggacgtaccgtacgtaggtacctaccgtaacgaacccgtaaccgttccgggtacccggtaccccgggtcccggggtaaccccggtaaccgttccggtacccgttacccgtcctcccgttccgacccgttccccgaacccgacccggtaaccggtccccgtaccggttccccggttcccccgttccccggtccg

SEQ ID NO: 325802 - DNA, 619 bp, Homo sapiens
  misc_feature: GZ8MTXP01CCFAB.22.38.D05.1.454.CMB.2.raw
  modified_base (409)..(409): a, c, t, g, unknown or other
  misc_feature (409)..(409): n is a, c, g, or t
tcagacatacgcgtcacgaccggtgctcgatttagtatctgatagttgggtttgggggaggaactgctcagttaggacccagagggaaccatggaagccccagctcagcttctcttcctcctgctactctggctcccagataccaccggagaaattgtgttgacacagtctccagccaccctgtctttgtcgtccgggggaaagacgccaccctctcctgcagggccagtcagaatgttagtagttactagcctggtacagacaaagcctggccaggctcccagacctcctcatctctgactacataccaaacgacggccacgtcggacactcccgagccaggttcagtggcaggtcgggtcgtggacagtacttacactctcaccatcagcactagactctagaagtntttagacttagtttattacgtgtacgagcgagtcgtaggtctaacttccgttacgttcccttacccgtaccttaccggtttacgggacccggtaacgggggtaaccctagggtccgtaaggggtaaacacgtaaaccgaaacggtaaacgttcggttacgggcttaccggcctacgtaacttcctacgttccttcgttaactttcccccg

SEQ ID NO: 325803 - DNA, 723 bp, Homo sapiens
  misc_feature: GZ8MTXP01DQ3H7.22.38.D05.1.454.CMB.2.raw
  modified_base (465)..(465): a, c, t, g, unknown or other
  misc_feature (465)..(465): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctggttctcactcaactctagtggagtgggtgtgggctggtccgtcacgccccaggaacgcctggaagtggtgctacttattagtggatgacggtacgctacagtcatctgtggaggaggagactacaccactacccaaccgaaacggacccaaaccccccgaaaaaaccgtacgggttacggttaacccttaaacaaacgtacgaaacccaccagtacgggaccctgtacggaacacacgaccaactaattctttcnggtcacactactcctaaggtaaggacgtacctaacccggtaggttaacgtccgtacggaaaccccttaaacggttccggggttaccccgggtaaccccccgggtccggggggtaaaccccccgggtaaaccccgtttcgggggtccccaaacccgggtttccctccccttacccggacccgttcccccgtaaccccgaaacccggaaccggggtccccgacgttccccgggtttccccgttcccccccggttccgggg

SEQ ID NO: 325804 - DNA, 716 bp, Homo sapiens
  misc_feature: GZ8MTXP01EJMSV.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggtccgtcggccccaggaacggcctggatgggtgctacttattattgggatgacggttaccgctacagtcatctctgaggaggagactcacatcaacccaacggaccaaaccccgaaaaccacggtaacggtaccttaacaatacgaccaccatcggacctgtacgacacacgaccaactattaacttttctagttcgacctaactacttaccttaaagttacgggggaacgtaccgtaacccgttagggttaacgttcccgtacggtaacccctaaaacggttccggggtttaccccgggaccccccgggtttaccgggggggaccccccggggtaaaccccgttcggggttacccctaaccccgggtttcctccccgttccaaccggttccccttaccccgaaccccggaaccggggccccctaacggttccccggttccccgtttccccccgttggggtccccccgg

SEQ ID NO: 325805 - DNA, 580 bp, Homo sapiens
  misc_feature: GZ8MTXP01CL73E.22.38.D05.1.454.CMB.2.raw
  modified_base (414)..(414): a, c, t, g, unknown or other
  misc_feature (414)..(414): n is a, c, g, or t
  modified_base (452)..(452): a, c, t, g, unknown or other
  misc_feature (452)..(452): n is a, c, g, or t
  modified_base (460)..(460): a, c, t, g, unknown or other
  misc_feature (460)..(460): n is a, c, g, or t
tcagacatacgcgtcacgaccggtgctcgatttagtatctgatagttgggtttgggggaggaactgctcagttaggacccagagggaaccatggaagccccagctcagcttctcttcctcctgctactctggctccagataccaccggagaaattgtgttgacacagtctccagccaccctgtctttgtcgtccgggggaaagagccaccctctcctgcagggcagtcagaatgttagtagttactagcctggtaccagacaaaagcctggccaggcctacccagacctcctcactctctagatacataccaaacgacggccacgtcggacactccccagtcccaggttcaggtcggcgtaggtcgggtcgaggggacacgtacttcaacttcacacactcagacgactagacnctagaacgtattgactagtttatctgtcagcagtcganactattcncggtcctacgtactaccgttcggaccgtacggggaccaagcgtaaggaacgactaacgaaacggtactggttacgttcgacgaacctaacgtcttctacgttccttcgaacgtttccccg

SEQ ID NO: 325806 - DNA, 614 bp, Homo sapiens
  misc_feature: GZ8MTXP01BNYVK.22.38.D05.1.454.CMB.2.raw
  modified_base (283)..(283): a, c, t, g, unknown or other
  misc_feature (283)..(283): n is a, c, g, or t
  modified_base (315)..(315): a, c, t, g, unknown or other
  misc_feature (315)..(315): n is a, c, g, or t
  modified_base (434)..(434): a, c, t, g, unknown or other
  misc_feature (434)..(434): n is a, c, g, or t
  modified_base (438)..(438): a, c, t, g, unknown or other
  misc_feature (438)..(438): n is a, c, g, or t
  modified_base (456)..(456): a, c, t, g, unknown or other
  misc_feature (456)..(456): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaggccctggaatgggtnctacttattagtggatgacggttaccgctacngtccatctctgaggaggagactcaccatcccaaccaacggaccaacccccaaaacgacggtacgtccttacaactcgacccacatcgggaccctgtacgacacacgccacattatttcngtcncacactctaagtaggacncaaccgtggtacgtctgaccctaaacgtcgggtacccgaccccggtgggggaaccccggtaacccgttcgggtcccacccggttctcccgttacgccgcccgtaacccgacccgtaacggggcccctacgttcccgggtcccctttcccccggccggg

SEQ ID NO: 325807 - DNA, 614 bp, Homo sapiens
  misc_feature: GZ8MTXP01BUE37.22.38.D05.1.454.CMB.2.raw
  modified_base (297)..(297): a, c, t, g, unknown or other
  misc_feature (297)..(297): n is a, c, g, or t
  modified_base (328)..(328): a, c, t, g, unknown or other
  misc_feature (328)..(328): n is a, c, g, or t
  modified_base (347)..(347): a, c, t, g, unknown or other
  misc_feature (347)..(347): n is a, c, g, or t
  modified_base (430)..(430): a, c, t, g, unknown or other
  misc_feature (430)..(430): n is a, c, g, or t
  modified_base (451)..(451): a, c, t, g, unknown or other
  misc_feature (451)..(451): n is a, c, g, or t
  modified_base (456)..(456): a, c, t, g, unknown or other
  misc_feature (456)..(456): n is a, c, g, or t
  modified_base (480)..(480): a, c, t, g, unknown or other
  misc_feature (480)..(480): n is a, c, g, or t
  modified_base (557)..(557): a, c, t, g, unknown or other
  misc_feature (557)..(557): n is a, c, g, or t
  modified_base (563)..(563): a, c, t, g, unknown or other
  misc_feature (563)..(563): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcacctgaaggagtctggtcctacgctggtacgaaacccacacacgaccctcacgctcgacctcgcctaccttctcgttgggttctcactcaactctaggtggagtgggtgtgggtctggtccgtcacgccccgaggaacggcccgtaggaagtgggtnactactttaagtttgtggatggacggtaccnctacacgcatctgtgaggngagactcacactaccaaccaacggaacccaaaccccaaacgtaacggtacgtcctaacaatacgaccaccgatcggaccctgngacacgacgcaatattacttntcgancaacacgttacagggttacggacnccgtacgttagtacgtcgtacgaccgtaaacgtccggtaccgaccccgggtcggggaacccggtaccttcggtaccnccgtcnccgcttccgcctaaccgaccgaacgccccagttcccgtcccttcccgtccg

SEQ ID NO: 325808 - DNA, 696 bp, Homo sapiens
  misc_feature: GZ8MTXP01EN362.22.38.D05.1.454.CMB.2.raw
  modified_base (473)..(473): a, c, t, g, unknown or other
  misc_feature (473)..(473): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctggttctcactcaactctagtggagtgggtgtgggtctggtccgtcacgccccaggaaaggcctggaagtgggttgcacttattagttggatgacggttaccgctacagtccatctcgtgaaggaggagactcacatacccaaccgaaacggaaccaaacccccaaaaaccgaacgggttacggtaacccttaaacgaaacgtacgaacccaaccacgtacggaccccgttgaggaacacgacgcccaaactattattttaccgngtacacctaactacgttacgtaacggtacggtacgtacctaacgtggtacgtccgtacgtaaacccgtaaaccggttccgggtaccccggaccccgggtaccgggggaaccccggtaacccgttcggtacccttacccgtcctacccgttaccgcccgttacccctaaccccgacccggtaaccggtccccgtccggttcccgttcccccgttccccggtcgg

SEQ ID NO: 325809 - DNA, 716 bp, Homo sapiens
  misc_feature: GZ8MTXP01ELZPW.22.38.D05.1.454.CMB.2.raw
  modified_base (202)..(202): a, c, t, g, unknown or other
  misc_feature (202)..(202): n is a, c, g, or t
tcagacatacgcgtcacgaccggtgctcgatttagtatctgatagttgggtttgggggaggaactgctcagttaggacccagagggaaccatggaagccccagctcagcttctcttcctcctgctactctggctccagataccaccggagaaattgtgttgacacagtctccagccaccctgtctttgtcgtccggggaaanagccaccctctcctgcagggccagtcagaatgttagtagttacttagcctaggtaccagacaaagcctggccaggctcccagactcctcactctctgatacataccaaacgacggcccacgtcggcactcccgacgtccagggttcaggtggacgaggtcgggtcggttaggggactacggtacctttaccaacttcctacaaccctactcgacgtaccgaccgttaacgacggtcccttagggtaaacgtacgtttttagaccgtttaaagtttttaacgtttaactcgggttaccagtcgtaacggtacgttacggggactaacgttccgtacggttccccttacccgttaccgtacccgttttacggggaccccgtaaaggggggtaccctaaacgggcccggtaagggtaaacgttacgtaaaccgttaaaacgggtaaaccgtttggggaacggcgttacggaaccctaactctttcggtcgtttacctttccgttaaccgtttccccg

SEQ ID NO: 325810 - DNA, 640 bp, Homo sapiens
  misc_feature: GZ8MTXP01EU55Z.22.38.D05.1.454.CMB.2.raw
  modified_base (284)..(284): a, c, t, g, unknown or other
  misc_feature (284)..(284): n is a, c, g, or t
  modified_base (322)..(322): a, c, t, g, unknown or other
  misc_feature (322)..(322): n is a, c, g, or t
  modified_base (454)..(454): a, c, t, g, unknown or other
  misc_feature (454)..(454): n is a, c, g, or t
  modified_base (575)..(575): a, c, t, g, unknown or other
  misc_feature (575)..(575): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgccaccttctctgggttctcactcaactctagtggagtgggtgtgggctggttccgtcacgccccaggaacggccctggatgggtncacttattagtggatgacggtacgctacagtcatctcngaggagagactcaccactacccaccgaaacggaacccaaacccccaaaaaccgaacgggttacggtaacccttaaacaaactacgaacccaaccacgtcggaccctgtacggacacacgaccatatatttcngtcacactactctaagacggacgactaccgtggtaactcgtacacccgtaaacgttcggtacccggaccccggttcgggggaaccccggtaacccgttcggtccttacccgtccgtacccncgaccgcccctaacccggaccgaaccggggtcccctacggttcccggtcccgttcccccgtcggg

SEQ ID NO: 325811 - DNA, 652 bp, Homo sapiens
  misc_feature: GZ8MTXP01A4I0I.22.38.D05.1.454.CMB.2.raw
  modified_base (445)..(445): a, c, t, g, unknown or other
  misc_feature (445)..(445): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctggttctcactcaactctagtggagtgggtgtgggctggtccgtcacgccccaggaagcctggagtggtgctattattagtggatgacggtacgctacagtcatctcgtgaggaggagactacaccatacccaaccgaacgaacccaaaccccaaaaccacggttacgtcctaacaactacgacccaccacgtcgaccctggtacgaccacacgacctaactaagtttactttacgngttacgacctaacctacttacgtaacgggtagggactccgtaaccggttggtactcgtacgtaaccctaaacggttccggttaccccggaccccgtcggggggaaccccgtaacccgttgggtaccccaccgttcctacccttcgccgcccgtaacccgaaccgtaaccgggccctacggttcccgggttccccttccccggccggg

SEQ ID NO: 325812 - DNA, 654 bp, Homo sapiens
  misc_feature: GZ8MTXP01E1TDS.22.38.D05.1.454.CMB.2.raw
  modified_base (316)..(316): a, c, t, g, unknown or other
  misc_feature (316)..(316): n is a, c, g, or t
  modified_base (336)..(336): a, c, t, g, unknown or other
  misc_feature (336)..(336): n is a, c, g, or t
  modified_base (456)..(456): a, c, t, g, unknown or other
  misc_feature (456)..(456): n is a, c, g, or t
  modified_base (483)..(483): a, c, t, g, unknown or other
  misc_feature (483)..(483): n is a, c, g, or t
  modified_base (591)..(591): a, c, t, g, unknown or other
  misc_feature (591)..(591): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctggttctcactcaactctagtggagtgggtgtgggctggttccgtcacgcccccaggaacgcctggaatgggtgcactttattagtgggatggacggttaccgctacngtccatctcgtgaggagganactcaccgactaccccaaccgaacggaacccaaaccccccgaaaaccgacgggtacgttaaccttacaactcgaccacacgtcgaccctggtacggacacgagaccactacttatttccngtcaccactactacgtacggtacgacnccgtacgtggtactcgtacgaacccgtaacgtccggggtaccccgaccccggggtccggggaaccccggtaacccgttcggtaccccacccgtccctcccgccgcccnccccgtaacccgaccccggtaaccggtcccctaccgttccccggttcccccgttccccggcgg

SEQ ID NO: 325813 - DNA, 673 bp, Homo sapiens
  misc_feature: GZ8MTXP01B6UA0.22.38.D05.1.454.CMB.2.raw
  modified_base (280)..(280): a, c, t, g, unknown or other
  misc_feature (280)..(280): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctggttctcactcaactctagtggagtgggtgtgggctggttccgtcagccccaggaaggccctggatgggtncacttattattgggatggacggttaccgctacagtccatctctgaggaggagactcacactacccaccgaaacggaacccaacccccaaaaaccgacgggttacggttccttaacaactcgacccaccacgtcgggacccctgtacggaccacacgccctaatacttatttctgtcgaccactaacttctaaggttaacgggacgtcctaccgtaggttacgtcctacggacccgtaaaccgttcggggttaccccgaccccgggtcggggggaacccccgggaacccgttcgggtcccttacccgttcccgtcccttcgccgccccttccccgaaccccggaaccggggtcccctacggttccccggttccccgtttcccccggtcccgggg

SEQ ID NO: 325814 - DNA, 673 bp, Homo sapiens
  misc_feature: GZ8MTXP01AK1D1.22.38.D05.1.454.CMB.2.raw
  modified_base (455)..(455): a, c, t, g, unknown or other
  misc_feature (455)..(455): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtagaaacccacacagaccctcacgctgacctgcaccttctctggttctcactcaactctaggtggtagtgggtgtgggctggttccgtcacgccccaggaaaggccctaggagtgggtgctacttatttagtggtatgtacggttaccgctacacgtcatctcgtgaggaggagactcaccatacccaccaaacggacccaaccccaaaacgacggtacgtctaacaactcgaccacacgtcgacccttggacgaccaacacgaccctaatattactttctcggtanacctaactactacttaagggacggactaccgtaccgttgggtacgtccgtacggaacccgtaaacgttccgggttaaccccgggaccccggttccggggggaacccccggtaaccgttcggtacccgttcccggtaccctccgttacccgcgttacccccaacccgaccggtaaccgggccccgtacgttccccggtttccccgttccccggtccggg

SEQ ID NO: 325815 - DNA, 669 bp, Homo sapiens
  misc_feature: GZ8MTXP01AYUUX.22.38.D05.1.454.CMB.2.raw
  modified_base (446)..(446): a, c, t, g, unknown or other
  misc_feature (446)..(446): n is a, c, g, or t
  modified_base (615)..(615): a, c, t, g, unknown or other
  misc_feature (615)..(615): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgccccaggaaacggccctggatgggtgctacttatttatggtatggacggttaccgctacagtccatctctgaggaggagactcacatacccaaccgaacggaacccaacccccaaaacgaacgggttcggtcctttaacaatcgaacccaccacgtcgggaacccctggtgaaccacacgaccctaanattactttctgtcgactaaccacttcctaaggtaacgggacgacctaacccgttgggtaacgtccttacgaaacccgtaaacgttcccggggttaccgacccccgggttcggggggaacccccgggaaacccgtttcgggacccttacccgggtccctccttaccgacncccctaaccgaccggaacggtccccaggttccccggttccttaacccccgtggg

SEQ ID NO: 325816 - DNA, 620 bp, Homo sapiens
  misc_feature: GZ8MTXP01AX3TY.22.38.D05.1.454.CMB.2.raw
  modified_base (454)..(454): a, c, t, g, unknown or other
  misc_feature (454)..(454): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctggttctcactcaactctagtggagtgggtgtgggctggtccgtcacgccccaggaacggccctggaagtgggtgctactttagtttagttgggatggacggttaccgctacagtccatctcgtggaggaggagactcacactaccaaccaacggaacccaaacccccaaaacgaacgggtacgtccttaacaaactcgaaccaccacgtcgacccttgacggaacacacgaccaatatactttcngtcacactactctaggtacggacgtactaaccgttggtacgtctacgaacctaacgttcggttacccgacccggtcgggggaaccccgtaaccgttcgtccgaccgtctcccttcgaccgccctaaccgaccgaacgggccctgttcccggtccgttccccgtcgg

SEQ ID NO: 325817 - DNA, 651 bp, Homo sapiens
  misc_feature: GZ8MTXP01AMLV6.22.38.D05.1.454.CMB.2.raw
  modified_base (454)..(454): a, c, t, g, unknown or other
  misc_feature (454)..(454): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctagtacgaaacccacacacgaccctcacgctgacctgctaccttctcgtggttctcactcaactcgtagtggagtgggtgtgggtctcggttccgtcacgccccgaggaacggccgtggagtggtgctacttagttagtggatacggtacggttaccgctacagtccatctcgtaggaggaggacgactacacactaccccaaccgaacgaacccaaaccccaaacgtaacggtacgtcctaacacgtacaccacacgtcgacctgacgacacacgaccatattcttcncgacaccaactactactaaggtacggactccgtacggtgtacgtcgtacgtaaccgtaacgttccgggtacccggacccggtccgggggaaccccggtaaccgttcgggtcccttaccggtcctccgttccgccgttaccccgtaaccgaaccggtaaccggccctacggttccccggtcccgtttccccgcccggg

SEQ ID NO: 325818 - DNA, 609 bp, Homo sapiens
  misc_feature: GZ8MTXP01A7O2H.22.38.D05.1.454.CMB.2.raw
  modified_base (541)..(541): a, c, t, g, unknown or other
  misc_feature (541)..(541): n is a, c, g, or t
tcagacatacgcgtcacgaccggtgctcgatttagtatctgatagttgggtttgggggaggaactgctcagttaggacccagagggaaccatggaatccccagctcagcttctcttcctcctgctactctggctcccagataccaccggagaaattgtgttgacacagtctccagccaccctgtctttgtcgtccgggggaaagagccaccctctcctgcagggccagtcagaatgttagtagttacttagctggtaccagcaaaagcctggccaggctcccagactcctcatctctgatacatacccaacagggccacgtggcactccccagccctaggttccagtggctaggtcggggtctggggaacacggtacttaccaccttctacaacccataccagccgacctaggacgacctagaagttatttagcttaagttttacttacgttgtactagacgagccgttaggctagttcgtcgtccctaccgtaccgtaccgtttcggaccgtacgggggaccaaggccgtaagggaaganaacgaaacgtaacgtggttacggcttacggaaccaccgtaattccgtgttccttccttaacttccccg

SEQ ID NO: 325819 - DNA, 669 bp, Homo sapiens
  misc_feature: GZ8MTXP01A1J6C.22.38.D05.1.454.CMB.2.raw
  modified_base (461)..(461): a, c, t, g, unknown or other
  misc_feature (461)..(461): n is a, c, g, or t
  modified_base (586)..(586): a, c, t, g, unknown or other
  misc_feature (586)..(586): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgccaccttctctggttctcactcaactctagtggagtgggtgtggctggttccgtcgacgcccccgaggaaacggccctggaagtgggttgctactttatttagttggatgacggttaccgctacagtcatctcgtggaggaggagactcacactacccaaccgaaacggaacccaaacccccaaaacgaacggtacgtccttaacaactacgaccaccagtacggaccctgtaggaaccacgacgaccaactattactttcncgtacaccaactactactaaggtaggacgtcaccgttgggtactcgtacgaccctaaacgttcgggtcccgaccccgggtcggggaaccccggtaaccgttcgggtacccaccgttccgtacccnccgttaccgccccttaacccgaacccgggtaaacccgggtccccctacggttccccggttccccgtttccccccggtccgggg

SEQ ID NO: 325820 - DNA, 678 bp, Homo sapiens
  misc_feature: GZ8MTXP01CD04N.22.38.D05.1.454.CMB.2.raw
  modified_base (453)..(453): a, c, t, g, unknown or other
  misc_feature (453)..(453): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtacgaaacccacacagaccctcacgctgacctgcaccttctctggttctcactcaactctagtggagtgggtgtgggctggttccgtcacgcccccgaggaaacggccctggaagtgggttgctacttatttagtggatgacggttaccgctacagtccatctcgtgaggagagactcacatcccaaccaacggaacccaaaccccaaaaccgaaggttacgtcctacaagtcaccacagtcggaccctgtacggacacacgaccaactattactttctggtacncctaactacttacgtaaggtaacgggactacccgtaccgttagggtacgtccgtacgtaaccctaaaaccggtttcgggttacccccggaccccgggtccggggggaacccccgtaaccgttcggtaccccgttaacccggttcctcccaccgttccgaccccttaacccgaccgtaaccggggtccccctacggttccccggttccccgtttcccccggccggg

SEQ ID NO: 325821 - DNA, 725 bp, Homo sapiens
  misc_feature: GZ8MTXP01DYZMB.22.38.D05.1.454.CMB.2.raw
  modified_base (282)..(282): a, c, t, g, unknown or other
  misc_feature (282)..(282): n is a, c, g, or t
  modified_base (313)..(313): a, c, t, g, unknown or other
  misc_feature (313)..(313): n is a, c, g, or t
  modified_base (527)..(527): a, c, t, g, unknown or other
  misc_feature (527)..(527): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgccccaggaacggccctggatggtnctacttattatggatgacggttaccgctacngtccatctcgtagaggaggagacctcaccataccccaaaccgaacggaaacccaaacccccgaaaacccgaacgggttaccggttaacccttaacaaacgttaccgaacccacccgtacgtaccgggtaacccctggtacggaaccaaccgacgaccctaaactaacgtttatttccgtagtcgaccaactacgttacgtaaggtacggggacnccgtaacccgttggtaaccgtcgtacgaacccgttaaaccgttcgggttaccccgaccccgggtcgggggaaccccgggtaacccgttcggtacccgttacccggttccctacccgttccgccgttaccccgtaaccccgaacccggtaacccggggtccctaccggttcccggtttccccgttcccccggtcccggg

SEQ ID NO: 325822 - DNA, 545 bp, Homo sapiens
  misc_feature: GZ8MTXP01BKWFR.22.38.D05.1.454.CMB.2.raw
  modified_base (421)..(421): a, c, t, g, unknown or other
  misc_feature (421)..(421): n is a, c, g, or t
tcagacatacgcgtcacgaccggtgctcgatttagtatctgatagttgggtttgggggaggaactgctcagttaggacccagagggaaccatggaagccccagctcagcttctcttcctcctgctactctggctcccagataccaccggagaaattgtgttgacacagtctccagccaccctgtctttgtctccgggggaaagagccaccctctcctgcagggccagtcagaatgttagtagttacttagcctggtaccagcaaaagcctggccaggctcccagactcctcatctctgatacatccaacaggccagtcggcactcccagccaggttcagtggcaggtcgggctgggacagacttcactctcaccatcagcgactagacgcctagaagtacttttgactagtttattacgtntcagtcagcgtaggcatctcggccctcgtactaccttggaccgtacggggaccaaggctaaggacactaacaaacggaacttgacggcttagcccaccgaattccagttcctcttaacttcccc

SEQ ID NO: 325823 - DNA, 584 bp, Homo sapiens
  misc_feature: GZ8MTXP01CYUEA.22.38.D05.1.454.CMB.2.raw
  modified_base (420)..(420): a, c, t, g, unknown or other
  misc_feature (420)..(420): n is a, c, g, or t
  modified_base (428)..(428): a, c, t, g, unknown or other
  misc_feature (428)..(428): n is a, c, g, or t
  modified_base (450)..(450): a, c, t, g, unknown or other
  misc_feature (450)..(450): n is a, c, g, or t
  modified_base (559)..(559): a, c, t, g, unknown or other
  misc_feature (559)..(559): n is a, c, g, or t
  modified_base (577)..(577): a, c, t, g, unknown or other
  misc_feature (577)..(577): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagccccaggaacggccctggatggtgctacttattatggatgacggttaccgctacagtccatctcgtgaggaggagactcacatcccaaccaaacggaccaacccccaaaacaacgggtcgtcctaacaatcgaccacactcggaccctgtcgacacacgccanattattcngtgctacactctaagtacggancctaccgtggtacgtctacgacctaaacgtccgggttaccgaccccggtcgggggccccggtaacccggttcacccgttctccgcacgcccttaccaaccgacggcccngtccgttcccttccccgnggtcccg

SEQ ID NO: 325824 - DNA, 785 bp, Homo sapiens
  misc_feature: GZ8MTXP01A24LM.22.38.D05.1.454.CMB.2.raw
  modified_base (199)..(199): a, c, t, g, unknown or other
  misc_feature (199)..(199): n is a, c, g, or t
tcagacatacgcgtcacgaccggtgctcgatttagtatctgatagttgggtttgggggaggaactgctcagttaggacccagagggaaccatggaagccccagctcagcttctcttcctcctgctactctggctccagataccaccggagaaattgtgttgacacagtctccagccacctgtctttgctccggggaaangccacctctcctgcagggccagtcagaatgttagtagttacttagcctgtaccagacaaagctggccaggctcccagactcctcatctctgactaacactacccaacgacggggcccaacgtggacactccccgaagtcccaagggtttcaggtacgggtcgtaacggttcgggggtaccttgggggaacctaggtaaccctttcgaacctttcccgtccaaacccgacttaccgaacgtacccggtaaacccgtaagaccgtacccgttaaggtaaacggttaagtttttacggtaacgtttaaacggtttttaacttttaaccgtaggtttaccgaaagttccgaacgtaccgggttaacggggtacttaacgttaccgttccggggtcccctttaaccccggggttaaccttacccggttttaccggggaccccggtaaccgggggtaaaccctaacgggacccggttaaggggaaacggttaaactaacccggttaaaacgaaaccggttaggttaccgggcgttacggaacctaacccgtaacttccgttacgtttccctttaacttaaccgttttccccg

SEQ ID NO: 325825 - DNA, 614 bp, Homo sapiens
  misc_feature: GZ8MTXP01COJXB.22.38.D05.1.454.CMB.2.raw
  modified_base (204)..(204): a, c, t, g, unknown or other
  misc_feature (204)..(204): n is a, c, g, or t
tcagacatacgcgtcacgaccggtgctcgatttagtatctgatagttgggtttgggggaggaactgctcagttaggacccagagggaaccatggaagccccagctcagcttctcttcctcctgctactctggctcccagataccaccggagaaattgtgttgacacagtctccagccaccctgtctttgtcgtccgggggaaanagccaccctctcctgcagggccagtcagaatgttagtagttacttagcctggtaccagacaaaagcctggccaggctcccagacctcctcatctctgatacatccaaacgacgggccacgtcggccactccccgagccgaggttcaggtggcaggtcgggtcgtggggacagtactacactctcaccatcagcgactagacgctagaacgtatttgacttagtttacttactgtacagcgagtacgtaggctagttcgtcggtccctccgtaccgtaccgtttacggaccggtaacggggtaaccaaggtccgtaaggaacgacttaaaccgaaacgtaaacgtggttacggttccgttcggaacctaacctaacgttccgttgttaccctttaacttcgtttaaccccg

SEQ ID NO: 325826 - DNA, 587 bp, Homo sapiens
  misc_feature: GZ8MTXP01A99TV.22.38.D05.1.454.CMB.2.raw
  modified_base (427)..(427): a, c, t, g, unknown or other
  misc_feature (427)..(427): n is a, c, g, or t
  modified_base (447)..(447): a, c, t, g, unknown or other
  misc_feature (447)..(447): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggtgctacttatttagtggatgacggttaccgctacagtccatctctgaggaggagactcacatcccaccaacggacccaaccccaaaacgaggtcgtcctacaatcgaccacatcggaccctgtagacacagccactatactttcngtgcacactactagtagganccacgtggtatctgaccctaaacgtcggtaccgaccccgtgggggaaccccggaaccttcgggtccaccgtcctcccgttcgacgcccctaaccgacccgtaacggggcccctagttcccggttcccttcccccggtcgg

SEQ ID NO: 325827 - DNA, 683 bp, Homo sapiens
  misc_feature: GZ8MTXP01BNOXZ.22.38.D05.1.454.CMB.2.raw
  modified_base (283)..(283): a, c, t, g, unknown or other
  misc_feature (283)..(283): n is a, c, g, or t
  modified_base (476)..(476): a, c, t, g, unknown or other
  misc_feature (476)..(476): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctggttctcactcaactctagtggagtgggtgtgggctcggtccgtcacgccccgaggaacggcctaggatgggtnctacttattagtggatgacggttaccgctacacgtctatctcgtaggaggaggacactacaacactaccccaaaccgaacggaaccctaaacccccgaaaaccgtaacgggtaccggtaaccttaacaaactacgaacccaccacgtcggaccctaggtacgaaccacgagccaactatttactttcgtacgntacaactaccttaccgtaagggtacggacgtacctaccgttaggttaccgtcgttacgacccgtaaaccggttcggttaccccggacccggttccgggggccccggaaaccgttcgggttacccaccggtccctaccgttccgccgttcccctaacccggaccgtaacgggcccctaggttccccgtaacccgttcccccgtccggg

SEQ ID NO: 325828 - DNA, 657 bp, Homo sapiens
  misc_feature: GZ8MTXP01BW67F.22.38.D05.1.454.CMB.2.raw
  modified_base (615)..(615): a, c, t, g, unknown or other
  misc_feature (615)..(615): n is a, c, g, or t
  modified_base (634)..(634): a, c, t, g, unknown or other
  misc_feature (634)..(634): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctggttctcactcaactctagtggagtgggtgtgggctggttccgtcacgccccaggaaacggccctggaagtgggtgctacttatttagttgggatgacggttaccgctacagtccatctctgaggaggagactcacactacccaccaaggaacccaaacccccaaaaaccgaacggttacggtccttaacaaactacgaccaaccacgtacggacccctggtacggaaccaccgacgtacccaactactttaactttcgtaggttcaccaacctacttaccctaaggttaaggggaccgtacctaaccgtagggttacgtaccttcggaaccctaaacgttccggttacccggaccccggtcgggggaaccccggtaaccgttcgggtcacccgtctccttcgccnccctccaccgaacggcccncgttaccgtcccttcccgtccgg

SEQ ID NO: 325829 - DNA, 637 bp, Homo sapiens
  misc_feature: GZ8MTXP01CZU67.22.38.D05.1.454.CMB.2.raw
  modified_base (286)..(286): a, c, t, g, unknown or other
  misc_feature (286)..(286): n is a, c, g, or t
  modified_base (318)..(318): a, c, t, g, unknown or other
  misc_feature (318)..(318): n is a, c, g, or t
  modified_base (327)..(327): a, c, t, g, unknown or other
  misc_feature (327)..(327): n is a, c, g, or t
  modified_base (431)..(431): a, c, t, g, unknown or other
  misc_feature (431)..(431): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtcgaaacccacacacgaccctcacgctgacctgcctaccttctctggttctcactcaactctagtggagtgggtgtggctggtccgtcacgccccaggaacggccctggaagtgggtnctacttatttagtggatcgacggttcgctacngtccatctntagaggagacgactcacactacccaccgaacggacccaaaccccaaaacgagtacgtctacaatacaccacacgtcgacctgtcgacacagaccacattattcngtcacactactactaaggtacggacgacctacgttaggtacgtacgtcggaaccctaaacggttccgggttacccggaccccgggtcgggggaaccccgggtaacccttcggggtacccttacccggttacctcccgacgttcgacccctaacccgaaacggaacccgggaccctacggttcccggttcccgtttccccgcccggg

SEQ ID NO: 325830 - DNA, 721 bp, Homo sapiens
  misc_feature: GZ8MTXP01APP17.22.38.D05.1.454.CMB.2.raw
  modified_base (250)..(250): a, c, t, g, unknown or other
  misc_feature (250)..(250): n is a, c, g, or t
  modified_base (275)..(275): a, c, t, g, unknown or other
  misc_feature (275)..(275): n is a, c, g, or t
  modified_base (314)..(314): a, c, t, g, unknown or other
  misc_feature (314)..(314): n is a, c, g, or t
  modified_base (324)..(324): a, c, t, g, unknown or other
  misc_feature (324)..(324): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtcttgtcctacgctggtgaaacccacacagaccctcacgctgacctgcaccttctctggttctcactcaactctagtggagtgggtgtggctggtccncagccccaggaagcctggatgggtncacttatttatggatgacggttacgctacagtccatctntgaggagganacgtcaccactcccaaccaacggaccaaacccccgaaaacgacgggttcgggtaacccttacaaactcgaacccaccgatcggaaccctggtacggacaacacgaccaactacttaatttccgtgttcgacctaaccactttacctaaggttaacggggacgaccgtaacccgttgggtaacgtccgttaacggacccgtaaaaccgttccggggtttaacccggaccccccgggttaccggggggcccccggggtaaaccccgttcggggtaccccgttacccgggttcccctttccccgttaccggaccgttcccccgttaaccccgaccccgaaaccgggggtccccctaacggttccccggggttcccccttttaaccccccggtccccgggg

SEQ ID NO: 325831 - DNA, 794 bp, Homo sapiens
  misc_feature: GZ8MTXP01BDBVJ.22.38.D05.1.454.CMB.2.raw
  modified_base (285)..(285): a, c, t, g, unknown or other
  misc_feature (285)..(285): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcacctgaaggagtctggtcctacgctggtacgaaacccacacacgaccctcacgctgacctgcctaccttctcgtggttctcactcaactcgtagtggagtgggtgtgggtctggtccgcacgcccgaggaagcctaggagtggtnctattattagtggtatggtacggtacgctacgacgtcatctcgtaggaggtaggacgacctacgacctaactaccccgaaaccgaaaccggaaaccccgaaaaccccccgaaaaaaccggtaacgggttaaccggttaaccctaaacgtaaacgttaccgaaaccctaaccgtagtaccgggtacccgtaggtaacggaaccaacgaccgtaccctaattaaactttacgttttaccgtacggtacgaccctaaacctaacgttaacccggtttaaggttaaccggggacgtaccctaaccgggttacggttaacgttcccgtaccgtaaacccgttaaaacggtttcccggggttaccccgtaaccccggggtcccggggggtaaccccgtaaccccgttcgggtaccccttacccggtccctcccgttacccgccgttacccgtaaccccggaacggtcccgggtacccctacggtttccccggtcccgtttaacccccgggcccgg

SEQ ID NO: 325832 - DNA, 690 bp, Homo sapiens
  misc_feature: GZ8MTXP01AB949.22.38.D05.1.454.CMB.2.raw
  modified_base (286)..(286): a, c, t, g, unknown or other
  misc_feature (286)..(286): n is a, c, g, or t
  modified_base (438)..(438): a, c, t, g, unknown or other
  misc_feature (438)..(438): n is a, c, g, or t
  modified_base (466)..(466): a, c, t, g, unknown or other
  misc_feature (466)..(466): n is a, c, g, or t
  modified_base (471)..(471): a, c, t, g, unknown or other
  misc_feature (471)..(471): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctggttctcactcaactctagtggagtgggtgtgggctggttccgtcacgcccccaggaaacggcctggagtgggttcnctactttatttagtgggtatgtaccggttaccgtactaccagtccattctcgtgaggaggagactcaaccactccccaaccaacggaacccaaacccccgaaaacacggtacggtccttaaacaaactcgaaccctacgactacggtacccncgtaggaaccacgatacccaataacttntttcncggtcactaacgacttacctaaggtacggacggaccaaccggttagtacgttccgaggtaacccctaaaacggttccggggttaacccccgccccgggttaccgggggaacccccgtaaccgttccgggtacccttaacccgggtccctccccggttcaccggcccctaaccgaacccgaacgggtccccagttcccggtccccttaaccccggcccgg

SEQ ID NO: 325833 - DNA, 625 bp, Homo sapiens
  misc_feature: GZ8MTXP01EJQ6X.22.38.D05.1.454.CMB.2.raw
  modified_base (270)..(270): a, c, t, g, unknown or other
  misc_feature (270)..(270): n is a, c, g, or t
  modified_base (449)..(449): a, c, t, g, unknown or other
  misc_feature (449)..(449): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtagaaacccacacagaccctcacgctgacctgcaccttctctgggttctcactcaactctagtggagtgggtgtgggctggtccgcacgcccaggaaggccnggatggtgctattattattggatgacggttaccgctacagtccatctcgtgaggaggagactcaccatacccaaccgaaacgaacccaaacccccaaaaaccgaacggtacggtaaccctaacaaatacgaacccaccaacgtcggtaccctgtacgacacgacgccaactatatttcngtcacacactactaagaggtacgaccaccgtggtacgtctacgacctaaacgtccggttacccggaccccggttcgggggaacccccggtaaccgttcggtacccaccggtcctccgttccacgcccctaacccgaccgtaacgggcccctacgttcccggtccttcccccgtcgg

SEQ ID NO: 325834 - DNA, 660 bp, Homo sapiens
  misc_feature: GZ8MTXP01APUBP.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctggttctcactcaactctagtggagtgggtgtgggctggttccgtcacgccccgaggaacggccctggaagtgggtgctacttatttagttgggatgacggttaccgctacagtccatctctgaggaggagactcaccactacccaaccgaaacggaacccaaaccccaaaaaccgtaacgggtacgtaaccctaacaaatacgaacccaccacgtcgaccctgtacgacacacgccaactattacttcgtgtacgacaactacttactaaggttaacgggacgtacctaacccgttgggtacctcgtacgtacccaaacgttcgggtacccggtaccccggtccgggggccccggtaaaccgttcggtacccacccgtccgtcccttccgaccgttcccgtaaccccaccgaaccggcccctacgttcccgggtaaccctttccccgccgg

SEQ ID NO: 325835 - DNA, 666 bp, Homo sapiens
  misc_feature: GZ8MTXP01EXU92.22.38.D05.1.454.CMB.2.raw
  modified_base (233)..(233): a, c, t, g, unknown or other
  misc_feature (233)..(233): n is a, c, g, or t
  modified_base (490)..(490): a, c, t, g, unknown or other
  misc_feature (490)..(490): n is a, c, g, or t
  modified_base (615)..(615): a, c, t, g, unknown or other
  misc_feature (615)..(615): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtagaaacccacacagaccctcacgctgacctgctacctctctggttctcactcaactctagtggngtgggtgtgggctcggttccgtcacgcccccgaggaaacggccctaggaagtgggtgctacttatttagttgggatggtaccggttaccgctacacgtccattctcgtaggagggaggacgactacaccactaccccaaacccgaaacggaaaccccaaaaccccccgaaaaaccgtaacgggttaccggttaacccttaaacaaacgtcgaacccacacgtcggaccctgtacgacacgacaccaatactatttcngtcactaacactctaagcggacgcctaccgtgggttactcgtacgaccctaaacggtccgggttaccccgaccccggggttcgggggaacccccggtaaccttcgggtccacccgttctcccacncggttccctaacccacggcggtcccctagttcccggtccccttcccgccgg

SEQ ID NO: 325836 - DNA, 636 bp, Homo sapiens
  misc_feature: GZ8MTXP01D6R3U.22.38.D05.1.454.CMB.2.raw
  modified_base (284)..(284): a, c, t, g, unknown or other
  misc_feature (284)..(284): n is a, c, g, or t
  modified_base (315)..(315): a, c, t, g, unknown or other
  misc_feature (315)..(315): n is a, c, g, or t
tcagacatacgcgtcacgaccggtgctcgatttagtatctgatagttggggtttgggggagtgactcctgtgccccaccatggacacactttgctccacgctcctgctgctgaccatcccttcatgggtcttgtcccagatcaccctgaaggagtctggtcctacgctggtacgaaacccacacagaccctcacgctgacctgcaccttctctggttctcactcaactctagtggagtgggtgtgggctggttccgcacgccccgaggaacgcctggagtggtnctacttattagtggatgtacggtacgctacncgtcatctcgtgaggagagactcacatacccaaccgaaacgacccaaaccccaaaaccgtaacggtacgtcctaacaaactacgaccacacgtcggacctgtacgaacacgacgaccaacttattactttacgtgtacacaactactacgtaaggtacggactccgtaccgttggtacgtccgtacgaacctaaacgttcggtacccggaccccggtcgggggaaccccgtacgttcggtacccacccggttctccgttcgcccgttcctaacccgaacccgaacgggtcccctacgttcccggtccccgttcccgcccgg

SEQ ID NO: 325837 - DNA, 625 bp, Homo sapiens
  misc_feature: GZ8MTXP01D1H4Z.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggttgcacttatttattgggatgacggttaccgctacagtccatctctgaggagagactcacatccacaagacaccccaaaacagtacgtctacaatcgaccaccatgacccctgtcgacacacgccaacattatttctgtcgcacaacttcagttaaggcgtcaccgttggtaacgtctagacctaaacgttcgggtaccgaccccgtgggggccccgggtaaacccttgggtcccgttaacccggttctccccgttacgccggttaccccttaaccccgaaacccggtaaaccgggggccccctaacgttcccgggttcccccgttttccccccggtccgggg

SEQ ID NO: 325838 - DNA, 719 bp, Homo sapiens
  misc_feature: GZ8MTXP01CUXCP.22.38.D05.1.454.CMB.2.raw
tcagacatacgcgtcacgaccggtgctcgatttagtatctgatagttgggtttggggagtgactcctgtgcccaccatggacacactttgctccacgctcctgctgctgaccatcccttcatgggtcttgtcccagatcaccctgaaggagtctggtcctacgctggtacgaaacccacacacgaccctcacgctgacctgctaccttctcgtggttcctctactacaactcgtagtggaggtgggtgtgggctcggttccgtcgacgaccccgaggaaacggcccgtaggaagtggtgtctactttagttagtggtatcggtaccggttacgactacacgtcctatctcgtaggaggaaggacgactacgacactaaccccaaaccgaaacggaacccaaaacccccgaaaaacggtaacggtaccggttaaccctaaacgtaaactaccgaacccaaccgacgtacggaccccgtgtacggaaccaacacgtacctaactatttactttcgagttacgactaactacctacgttaagtacggacgtacctccgttagtacgttccgtaacgtaacccgtaaaccggttcgggttacccggaccccgggtccggggaaccccgggtaaccgttcgggtacccaccggttctcccttacgttcccgacccaacccgaaccggaacggtcccctacgttcccgttcccttccccgtccgg

SEQ ID NO: 325839 - DNA, 631 bp, Homo sapiens
  misc_feature: GZ8MTXP01CLUW8.22.38.D05.1.454.CMB.2.raw
  modified_base (447)..(447): a, c, t, g, unknown or other
  misc_feature (447)..(447): n is a, c, g, or t
tcagacatacgcgtcacgaccggtgctcgatttagtatctgatagttgggtttgggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggtccgtcagccccaggaaggcctggatgggtgctacttatttagttgggatgtacggttaccgctacagtccatctcgtgaggaggagactcacactacccaaccaacggacccaacccccaaaaaccgaacgggtacggtccctacaaactcgaccaccactcgggaccctggtacgacacagaccatattactttcngtcgcacactctagtaggacgccaccgttggtagtctagaccctaaacgtccgggtacccgaccccggttcgggggccccggtaacccgttcgggtcccaccggttcctcccgttccgaccgttccctaacccgacccgaaccgggtcccctacgttcccgggttccccgttcccccgtccggg

SEQ ID NO: 325840 - DNA, 650 bp, Homo sapiens
  misc_feature: GZ8MTXP01AWZ6Q.22.38.D05.1.454.CMB.2.raw
  modified_base (238)..(238): a, c, t, g, unknown or other
  misc_feature (238)..(238): n is a, c, g, or t
  modified_base (464)..(464): a, c, t, g, unknown or other
  misc_feature (464)..(464): n is a, c, g, or t
  modified_base (471)..(471): a, c, t, g, unknown or other
  misc_feature (471)..(471): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtagaaacccacacacgaccctcacgctcgacctgcctaccttctcgtggttctcactcaactctagtggngtgggtgtggctgtcgcacgcccaggaacgcctggaagtggtgctacttatttagtggatgtaccggttaccgctacacgtccatctcgtggaggaggacgactacaccactaccccgaaccgaaacggaacccaaacccccgaaaacgtacggtaccggttaacctaacaaactacgacccacctacgtcggacccgttgacgacacgacgacctatattacttntcgtacnctaactacttctaaggtacgggacgtcctaccgtggtacgtctacgacctaaacgtcggtacccggcccgggtcggggccccggtaaccgttcggtcccacccggttcctacccgttcgccttcccgtaacccgaccggtaaccggtaccctcgttcccggttcccttccccggtccgg

SEQ ID NO: 325841 - DNA, 737 bp, Homo sapiens
  misc_feature: GZ8MTXP01CBKNC.22.38.D05.1.454.CMB.2.raw
  modified_base (319)..(319): a, c, t, g, unknown or other
  misc_feature (319)..(319): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgcccccaggaaaggccctggaatgggtgctacttatttagtgggatgacggttaccgctacngtccatctctggaggagacgactcaccactacccaaccgaaacggaacccaaacccccgaaaaaccgacgggttacggtcccttaacaactacgacccaccactcgaccctgtacggaccacacgcccaatactttatttctgtacgacctaactacttacgtaagggtacggacgtccgtaacccgttgggtaacgtccgtacggtaacccctaaaacgttccggggttacccggtaccccccgggttccgggggggaacccccccgggtaaaccccgtttccgggggtaaccccttaaccccgggttcccttccccgttaccgacccgttacccccgttaacccgaaacccccggtaaaccgggggtccccctacggtttccccgggttcccccgttttccccccgtaacccgggg

SEQ ID NO: 325842 - DNA, 729 bp, Homo sapiens
  misc_feature: GZ8MTXP01B6AHJ.22.38.D05.1.454.CMB.2.raw
  modified_base (288)..(288): a, c, t, g, unknown or other
  misc_feature (288)..(288): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctggttctcactcaactctagtggagtgggtgtgggctggttccgtcacgcccccgaggaaacggccctaggaagtgggtnctacttatttagtggatggacggttaccgctacagtccatctctggaggaggagactcaccataccccaaccgaaacggaacccaaacccccaaaacgtaacgggtcgtaaccttaacaatcgacccacacgtcggaccctgtacgaccacgacgaccaactaagttactttcgtagtcgacactactactaaggtacggacgtaccgtaccgttagggttacgtaccgtcgtaacccgtaaaaccggttccggggttaccccggtaacccccgggtccggggggtaaccccccgggtaaacccgttccggggttaccccttacccgggttcccttccccggttccttacccggttcccccgtaaccccgaaaccccgggtaacccgggtccccgtaaccggtttccccgggtttccccgttttccccccggtccccgggg

SEQ ID NO: 325843 - DNA, 635 bp, Homo sapiens
  misc_feature: GZ8MTXP01DHS1I.22.38.D05.1.454.CMB.2.raw
  modified_base (460)..(460): a, c, t, g, unknown or other
  misc_feature (460)..(460): n is a, c, g, or t
  modified_base (569)..(569): a, c, t, g, unknown or other
  misc_feature (569)..(569): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctggttctcactcaactctagtggagtgggtgtgggctggtccgtcacgccccgaggaacggcctggagtgggtgctacttattattggatgacggttacgctacagtaccatctcgtagaggaggagactcacactacccaaccgaaacgaacccaaacccccaaaacgtaacggtacggtccttaacaaactacgaaccaccagtacggaccctagtacggaccacacgacccaagtaattatttcgagtnaccaactactctaaggtaggacgtactaccgtggtactcgtacgaacctaaacgtcggttaccccgacccggtcgggggaaccccgtaacgttcggtcccaccggttcnccttacgccgacccgtaacccaaccgaaccggcccctacgttcccggtcccgttcccccgtaacgg

SEQ ID NO: 325844 - DNA, 659 bp, Homo sapiens
  misc_feature: GZ8MTXP01BFUN6.22.38.D05.1.454.CMB.2.raw
  modified_base (260)..(260): a, c, t, g, unknown or other
  misc_feature (260)..(260): n is a, c, g, or t
  modified_base (289)..(289): a, c, t, g, unknown or other
  misc_feature (289)..(289): n is a, c, g, or t
  modified_base (403)..(403): a, c, t, g, unknown or other
  misc_feature (403)..(403): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtacgaaacccacacagaccctcacgctgacctgccaccttctcgtggttctcactcaactctagtggagtgggtgtgggctggttcccgtcncgccccgaggaacggcctggaagtgggtnctactttagtttagtgggattggaccggttaccgctacacgtccatctcgtggaggagagactcaacataccccaaccaacggaaccaacccccaaaacgtcgtacgtcctaanactacgaccaccgacgacggtaccctagacgaacacacgacctaactattactttctaggtacaccaactacgttaccgtaggtaacggacgtactaccgttaggtacgtaccgtacgtaacccgtaaacggttccggttacccggacccccgggttcgggggaacccccggaaccgttcggacccttccggtcccttccgacgcgcccctaacccaccgaaccggtcccacggttccgtcccgtttcccgcccgg

SEQ ID NO: 325845 - DNA, 629 bp, Homo sapiens
  misc_feature: GZ8MTXP01DZ1RY.22.38.D05.1.454.CMB.2.raw
  modified_base (432)..(432): a, c, t, g, unknown or other
  misc_feature (432)..(432): n is a, c, g, or t
tcagacatacgcgtcacgaccggtgctcgatttagtatctgatagttgggtttgggggaggaactgctcagttaggacccagagggaaccatggaagccccagctcagcttctcttcctcctgctactctggctcccagataccaccggagaaattgtgttgacacagtctccagccaccctgtctttgtcgtccggggaaagagccaccctctcctgcagggcagtcagaatgttagtagttacttagcctggtaccagacaaaagcctggccaggctcccagactcctcatctctgatacataccaaacgacgggccacgtcggacactccccgagcctaggttcaggtggcgaggtcggggtctaggggacacgtacttaccacttcctacaaccctatccagccgaccgtagacgtcctagtaacgtnttttacggacttaagttttattactggtcaagcaagtcgttaggctatcgtacgcctccgactccgttggccgtaaggggaccaaggccgtaaggagacgtaaacgaaacgtaaccgttggttacggttccttcggaacccttaaaccgtaacgtttccttacggtttaccctttccgttaaacccgttttcccccg

SEQ ID NO: 325846 - DNA, 729 bp, Homo sapiens
  misc_feature: GZ8MTXP01CVLEF.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtagaaacccacacagaccctcacgctgacctgcaccttctctggttctcactcaactcgtagtggagtgggtgtgggctggttccgtcacgccccgaggaaacggccctaggaagtgggttgctacttatttagtgggatgacggttacgctacagtcatctctggaggagagactacaccatacccaaccaacggaccaaacccccgaaaaccgaacggtacggtcccttaacaaatcgacccacgactcgggaccccttgaggaaccacgacgacccaatatttaactttcgtagtacacctaactaacttaccgtaaggtacggggaatacccgtaacccgttgggttaacccgtcgtacggtaacccgtaaacggttccggggttaccccgtacccccggggtcggggggaacccccccgggtaaccgttggggtttaccccaaacccgggttttcccccgtccccgttaccgcccggttaccccgtaaccccggtaacccggaaccccgggtccccgtacccggttccccgggttccccccgttccccgggtccgg

SEQ ID NO: 325847 - DNA, 631 bp, Homo sapiens
  misc_feature: GZ8MTXP01AMM5X.22.38.D05.1.454.CMB.2.raw
  modified_base (322)..(322): a, c, t, g, unknown or other
  misc_feature (322)..(322): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctggttctcactcaactctagtggagtgggtgtgggctggttccgtcacgcccccaggaaacggccctggaagtgggttgctactttatttagtgggatgacggttaccgctacngtccatctcgtgaggaggagactcaccatcccaaccaacggaacccaaacccccaaaacgacgggtacggtccttaacaactcgacccaccatcggaccctgtcgaaccacacgccaactattactttcctgtcgacactacttctaaggtacggacgtcaaccgttggtacgtctcgaccctaaacgtcgggttacccgaccccggtcgggggccccggtaaccgttcgggtacccaccggtcctacccgttcgccgccctaaccgacccgaacgggccccacgttcccgggtccctttccccgcggg

SEQ ID NO: 325848 - DNA, 651 bp, Homo sapiens
  misc_feature: GZ8MTXP01DVMDT.22.38.D05.1.454.CMB.2.raw
  modified_base (255)..(255): a, c, t, g, unknown or other
  misc_feature (255)..(255): n is a, c, g, or t
  modified_base (274)..(274): a, c, t, g, unknown or other
  misc_feature (274)..(274): n is a, c, g, or t
  modified_base (282)..(283): a, c, t, g, unknown or other
  misc_feature (282)..(283): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcacctgaaggagtctggtcctacgctggtacgaaacccacaacacgaccctcacgctgacctgctaccttctctggttctcactcaactctagtggagtgggtgtgggctggtccncacgccccgaggaacgccnggatggtnntattattagtggatgacgtcgcacagtcatctgtggagagagactcaccactacccaaccaaacgaacccaaaccccaaaacgaacggtacgttcctaacaaactacgaaccacacgtcggaccctgtacgaacacagaccaatattctttatcgactacaactaactcgtaacgttacggactaccgtacgttaggtaccgtcgacgtaacccgtaaacgttccgggttaaccccggaccccgggtcgggggtaaccccgtaaacccgttcggtacccgttacccggtcctcccgttaccgcccgaccctaacccgaaccggtaaccggtccccgtaccgttcccggtccccgtttccccgtccggg

SEQ ID NO: 325849 - DNA, 718 bp, Homo sapiens
  misc_feature: GZ8MTXP01EE8WR.22.38.D05.1.454.CMB.2.raw
  modified_base (178)..(178): a, c, t, g, unknown or other
  misc_feature (178)..(178): n is a, c, g, or t
  modified_base (284)..(284): a, c, t, g, unknown or other
  misc_feature (284)..(284): n is a, c, g, or t
  modified_base (316)..(316): a, c, t, g, unknown or other
  misc_feature (316)..(316): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccanacagaccctcacgctgacctgcaccttctctgggttctcactcaactctagtggagtgggtgtgggctggttccgtcacgccccaggaaaggccctggaatgggtnctacttattagtggatgacggttaccgctacngtcatctctggaggaggagactcaccataccccaaccaaacggaacccaaacccccaaaaaccgtaacgggttacggtcccttaacaaacttacgaaccccaccacgtacgggtacccctggtacggacaacgacgacccaatacttaacttttcgtgtcgctaacctactaccgttaagtaacggtagacctaacgttcggtaacgttcctaggtaaccccgtaaaacgttccggggtttaacccggacccccgggttacccggggggtaacccccgggtaaaccccggttcgggtacccgttaccccgggttcctaccccgttccgaccggttccccttaacccgaacccggaaccggggtcccctacgttcccgggttccctttcccccgggtcccggg

SEQ ID NO: 325850 - DNA, 604 bp, Homo sapiens
  misc_feature: GZ8MTXP01A0SG9.22.38.D05.1.454.CMB.2.raw
  modified_base (330)..(330): a, c, t, g, unknown or other
  misc_feature (330)..(330): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagacccctcacgctgacctgcaccttctctgggttctcactcaactctagtggagtgggtgtgggctggtcctcacgccccaggaaggcctggatgggtgctacttattgtggatgacggttaccgctacagtccatctctgaggagganactcacatcccaaccaaggaccaaaccccaaaacgaggtcgtaaccttacaagtcgaccacactacggccctagtcgacacgacgccactattactttctgtcacactactctaagtacggacgcctaccgttggtaacgttctcgaacccgtaacgtcgggttcccgaaccccggttcgggggccccggaaccttgggtcccaccgttcctcccttccgccgccctcccaccgaaccgggcccctcggttcccggtcccgtttcccccgcggg

SEQ ID NO: 325851 - DNA, 591 bp, Homo sapiens
  misc_feature: GZ8MTXP01DXQAI.22.38.D05.1.454.CMB.2.raw
  modified_base (375)..(375): a, c, t, g, unknown or other
  misc_feature (375)..(375): n is a, c, g, or t
  modified_base (387)..(387): a, c, t, g, unknown or other
  misc_feature (387)..(387): n is a, c, g, or t
tcagacatacgcgtcacgaccggtgctcgatttagtatctgatagttgggtttgggggaggaactgctcagttaggacccagagggaaccatggaagccccagctcagcttctcttcctcctgctactctggctcccagataccaccggagaaattgtgttgacacagtctccagccaccctgtctttgtcgtccggggaaagagccaccctctcctgcagggccagtcagaatgttagtagttacttagcctggtaccagacaaagcctggccaggcctcccagactcctcatctctgatacatacccaaacgacggccacgtcggcactcccagcctaggttcaggttggcgtaggtcgggtcgtaggggacngtacctcactcncaccatcacgcacagactctagaagtatttgacttagtttactactgtacagcgagtcgtagctattccgtcgtaccctccgtactccgtttacggccgaacggggacccaaggcgtaagggacgttaacgtaaccgaaaacgtacgtggttacgcgttacggaacctacctaacttcgtgttccttccgttaacgtttccccg

SEQ ID NO: 325852 - DNA, 699 bp, Homo sapiens
  misc_feature: GZ8MTXP01AVW8Z.22.38.D05.1.454.CMB.2.raw
  modified_base (403)..(403): a, c, t, g, unknown or other
  misc_feature (403)..(403): n is a, c, g, or t
tcagacatacgcgtcacgaccggtgctcgatttagtatctgatagttgggtttgggggaggaactgctcagttaggacccagagggaaccatggaagccccagctcagcttctcttcctcctgctactctggctcccagataccaccggagaaattgtgttgacacagtctccagccaccctgtctttgtctccgggggaaagacgccaccctctcctgcagggccagtcagaatgttagtagttactagctgtaccagacaaagcctggccaggctcccagactcctcatctctgactacatcccaaacgacgggccacgtcggccacgtccccgaagtcccgtaggttccaggtcggacgtaggtcggggtcgtaggggacacgtacctttaccgacttcnccaacctataccacgaccgaccgtacgacgtccgtaggtaagttacttttagacttaagttttacttacgtgtacgagcctaggtacgtaggtcgtagttccgtccggggtaccccttccggtaacccgttacccggttttcgggacccggtaacgggggaaccctaacgggtccgttaacggggaaagttaccggtaaacgttaaaacccggtaacggttcggttaacgggttccttcgggaacctaaccccgtttcgttaccgttcgttacccttccgttaacccgtttccccg

SEQ ID NO: 325853 - DNA, 701 bp, Homo sapiens
  misc_feature: GZ8MTXP01AXDVK.22.38.D05.1.454.CMB.2.raw
  modified_base (465)..(465): a, c, t, g, unknown or other
  misc_feature (465)..(465): n is a, c, g, or t
tcagacatacgcgtcacgaccggtgctcgatttagtatctgatagttgggtttgggggagtgactcctgtgccccaccatggacacactttgctccacgctcctgctgctgaccatcccttcatgggtcttgtcccagatcaccctgaaggagtctggtcctacgctggtacgaaacccacacagaccctcacgctgacctgcctaccttctctgggttctcactcaactctagtggaggtgggtgtgggtctggttccgtcacgccccgaggaacggccgtggaagtggtgctacttatttagtggatgtacggttacgctacacgtcctatctcgtgaaggtaggacgacctacaccaactaccccaaccgaacggaacccaaacccccaaaacgaacgggtacgtcctaaacaatacgacccacacgtcgaccctgtacgacacacgaccatattactttcncgtcgactactacgttactaaggtacggacgtaccgtaacgtggttacgtacgtaccggtaacccgtaaacgtcccgggttacccggtaccccgggtaccggggggaaccccggtacccgttcgggtcccttacccggttacctcccgttacccgttcccgttccccgtaacccgacccggaacccgggttcccctaccggttccccggttaaccccgttcccccggtccccgggg

SEQ ID NO: 325854 - DNA, 708 bp, Homo sapiens
  misc_feature: GZ8MTXP01E4KMK.22.38.D05.1.454.CMB.2.raw
  modified_base (321)..(321): a, c, t, g, unknown or other
  misc_feature (321)..(321): n is a, c, g, or t
  modified_base (333)..(333): a, c, t, g, unknown or other
  misc_feature (333)..(333): n is a, c, g, or t
  modified_base (344)..(344): a, c, t, g, unknown or other
  misc_feature (344)..(344): n is a, c, g, or t
  modified_base (491)..(491): a, c, t, g, unknown or other
  misc_feature (491)..(491): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcacctgaaggagtctggtcctacgctggtagaaacccacacagaccctcacgctgacctgctaccttctctggttctcactcaactctagtggagtgggtgtggtctggtccgtcacgaccccgaggaaacggccctaggaagtggtgctacgttatttagtggagtgtacgtaccgactanacgtcatcgtcnggtaggagganactacaactacaaccccaaccgaaacggaaacccaaaacccccgaaaaacgtaacggttacggtaacccttaaacgaaactacggacctaacgacgacggtaccctaggtacgaaccaactacgaccaataacttagtttactcganaccaccgaatccgtaaggtaagggacgacctacgtaggtacttcgaacgtacctaaaccggtcgggttaccccggaccccgggttgggggaaccccgtaacccgttgggtaccccaaccggttcccgttaaccccttccgttacccgttaccccgtaacccgaacccggtaacccgggtccccgtaccggttcccgtttccccgttccccgtaacgg

SEQ ID NO: 325855 - DNA, 693 bp, Homo sapiens
  misc_feature: GZ8MTXP01CVEGT.22.38.D05.1.454.CMB.2.raw
  modified_base (667)..(667): a, c, t, g, unknown or other
  misc_feature (667)..(667): n is a, c, g, or t
tcagacatacgcgtcacgaccggtgctcgatttagtatctgatagttgggtttgggggaggaactgctcagttaggacccagagggaaccatggaagccccagctcagcttctcttcctcctgctactctggctcccagataccaccggagaaattgtgttgacacagtctccagccaccctgtctttgtcgtccggggaaagacgccaccctctcctgcagggccagtcagaatgttagtagttacttagctggtaccagacaaagcctggccaggcctcccagactctcatctctgactacatacccaaacgacgggaccacgtcggaccactccccgacgccgaggttcaggtggcgtaggtcgggtcgtaggggactacgtaccttaccactcctacaaccactcacgaccgtaaccgtaaggacgtaccgtaggtaaagttattttacgaacgttaagtttttaacgttacttcggttaacgacgtcgtaaggtaccggtaaggggtacctacgttccgtaccggtccccgttacccgttaaccgttacccggttttacgggacccggtaacgggggtaaccaacggtcggtaacggaacgaacgtaaacgttaaacgaaaccgttggttaacgggttcttacggtaaccacctcttacgtnttaccttaaccttaaccgtttccccg

SEQ ID NO: 325856 - DNA, 626 bp, Homo sapiens
  misc_feature: GZ8MTXP01BVUSW.22.38.D05.1.454.CMB.2.raw
  modified_base (414)..(414): a, c, t, g, unknown or other
  misc_feature (414)..(414): n is a, c, g, or t
  modified_base (422)..(422): a, c, t, g, unknown or other
  misc_feature (422)..(422): n is a, c, g, or t
  modified_base (425)..(425): a, c, t, g, unknown or other
  misc_feature (425)..(425): n is a, c, g, or t
  modified_base (442)..(442): a, c, t, g, unknown or other
  misc_feature (442)..(442): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgcccccaggaaaggccctggaatgggttgctactttatttattgggatgacggttaccgctacagtccatctctgaggaggagactcacatccaccaaggaccaaccccaaacaagtcgtctacaatcgaccacatcgaccctgtcgacacagccanattattcngtncacactctagtacgganccacgttggtagtctacgaccaaacgttcggttaccgaccccggttcgggggaacccccgggtaaacccgttcgggtacccacccggttcctccccgttccgaccggttcccctaaccccgaacccgtaaaccgggggtccccctaagttccccggggtttcccctttcccccccggtccgggg

SEQ ID NO: 325857 - DNA, 697 bp, Homo sapiens
  misc_feature: GZ8MTXP01DPU0A.22.38.D05.1.454.CMB.2.raw
  modified_base (283)..(283): a, c, t, g, unknown or other
  misc_feature (283)..(283): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtagaaacccacacagaccctcacgctgacctgcaccttctctgggttctcactcaactctagtggagtgggtgtgggctggttccgtcacgccccaggaaggccctggatgggtnctattattatggatgacggttacgctacagtccatctcgtggaggaggagactacaccactacccaaccaaacggaacccaaacccccaaaaacgaacggttacggtccttaacaatacgaaccaccactcggaccctgtacgacaacacgaccaactattactttctggtcaccaactacttaccaagggttaacgggacgtacctaaccgttggggtaacttccgtacggtaaacccgtaaacgttccggggtttaccccggacccccggggttcggggggaaccccccggttaacccggttggggtaccccttaccggttcccgttccttacccgccggttcccctaacccgaacccggtaaccgggtccccgtacggttccccgggttccccgttcccccggtcccgggg

SEQ ID NO: 325858 - DNA, 686 bp, Homo sapiens
  misc_feature: GZ8MTXP01AJVXZ.22.38.D05.1.454.CMB.2.raw
  modified_base (483)..(483): a, c, t, g, unknown or other
  misc_feature (483)..(483): n is a, c, g, or t
  modified_base (607)..(607): a, c, t, g, unknown or other
  misc_feature (607)..(607): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtacgaaacccacacacgaccctcacgctgacctgcaccttctctggttctcactcactctaggtggaggtgggtggtgggtcgttcggtccgtcgacgccccgaggaacggcctggagtgggtgactacttagtttagtggtagtgtacggttaccgctacgacgtccatctcgtagaggaggacgactacaccgactaccccaaccgaaacggaacccaaacccccgaaaacgtaacgggtacggttaacctaacaactacgacccacgacgtacggacccttggacgaacacacgaccctatatttactttgngtacacacctacttacgtaaggtacggacgtaccgtaccgtttggtacgtcgtacgaaccctaacggttccggtacccggccccgggtcggggaaccccggtacgttcgggtcccaccgttccnccgaccgccgttccccgtaacccgacccgggtaaccgggtccccctaggttcccccggttcccgttcccccggtccggg

SEQ ID NO: 325859 - DNA, 662 bp, Homo sapiens
  misc_feature: GZ8MTXP01A8U2S.22.38.D05.1.454.CMB.2.raw
  modified_base (284)..(284): a, c, t, g, unknown or other
  misc_feature (284)..(284): n is a, c, g, or t
  modified_base (311)..(311): a, c, t, g, unknown or other
  misc_feature (311)..(311): n is a, c, g, or t
  modified_base (605)..(605): a, c, t, g, unknown or other
  misc_feature (605)..(605): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtacgaaacccacacacgaccctcacgctgacctgcctaccttctctggttctcactcaactctagtggagtgggtgtggctggtccgtcacgccccgaggaacgcctggatgggtnctattattagtggatgtacggttaccnctacacgtccatcgtcgtaggaggtaggacgacctcaaccactaccccgaaccgaaacggaacccaaacccccaaaaccgtaacgggttacggttaacccttaaacgaacgtacgaacccacgtaacgtcggacccgtgtacgaacaccacgacctaatatttactttcgagtacactaactacgtacgtaaggtaggacgacctacgtggtactcgtacgtaccgtaaacgttccgggtacccgtaccccgggtcggggaaccccggtaaccgttcggtcccaccgtcctccncgttccgccctaacccgaccgaaccggccctagttcccggttcccttccccggtcgg

SEQ ID NO: 325860 - DNA, 657 bp, Homo sapiens
  misc_feature: GZ8MTXP01BBYMJ.22.38.D05.1.454.CMB.2.raw
  modified_base (353)..(353): a, c, t, g, unknown or other
  misc_feature (353)..(353): n is a, c, g, or t
  modified_base (362)..(362): a, c, t, g, unknown or other
  misc_feature (362)..(362): n is a, c, g, or t
  modified_base (463)..(463): a, c, t, g, unknown or other
  misc_feature (463)..(463): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtacgaaacccacacacgaccctcacgctgacctgcctaccttctcgttcgggttctcactctaactcgtaggtggtaggtggggtggtgggtcgttgggttccgtcgacgccccgaaggaacggcctaggaagtggtgactacttagtttagtggatcggtacgtaccgctacagtctatctcgngaggacganactacacacacccaacgaacgaaccaaacccaaacgaacgtacgtaacctaacaactcgaccacacgacgaccctgacgacactacaccatacttactttngctacaactactactaggaaggactaccgacgttaggtactccgtacgaacccgtaacgttccgggtaccccgtaccccgggtcgggggaacccctaaccggcggttaccttaccccgtcctcccgacgacccgttccccgtaaccgaccccggtaacggccccgtagttccccgtccccgtttccccggccgg

SEQ ID NO: 325861 - DNA, 673 bp, Homo sapiens
  misc_feature: GZ8MTXP01EUSL7.22.38.D05.1.454.CMB.2.raw
  modified_base (449)..(449): a, c, t, g, unknown or other
  misc_feature (449)..(449): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgctaccttctctgggttctcactcaactctagtggagtgggtgtggctggtccgtcacgccccaggaaaggccctggaatggtgcacttattatggatgacgtaccgctacagtcatctcgtgaggaggagactcaaccatacccaaccgaaacggaaccaaacccccaaaaccgaagggttacgtccttaaacaatcgacccaaccacgtcggacccctgacggaccacacgacaactacgtattttccngacacactacgttactaaggtacggtaacgactacggttacggtacgttccgtacgtaacccgtaaccgttccgggtaccccggtaccccggggtccggggaacccccgggtaaccgttccgggtacccgttccccgttccgtacccgttaccgacccgttaccccgtaaccccgacccggaaccggtcccctaccgttccccggttccccgttccccggtcgg

SEQ ID NO: 325862 - DNA, 712 bp, Homo sapiens
  misc_feature: GZ8MTXP01AYROL.22.38.D05.1.454.CMB.2.raw
  modified_base (336)..(336): a, c, t, g, unknown or other
  misc_feature (336)..(336): n is a, c, g, or t
  modified_base (476)..(476): a, c, t, g, unknown or other
  misc_feature (476)..(476): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtccttgtcccagatcaccctgaaggagtctggtcctacgctggtgaaacccacacagaccctcacgctgacctgcaccttctctgggttctcactcaactctagtggagtgggtgtgggctggtcctcacgcccccaggaaacggccctggaatgggttgcacttattatggatgacggttaccgctacagtccatctctggaggagganactcaccgataccccaaccaaacggaccaaaccccccaaaaacgacgggttacggtcccttaacaaactacgaaccctaccacgtacggaacccctgtacggaaccaacgacgacccaactaattaacgtttcctaggtnacctaacacttccgtaagtacggacggtacctaaccgttagggtacgtaccgttacggaccctaaaacggtcgggtttaccccggaaacccccgggttcggggggaaccccccggggtaaaccccgttgggggaccccttaacccggttccttccccgaaccttcggttaccccctaacccggaccccgaacgggggcccccacggtttcccggttccccgttcccccgtccgggg

SEQ ID NO: 325863 - DNA, 649 bp, Homo sapiens
  misc_feature: GZ8MTXP01BUDHB.22.38.D05.1.454.CMB.2.raw
  modified_base (594)..(594): a, c, t, g, unknown or other
  misc_feature (594)..(594): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctggttctcactcaactctagtggagtgggtgtgggctggttccgtcacgccccgaggaaggccctggaagtgggttgctacttatttattggatgacggttaccgctacagtcatctcgtgaggaggagactcacactacccaaccgaacggaacccaaacccccaaaaccgaacgggtacggtccttaacaactacgacccaaccacgtacggaccctggtacggacacgacgacccaatactttactttcgtacggtgaaccctactaacttccgtaagggtaacgggacgtaccctacccgttaggggttaactcccgttagaacccctaaacgttcgggttcccgaaccccggtcgggggaaccccggtaccttcgggtccnccgtcctccttcgcgccctccgaccgaacggcccagttccgtccttccccgtcgg

SEQ ID NO: 325864 - DNA, 618 bp, Homo sapiens
  misc_feature: GZ8MTXP01AKFME.22.38.D05.1.454.CMB.2.raw
  modified_base (281)..(281): a, c, t, g, unknown or other
  misc_feature (281)..(281): n is a, c, g, or t
  modified_base (306)..(306): a, c, t, g, unknown or other
  misc_feature (306)..(306): n is a, c, g, or t
  modified_base (330)..(330): a, c, t, g, unknown or other
  misc_feature (330)..(330): n is a, c, g, or t
  modified_base (339)..(339): a, c, t, g, unknown or other
  misc_feature (339)..(339): n is a, c, g, or t
  modified_base (441)..(441): a, c, t, g, unknown or other
  misc_feature (441)..(441): n is a, c, g, or t
  modified_base (445)..(445): a, c, t, g, unknown or other
  misc_feature (445)..(445): n is a, c, g, or t
  modified_base (467)..(467): a, c, t, g, unknown or other
  misc_feature (467)..(467): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtagaaacccacacacgaccctcacgctgacctgcaccttctctggttctcactcaactctagtggagtgggtatgggctcggttccgcacgccccaggaacgcctggatggtncacttattatggatgacggttaccnctacagtccatctcgtgaggaganactcaccanccccaaccgaacggaacccaaacccccaaaacgacgggttacgtaaccctacaaactacgaccaccagtcgaaccctgacgacacgagaccatattacttcngtcncaactctcgtaaggtcggaacnctaaccgtgtaacgtcgttaccgaccgtaacgttcgggtacccgaccccggttcgggggaaccccggtaacccgttgggtcccaccggttcctcccttcgccgttcccaaccgaccgaacgggcccgtacgccgttcccgttccccgccgg

SEQ ID NO: 325865 - DNA, 676 bp, Homo sapiens
  misc_feature: GZ8MTXP01AXH69.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtacgaaacccacacacgaccctcacgctgacctgcctaccttctcgtggttctcactcaactctagtggagtgggtgtggtctggttccgtcacgccccgaggaacgccgtggagtggtgctattattagtggatgtacgtacgctacgagtcatctcgtgaaggaggacgactacaccactaccccaaccgaaacggaacccaaaccccgaaaacgtaacgggtacgtaacctaacaactacgaaccacacgtacggaccctgacgaccacacgccatacttactttcacgtcacactacttacgtaaggtaggaacgtcctaacgtggtactccgtacgtacccgtaaacgttccgggtaccccgtccccggggtccgggggtaaccccggtaaccgttcgggtacccttacccgttcccgtacccgttccgcccgttaccccgtccccgaaacccggaaccggggtacccctcgggttccccggttcccctttccccggcccggg

SEQ ID NO: 325866 - DNA, 697 bp, Homo sapiens
  misc_feature: GZ8MTXP01CPDA6.22.38.D05.1.454.CMB.2.raw
  modified_base (477)..(477): a, c, t, g, unknown or other
  misc_feature (477)..(477): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtacgaaacccacacacgaccctcacgctgacctgcaccttctcgtggttctcactcaactcgtagtggagtgggtggtgggtctggttccgtcacgccccgaggaacgccgtaggagtggtgctacttagtttagtgggtatcggtacggtaccgctacacgtccatctcgtggaggaggagactacaccataccccaaccaaacggaacccaaacccccgaaaaccgacgggttacggtaaccttaacaaacgtacgaccaccacgtacggaccctggtacgaccactacgacctaacatttactttntcggtacacacctacgttcgtaaggtacggggactccgtaacccgttggtacgtccgtacgaacccgtaaacggtttcccggggtaccccgaccccgggtaccggggggaacccccggtaacccgttgggcccttacccgttccgacccttcccgacgccccgtaacccgaacccggtaacgggccccttaggttccccgtccccgtttcccccgccggg

SEQ ID NO: 325867 - DNA, 615 bp, Homo sapiens
  misc_feature: GZ8MTXP01ERRFZ.22.38.D05.1.454.CMB.2.raw
  modified_base (316)..(316): a, c, t, g, unknown or other
  misc_feature (316)..(316): n is a, c, g, or t
  modified_base (570)..(570): a, c, t, g, unknown or other
  misc_feature (570)..(570): n is a, c, g, or t
  modified_base (575)..(575): a, c, t, g, unknown or other
  misc_feature (575)..(575): n is a, c, g, or t
  modified_base (594)..(594): a, c, t, g, unknown or other
  misc_feature (594)..(594): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtacgaaacccacacacgaccctcacgctgacctgcacttctctggtctcactcaactctagtggtagtgggtggtgggctcggttccgtcgacgccccgaaggaacggccgtaggagtggtgactacttattagtggatgacgtaccncactacgtctatctcgtgaggaggacgactcacatacccaaccgaaacgaccaaaccccaaacgtaaggtacgtaactacaatacgaaccacacgcgaccctgtacgacacgacaccataactttattacgcgtcacaacgtacttacgtaaggtacggacgtacaccgttggtactaccgtacgaaaccgtaacgtccgggttacccgccccgggtcgggaaccccggtaacttcggaccttaccgccttacncgacncctcccacgaaccggtccncgttcccggtccttcccggcg

SEQ ID NO: 325868 - DNA, 524 bp, Homo sapiens
  misc_feature: GZ8MTXP01EUTZO.22.38.D05.1.454.CMB.2.raw
  modified_base (288)..(288): a, c, t, g, unknown or other
  misc_feature (288)..(288): n is a, c, g, or t
  modified_base (398)..(398): a, c, t, g, unknown or other
  misc_feature (398)..(398): n is a, c, g, or t
  modified_base (419)..(419): a, c, t, g, unknown or other
  misc_feature (419)..(419): n is a, c, g, or t
  modified_base (483)..(483): a, c, t, g, unknown or other
  misc_feature (483)..(483): n is a, c, g, or t
  modified_base (511)..(511): a, c, t, g, unknown or other
  misc_feature (511)..(511): n is a, c, g, or t
  modified_base (519)..(519): a, c, t, g, unknown or other
  misc_feature (519)..(519): n is a, c, g, or t
tcagacatacgcgtcacgaccggtgctcgatttagtatctgatagttgggtttgggggaggaactgctcagttaggacccagagggaaccatggaagccccagctcagcttctcttcctcctgctactctggctcccagataccaccggagaaattgtgttgacacagtctccagccaccctgtctttgtcgtccgggggaaagagccaccctctcctgcagggccagtcagaatgttagtagttacttagctggtaccagacaaagcctggcaggctcccagactcncatctctgatacatccaaacgacggccactggcactcccagcctaggttcagtggcaggtggtctgggacagacttcactctcacatcagcgactagacgcctagaagtnttttgcttaagtttattactntcagcagcgtaggctagtctcggcctccgtactacgttggccgagggaccaagctaagagttanacgaaacgaatgagcttagccactctcngttcttcncttcc

SEQ ID NO: 325869 - DNA, 671 bp, Homo sapiens
  misc_feature: GZ8MTXP01B5L9Z.22.38.D05.1.454.CMB.2.raw
  modified_base (288)..(288): a, c, t, g, unknown or other
  misc_feature (288)..(288): n is a, c, g, or t
  modified_base (324)..(324): a, c, t, g, unknown or other
  misc_feature (324)..(324): n is a, c, g, or t
  modified_base (334)..(334): a, c, t, g, unknown or other
  misc_feature (334)..(334): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgccaccttctcgtggttctcactcaactctagtggagtgggtgtgggtctggttccgtcacgcccccaggaacggcccgtggagtgggtnctactttagtttagtggatcgacggttaccgctacngtccatctgnggaggagagactcacactacccaaccaacggaacccaaacccccaaaaccgaacggtacgtcctaacaacgtcgaaccaccacgtcgacccttggacgaaccacacgacctaactaaatttactttcctagggtacacctaactacttacgtaaggtacggaacggtcctaacggtggtaacgtctacgaccctaacggttccgggttacccggaccggtccgggggaaccccggtaccgttcgggtcccacccgttccgtcccttacgccgttaccccgcccgtaaccggaacccggtccctaccggtttcccggttccccgttcccccgtccggg

SEQ ID NO: 325870 - DNA, 741 bp, Homo sapiens
  misc_feature: GZ8MTXP01BX2AX.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtagaaacccacacagaccctcacgctgacctgcaccttctctggttctcactcaactctagtggagtgggtgtggctggttccgtcacgccccaggaacggccctaggaatgggtgctacttatttagtgggatggacggttaccgctacagtccatctgtgaggaggacgactaccaccactacccaacccgaaacggaaccccaaaccccccaaaaaccggtaacgggttacgggtaaccctttaaaccgaaacgttacgaaccccaaccgtacgtaccgggtaacccctggtacggaaccaacgaacgaccctactaactttacttttctcggttacgacctaactaaccgttcgttaaggacggtacgacctaccgtaggttaacgtcgtaccggtaaccctaaacgttccgggttacccccggccccgggtccgggggtaacccccgggtaaccccgttggggtccccttaccgttcccctacccgttccgaacccgttcccgtaaccccgaacccggtcccgggtacccctcggtttccccggttcccccgttccccggtccccggg

SEQ ID NO: 325871 - DNA, 659 bp, Homo sapiens
  misc_feature: GZ8MTXP01DYLFY.22.38.D05.1.454.CMB.2.raw
  modified_base (366)..(366): a, c, t, g, unknown or other
  misc_feature (366)..(366): n is a, c, g, or t
  modified_base (369)..(369): a, c, t, g, unknown or other
  misc_feature (369)..(369): n is a, c, g, or t
  modified_base (375)..(375): a, c, t, g, unknown or other
  misc_feature (375)..(375): n is a, c, g, or t
  modified_base (380)..(380): a, c, t, g, unknown or other
  misc_feature (380)..(380): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatggtgcacttatttatggatgacggtaccgctacagtccatctctgaggaggagactcacatccaccagacacccaaacaagtgctanatnacacangaccngtgacacagcacatactttcagtcgacactactcgtaacgttagggaagtacctaacccgtagggggttaactcgtacggtaaaccctaaaaccgttcgggtttaccccggaacccccggtttcggggggaacccccgggtaaaccccgttgggggtccccttaaaccccgggttccttccccttacggaaccgttcccccttaacccggaaccccgaaaaccgggggtccccctaacggttccccggggtttccccctttcccccccggttcccgggg

SEQ ID NO: 325872 - DNA, 701 bp, Homo sapiens
  misc_feature: GZ8MTXP01C3ZU4.22.38.D05.1.454.CMB.2.raw
  modified_base (669)..(669): a, c, t, g, unknown or other
  misc_feature (669)..(669): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtagaaacccacacacgaccctcacgctcgacctgcctaccttctcgtgggttctcactcaactcgtaggtggaggtggggtgtgggtcgttcggttcccgtcgacgccccgaggaacggccgtggaagtgggtgctaactttagttagttggtatgacggttaccgctacacgtcatctcgtggaggaggagactacacactacccaaccgaaacgacccaaaccccaaaacgtaacgtacgtaactaactaactacgaccacacgtcgaccgtgtacgaccacacgcctaactatttactttcgtcggtacactaactacgtacgttaagggtaacggacgtacctaaccgttggtaaccgttcgtaccgtaaacccgtaaccggttcccgggttaccccgggacccccgggtccggggggtaacccccggtaacccgttcggttccccaccggtttccctccgttaccgcgttacccgccccgaacgaaccgggtcccncggttcccggttccccgttaaccccggtcccg

SEQ ID NO: 325873 - DNA, 705 bp, Homo sapiens
  misc_feature: GZ8MTXP01B3OGC.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctggttctcactcactctagtggagtgggtgtgggctggttccgtcacgccccgaggaaacggccctggaagtgggtgctacttatttagtgggtatgtacggttaccgctacagtccatctcgtgaggaggacgactcacactacccaaccaaacggaacccaaacccccaaaaccgtaacgggtacgtaaccttaacaaactacgacccaccacgtacggaccctggtacgacacgacgccatattacttctgtcacactactacttaggtacgggtacgccgtacccggttagggttacgtccgtacgtaaccccggtaaacgttccgggggtttaccccggaacccccgggttccggggggaacccccgggtaacccgttccgggtacccgttaccccggttccctcccgttcccgaccgttcccctaaccccggaacccgtaaccgggtcccccgtacggttcccccgggttccccgttcccccggtcccggg

SEQ ID NO: 325874 - DNA, 722 bp, Homo sapiens
  misc_feature: GZ8MTXP01DSGFL.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtacgaaacccacacagaccctcacgctgacctgcaccttctctgggttctcactcaactctagtggagtgggtgtgggctggtccgtcacgccccaggaacggccctggagtggtgctacttagtttagtggtagtgtacgttaccgctacacgtccatctcgtgaggagagactcacactacccaaccaaacggaaacccaaacccccgaaaaaccgaacggttacggttaaccttaacaaactacgaacccaaccacgtacggaccccttggacgaaccgaccaacacccaactaactttactttcgtacgtcgacctaactacttaccgtaaggttacggacgtacccgtaaccgttggtacctcgtaacgtaaccccgtaaacgttccgggtaccccggtaccccgggtccgggggtaacccccggtaaacccgttcggggtaccccacccgggttcctccccgttaccgccgacccccgttaacccgaaccccggtaacccgggtccccgtaccggttccccggttcccccgttccccggtccccgggg

SEQ ID NO: 325875 - DNA, 652 bp, Homo sapiens
  misc_feature: GZ8MTXP01DE22R.22.38.D05.1.454.CMB.2.raw
  modified_base (450)..(450): a, c, t, g, unknown or other
  misc_feature (450)..(450): n is a, c, g, or t
  modified_base (455)..(455): a, c, t, g, unknown or other
  misc_feature (455)..(455): n is a, c, g, or t
  modified_base (474)..(474): a, c, t, g, unknown or other
  misc_feature (474)..(474): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgccaccttctctggttctcactcaactctagtggagtgggtgtgggctggttccgtcacgaccccgaggaaacggccctggaagtgggttgctactttatttagttggatgtacggttaccgctacagtccatctctgaggagagactcacactacccaccaaacgaacccaaaccccaaaaccgaagtcgtcctaacaactacgacccacactcgggacccttggacgacacagtccaactattactttcngtacnccaacactctaagtacggngccgtacgtggtatcgacgaccgttaaaccgtcgggttacccgcccccggttcgggggaacccccggtaaccgttcggtacccgaccgttaccctcccgttacccgaccgttccccgtaacccgaacccgaaccggggtaccctaccggttcccggttccccgttccccggtccccgg

SEQ ID NO: 325876 - DNA, 664 bp, Homo sapiens
  misc_feature: GZ8MTXP01BIX7G.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtagaaacccacacacgaccctcacgctgacctgcctaccttctctggttctcactcactctagtggagtgggtgtggctggttccgtcacgccccagggaaacggccctggagtggtgctacttagtttagtggtatggacggttaccgctacacgtccatctcgtggaggaggacgactcacactacccaaccaaacggaacccaaacccccaaaacgtaacgggttacgtaaccttaacaaactacgaccaaccacgtcgtaccctagtcgaacacacgaccactattactttctgtcacactacgtctaggtaggactcctacggttgtaccgtcgtcgaaccgtaacgtccgggttacccgacccccgggtcgggggtaacccccggtaaccccgttggtaccccgaccgttcccgtaccttcccgccggttacccccaacccggaaccgtaaccgggacccctggttccccggttcccttcccccgtccgg

SEQ ID NO: 325877 - DNA, 630 bp, Homo sapiens
  misc_feature: GZ8MTXP01CXSAD.22.38.D05.1.454.CMB.2.raw
  modified_base (281)..(281): a, c, t, g, unknown or other
  misc_feature (281)..(281): n is a, c, g, or t
  modified_base (311)..(311): a, c, t, g, unknown or other
  misc_feature (311)..(311): n is a, c, g, or t
  modified_base (437)..(437): a, c, t, g, unknown or other
  misc_feature (437)..(437): n is a, c, g, or t
  modified_base (567)..(567): a, c, t, g, unknown or other
  misc_feature (567)..(567): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctggttctcactcaactctagtggagtgggtgtggctggttccgtcagccccaggaacggccctggaatgggtnctacttatttatgggatggacggttaccgntacagtccatctctgacggagagactcacatacccaccaacggaccaacccccaaaacgaacgtacggtccttacaactacgaccaccagtcgaccctgtaggaccacacgccactattactttcngtcgacctactacttaccgtaggtacggacgacctaaccgttgggtaacgtccgtacgacccgtaaacgttccgggtacccgaaccccggtcgggggaacccccggtaaccgttcggtccacccggttcncccttcgaccgttccctaaccgaccgaaccggccctacgttccgttccccgttccccgtccgg

SEQ ID NO: 325878 - DNA, 605 bp, Homo sapiens
  misc_feature: GZ8MTXP01D3EHX.22.38.D05.1.454.CMB.2.raw
  modified_base (285)..(285): a, c, t, g, unknown or other
  misc_feature (285)..(285): n is a, c, g, or t
  modified_base (439)..(439): a, c, t, g, unknown or other
  misc_feature (439)..(439): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtacgaaacccacacagacccctcacgctgacctgctaccttctctggttctcactcaactctagtggagtgggtgtggctggtccgtcacgccccgaggaacggcctggagtgggtnctacttagttagtggtatggtacggtaccgctacacgtaccatctcgtggaggagagactcacactacccaaccaaacgaacccaaaccccaaaacgacgtacgtctacaactacgaccacagtcggacctgtacgacacacgactaactattnttactgtcacacactcgtaggtagcgtacacgtgtcgtctacgaacctaacgtccggtaccgcccggtcggggtccccgtaaccgttcggtcccttaccgtcctccgacgccgaccctaaccgaaccgaaccgggccctacgttcccgttcccgttccccgtccgg

SEQ ID NO: 325879 - DNA, 693 bp, Homo sapiens
  misc_feature: GZ8MTXP01AJ4Y1.22.38.D05.1.454.CMB.2.raw
  modified_base (292)..(292): a, c, t, g, unknown or other
  misc_feature (292)..(292): n is a, c, g, or t
  modified_base (639)..(639): a, c, t, g, unknown or other
  misc_feature (639)..(639): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcacctgaaggagtctggtcctacgctggtacgaaacccacacacgaccctcacgctgacctgcctaccttctcgtggttctcactcaactcgtaggtggtagtgggtgtgggtctcggtccgcacgccccgaaggaacggccgtggagtggtnactattagttagtggatgacggtaccgctacgacgtcatcgtcgtaggaaggagacgactcacactacccaaaccgaaacggaaccccaaaaccccaaaacgtaacgggttacgtaaccttaacaaacgtacgaaccctacgacgtaccggtacccgtgaaccggaacacgacgacctaacttacttactttctacggtacacctaacgtacttaagtaacggggtacggtaacgtcctaacggttaggttacgtccgtaacggtaacccgttaacggttcccgggttacccggaccccgggtcgggggaaccccgtaccgttcggtcccttaccgtctaccgttcnccgacccgtaaccgaccgtaacggccctacggttcccgtcccgttccccggccg

SEQ ID NO: 325880 - DNA, 644 bp, Homo sapiens
  misc_feature: GZ8MTXP01A9VRB.22.38.D05.1.454.CMB.2.raw
  modified_base (281)..(281): a, c, t, g, unknown or other
  misc_feature (281)..(281): n is a, c, g, or t
  modified_base (310)..(310): a, c, t, g, unknown or other
  misc_feature (310)..(310): n is a, c, g, or t
  modified_base (330)..(330): a, c, t, g, unknown or other
  misc_feature (330)..(330): n is a, c, g, or t
  modified_base (456)..(456): a, c, t, g, unknown or other
  misc_feature (456)..(456): n is a, c, g, or t
  modified_base (461)..(461): a, c, t, g, unknown or other
  misc_feature (461)..(461): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtagaaacccacacagaccctcacgctgacctgcaccttctctggttctcactcaactctagtggagtgggtgtggctggtccgtcacgccccgaggaacgcctggaatgggtnctacttattagtggatgacgtaccgctanacgtcatctctggagagganactacaaccataccccaaccaaacggaacccaaacccccgaaaacgtacgggtacgtaacctaaacaacgtacgacccaactacgacgggtaccctgtacggacacacgaccaatattacgtttcncgtanaccactactacgtaggacggtacgaccgtacggtagtacgtcgtacgtaaccgtaaccgttccggtacccggaccccggtcgggggaaccccgtaaccgttcggtacccgttccgtcctcccttacgccgttccctaaccgacccgaacggtccctccggttaccgttccccgttcccgtcgg

SEQ ID NO: 325881 - DNA, 747 bp, Homo sapiens
  misc_feature: GZ8MTXP01CDDLU.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcacctgaaggagtctggtcctacgctggtagaaacccacacacgaccctcacgctgacctgcaccttctcgtggttctcactcaactctagtggagtgggtgtgggctggtccgtcacgccccgaggaacggccctggaagtggtgctacttattagtggatgacgttacgctacacgtcatctcgtagaggaggacgactacaccactacccaaccgaaacggaacccaaacccccgaaaacgaacgggttacgtaaccctaaactaaacgtacgaaacccaccgaacgtccgggaccctaggtacggaacacgacgaccaactaagtttactttcgtgtacgacctaactacttacgtaggtaacgggacgtaccgtaaccgttggtacttccgtacgtaaccccgttaaaccggttccggggttaccccggtaccccggggtcccgggggtaacccccgggtaaccgttccggggtaccccttacccgggttcccttcccgttacccgttaccgttcccccgtaaccccgaaacccggtaacccggggtacccccgttaccggttcccccgggtttaacccccgttccccccgggttccccgggg

SEQ ID NO: 325882 - DNA, 586 bp, Homo sapiens
  misc_feature: GZ8MTXP01DCCTX.22.38.D05.1.454.CMB.2.raw
  modified_base (256)..(256): a, c, t, g, unknown or other
  misc_feature (256)..(256): n is a, c, g, or t
  modified_base (270)..(270): a, c, t, g, unknown or other
  misc_feature (270)..(270): n is a, c, g, or t
  modified_base (278)..(279): a, c, t, g, unknown or other
  misc_feature (278)..(279): n is a, c, g, or t
  modified_base (305)..(305): a, c, t, g, unknown or other
  misc_feature (305)..(305): n is a, c, g, or t
  modified_base (425)..(425): a, c, t, g, unknown or other
  misc_feature (425)..(425): n is a, c, g, or t
  modified_base (537)..(537): a, c, t, g, unknown or other
  misc_feature (537)..(537): n is a, c, g, or t
  modified_base (578)..(578): a, c, t, g, unknown or other
  misc_feature (578)..(578): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtacgaaacccacacagaccctcacgctgacctgccaccttctctggttctcactcaactctagtggagtgggtgtgggctggtccgcncgcccaggaagccnggatggtnntattattagtggatgacgtcgctacngtcatctcgtggaggaggagacctcacactacccaaccaaacggaccaaacccccaaaacgacggtacgtcctaacaatacaccacacgtcggacctgacgacacagccaatattacttngtacgacactactacgtaaggtaggacactaccgttagggtactcgtacgaacctaaacgttccgggtcccgacccgggtcggggaaccccgtacgttcggtcccacgtccnccttcgcgttcccaaccgacgaaccgccacgttccgtcccncccggtcg

SEQ ID NO: 325883 - DNA, 707 bp, Homo sapiens
  misc_feature: GZ8MTXP01ELC8K.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtagaaacccacacagaccctcacgctgacctgcaccttctctggttctcactcaactctagtggagtgggtgtgggtctggttccgtcacgccccgaggaaacggccgtaggaagtggtgctactttatttagttggatcgtacggtaccgctacagtccatctcgtggaggaggagactacaccactaccccgaaccgaaaccggaacccaaaacccccgaaaaaccgtaaccgggttacggttaacccttaaacaaacgtaccgaacccgtaaccacgtacggtacccgtagtacggaaccaacgacgacccaattaacttaacttttcgcgtgacccaactactcctaagggtaggacgtactaccgttggtacgtccgtacgtaaccgtaaacgttccgggttacccggacccccgggttcgggggaacccccgggtaaccggttccggtccgttaccccggtcctccccgttacgccgttccctaacccgaacccgtcgggccctacgttccggttccccgttcccgtcccggg

SEQ ID NO: 325884 - DNA, 708 bp, Homo sapiens
  misc_feature: GZ8MTXP01DB7R7.22.38.D05.1.454.CMB.2.raw
  modified_base (303)..(303): a, c, t, g, unknown or other
  misc_feature (303)..(303): n is a, c, g, or t
  modified_base (404)..(404): a, c, t, g, unknown or other
  misc_feature (404)..(404): n is a, c, g, or t
  modified_base (435)..(435): a, c, t, g, unknown or other
  misc_feature (435)..(435): n is a, c, g, or t
tcagacatacgcgtcacgaccggtgctcgatttagtatctgatagttgggtttgggggaggaactgctcagttaggacccagagggaaccatggaagccccagctcagcttctcttcctcctgctactctggctcccagataccaccggagaaattgtgttgacacagtctccagccaccctgtctttgtcgtaccgggggaaagacgccaccctctcctgcgagggccagtcaagaatgttagtagttacttagctaggtaccagacaaagcctggccaggctcccagactctcatctctanactacactaccaacgacggaccacgcgacactaccacgccgtaggtcgagtcggcgtaggtccggtacgtaggactacgtacctactactcctacactacncgacgacctacgtagactacgtagtaatttntttacgacgttaaagttttacttacgtacgtacgacgtacgtacgtacgtacggtacgtaccgttaccgtaccggtacccgttacccgttacccggttacccggttaccgggtaacccgggtaaaccgggtaaaccggtaacggtaacggtaacgggtaaacgttaaacgtaaacgttaaacgtaaacggtaacggttacggttccgttaccgtaaccgtaaccgttaaccgttacgtttaccgttaccttaaccgtttaacccgttaacccg

SEQ ID NO: 325885 - DNA, 619 bp, Homo sapiens
  misc_feature: GZ8MTXP01CKVC9.22.38.D05.1.454.CMB.2.raw
  modified_base (497)..(497): a, c, t, g, unknown or other
  misc_feature (497)..(497): n is a, c, g, or t
  modified_base (568)..(568): a, c, t, g, unknown or other
  misc_feature (568)..(568): n is a, c, g, or t
  modified_base (576)..(576): a, c, t, g, unknown or other
  misc_feature (576)..(576): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtacgaaacccacacacgaccctcacgctgacctgctaccttctctggttctcactcaactcgtagtggagtgggtgtgggctggttccgtcacgccccgaaggaaacggccctggaagtggtgctacttatttagtggatgacggttacgctacagtccatctcgtggaggagagactcacactacccaaccgaaggaacccaaaccccaaaacgtaacggtacgtccttaaacaaactcgaaccacctacgtcggaccctgtacggaaccaacgacgtaccaaatatttacttctaggtcactaaccagttactaaggagggtaaccnccgtacgtgtactcgtacgtaaccgtaacgtccgtaccgacccgggtccgggaacccgtacgttcgtaccnccgtctcncgcgccctaaccgaccgaacgcctacgttccgtcccgccgtcg

SEQ ID NO: 325886 - DNA, 672 bp, Homo sapiens
  misc_feature: GZ8MTXP01C53PR.22.38.D05.1.454.CMB.2.raw
  modified_base (216)..(216): a, c, t, g, unknown or other
  misc_feature (216)..(216): n is a, c, g, or t
  modified_base (284)..(284): a, c, t, g, unknown or other
  misc_feature (284)..(284): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgctaccttctctggttcncactcaactctagtggagtgggtgtgggctggttccgtcacgccccgaggaacggccctggatgggtnctaacttatttagtgggatggtacggttaccgctacacgtccatctcgtggaggaggacgactacaccactaccccaaccaaacggacccaaacccccgaaaaccgtaacgggttacggttcccttaaacgaactacgaacccaccgtacgtacggacccgtgtacggaacacgacgacctaacatttactttctcggtacaccaactaacgtactaaggtaacgggactaccgtacccgttaggtaaccgtcgtacgaacccgtaacgttccgggtacccgaccccggtcggggaaccccggtaaccgttcggtccaccgttctcccttcgccgttccctaacccgaccgaaccggccctagttccccggtccttcccccggtcggg

SEQ ID NO: 325887 - DNA, 726 bp, Homo sapiens
  misc_feature: GZ8MTXP01B547O.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtacgaaacccacacacgaccctcacgctgacctgcctaccttctctggttctcactcactctagtggagtgggtgtgggctggttccgtcacgccccgaggaacggcctggagtggtgctacttagttagtggatcgacggttaccgctactacgtcctatctcgtgaggaggacgactaccaccactaccccgaaccgaaacggaacccaaacccccgaaaaccgtaacgggttacggttaaccctaacaacgtaccgacccaccacgtcgggaccccttggtacggacaaccgacgaccctaatatttacgtttctggacaccactacgttacgtaaggtacggtacgtaccgtaccgttagggtaaccgtcgttaccggaacccgttaaacggttccggggttaccccggaccccggggttccggggggaacccccggttaacccggttcgggtaccccgttaccggtcccttcccgttcgacccggttcccctaaccggacccggaaccggggtcccctacggtttccccggtccccgtttccccgggtccggg

SEQ ID NO: 325888 - DNA, 759 bp, Homo sapiens
  misc_feature: GZ8MTXP01A6D3H.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtagaaacccacacagaccctcacgctgacctgcaccttctcgtggttctcactcaactcgtagtggagtgggtgtggctggttccgtcacgccccgaggaacggccctggaatgggtgctacttagttagtggatggacggttaccgctacacgtccatctcgtggaggagacgactcaaccactaccccaaccgaaacggaacccaaacccccgaaaaaccgtaacgggtacggttaacccttaaacaaacgttaccgaaccccaacccgtaacgtacgggtaacccctagggtacggaaaccaacgtacgaccctaactaacttaacttttccgaggtacacctaaactacttaccgtaagggtaacggggaactacccgtaaccgtttagggttaaacgtccgtaacggtaaccccgtaaaaccggttcggggttaacccccggaaccccgggtcccggggggtaaccccgggtaaacccgttcggtacccgaccccggtcctcccgttaccgccggttaccccttaacccgaacccggtaaccgggtcccctacggttccccggttccccgtttcccccggtccggg

SEQ ID NO: 325889 - DNA, 685 bp, Homo sapiens
  misc_feature: GZ8MTXP01ANZDI.22.38.D05.1.454.CMB.2.raw
  modified_base (295)..(295): a, c, t, g, unknown or other
  misc_feature (295)..(295): n is a, c, g, or t
  modified_base (480)..(480): a, c, t, g, unknown or other
  misc_feature (480)..(480): n is a, c, g, or t
  modified_base (486)..(486): a, c, t, g, unknown or other
  misc_feature (486)..(486): n is a, c, g, or t
  modified_base (620)..(620): a, c, t, g, unknown or other
  misc_feature (620)..(620): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcacctgaaggagtctggtcctacgctggtacgaaacccacacacgaccctcacgctgacctgcctaccttctcgttgggttctcactctaactctaggtggagtgggtggtgggtctggttccgtcacgccccgaaggaacgcctaggaagtggtnctacttattagtggatgacgtacgctacactcatctcgtgaggagacgactcactactaccccaaaccgaacgaaaccccaaaccccgaaaacgtaacgggttacggtaaccctaaacaaacgtaccaacccaccgtaacgtccggtaccctaggtacgaacaacacgacctataattactttcncgtacncaactactctaagggtacgactccgtaacgttaggtacgtcctacggtaaaccccgtaacgtttccggggtaaccccgaccccggggtaccgggggaaccccgtaaccgttcggtaccttacccgtcctacccnccgacccgcccgtaacccgaccgaacggtcccctacgttcccggttcccccttcccggtcccggg

SEQ ID NO: 325890 - DNA, 598 bp, Homo sapiens
  misc_feature: GZ8MTXP01DIK5K.22.38.D05.1.454.CMB.2.raw
  modified_base (281)..(281): a, c, t, g, unknown or other
  misc_feature (281)..(281): n is a, c, g, or t
  modified_base (417)..(417): a, c, t, g, unknown or other
  misc_feature (417)..(417): n is a, c, g, or t
  modified_base (425)..(425): a, c, t, g, unknown or other
  misc_feature (425)..(425): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctggttctcactcaactctagtggagtgggtgtgggctggttccgtcacgccccaggaacggcctggaatggtnctattattagtggatgacggttacgctacagtccatctctgaggagagactcacactacccaaccaacggaccaaacccccaaaacgacggtacgtctacaatcgaccaccatcggaccctgtacgacacagccanattattcngtcacatactacgtagtacgggacacctaccgtggtaactctacgacctaaacgttcggtacccgaccccggtcgggggaaccccgtaacccgttggtacccaccgttcctccttcgccgccctaacccgaaccgaacgggccccacggttcccggtccccttccccgtccgg

SEQ ID NO: 325891 - DNA, 630 bp, Homo sapiens
  misc_feature: GZ8MTXP01C4MXE.22.38.D05.1.454.CMB.2.raw
  modified_base (314)..(314): a, c, t, g, unknown or other
  misc_feature (314)..(314): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtacgaaacccacacacgaccctcacgctgacctgcctaccttctcgtggttctcactcaactcgtaggtggagtgggtgtgggtctggttcctcacgcccgaggaacgccgtggagtggtgctacttagttagtggatgacgtacnctacagtcatctcgtggaggagagactacacactacccaaccgaacgaacccaaaccccaaaacgtacggtacgtcctaacaacgtacgaccacacgtacggaccctggtacgaaccacgacgacctaactagtttacttcgtgtacactaacgtactacgtaaggtacggacgtctaccgtggtactctacgaccgtaacgttccgggtacccgcccgggtcggggaaccccgtacgttcggtcccgaccgtcctccacgccgttccctaacccgaacgcccggccctacgttcccgttcccttccccggtccgg

SEQ ID NO: 325892 - DNA, 659 bp, Homo sapiens
  misc_feature: GZ8MTXP01B8P7L.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtagaaacccacacagaccctcacgctgacctgctaccttctctggttctcactcaactctagtggagtgggtgtgggctggtccgtcacgccccgaggaaggcctaggagtggtgctacttatttagtggatgacgtacgctacacgtcatctcgtggaggaggagactacacaactaccccaaaccgaaacgaacccaaaacccccgaaaaaacgaacgggttaacggtaaccttaaacaaactacgaaacccaacgtaacgtcggaccccgtagtacggacacgacacctaactatttaacgtttctagtacactaactaactacgtaaggtacgggacgtaccgtacgttagggtactcgtacgaaccctaacgttccgggtacccgaccccggtcgggggaaccccggtaaccgttcggtacccgaccgtctccttcgcgttccaacccgaccgaacggccctacttcccgtcccgttccccgccgg

SEQ ID NO: 325893 - DNA, 755 bp, Homo sapiens
  misc_feature: GZ8MTXP01DJGCU.22.38.D05.1.454.CMB.2.raw
  modified_base (282)..(282): a, c, t, g, unknown or other
  misc_feature (282)..(282): n is a, c, g, or t
  modified_base (309)..(309): a, c, t, g, unknown or other
  misc_feature (309)..(309): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtacgaaaacccacacacgaccctcacgctgacctgctaccttctcgtggttcctcactcaactctagtggagtgggtgtgggctggtccgcacgcccaggacgctggagtggtnctattattgtggatgacgtacgctacncgtcatctgtggaggagagacacacacaccaaccaaacgaacccaaaccccaaacgtacgtacgtcctaacaactacgaccaccgacgtacggacccgtgtacgactacacgtaccctagtaactttactttcgtacggtacacctaacttaacgttaccgttaaagggtaacggggtaaccgttaacccgttaaccgggttaggttaacccgttaccgtaccggttaaaaaccccggtttaaccgttccgggggtttaaaccccccggaccccgggggttaaccgggggggtaaccccccgtaaacccggtttcggggtaaacccccttcccgggttacccgtcccttaaacccgggcccgaccccgttaaccccggaaaaccggttaacccgggtcccccgtaacggtttcccccgggttttaacccccgccccggttcccggg

SEQ ID NO: 325894 - DNA, 805 bp, Homo sapiens
  misc_feature: GZ8MTXP01AV847.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtacgaaacccacacacgaccctcacgctcgacctgcctaccttctcgtgggttctcactcaactctagtggagtgggtgtggctggttccgtcacgccccgaggaacggcctggagtggtgctattattagttggatgtaccggtaccgtctacagtcctatctcgtaggaggaggacgtactaccaacctactacccccgaaaccgaaaccggaaaccccaaaacccccctaaaaaccggtaaacgggttaccggttaacccttaaaccgaaacgttacccggaaacccctaaccgtaacgtaccgggtaacccctgggtaaccggaaccaaccgggaaccgtacccaacgtaacttttacgtttcctgggttacgaccctaacgtaccttacgttaaacggggtaacgggtaccggtaccctaccgggttacggttaccgtccgtaccgtaacccgtaaaccgttcccggggttaccccgggtacccccggtacccggggggtaaccccccgtaccgggttcggtaccccgacccggttccctacccgttcccgacccgttacccccgttaacccgaaacccggtccggggtacccctccggttccccggtttcccccgttcccccgtcccgggg

SEQ ID NO: 325895 - DNA, 636 bp, Homo sapiens
  misc_feature: GZ8MTXP01A3CXA.22.38.D05.1.454.CMB.2.raw
  modified_base (435)..(435): a, c, t, g, unknown or other
  misc_feature (435)..(435): n is a, c, g, or t
  modified_base (474)..(474): a, c, t, g, unknown or other
  misc_feature (474)..(474): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggtccgtcacgccccgaggaaacggcctaggaagtggtgctacttatttatggatgacggttacgctacagtccatctctgaggacggagactcaccactacccaaccgaacggaaccaaacccccgaaaaccgtaacgggtacgtcccgttaacaatacgaccacacgcggaccctaggcgacacganccactattacttctgtacgcactactctaaggtacgganccaccgttggtaacgtcgtacgacccgaaaccgttgggttaccccggaacccccggttgggggaaccccgggtacccttagggtcccacccgtcctacccgttcacggttcccctaaccgaccgtaacgggcccctacgttcccggtcccgttccccgcggg

SEQ ID NO: 325896 - DNA, 700 bp, Homo sapiens
  misc_feature: GZ8MTXP01DIQ4Z.22.38.D05.1.454.CMB.2.raw
  modified_base (237)..(237): a, c, t, g, unknown or other
  misc_feature (237)..(237): n is a, c, g, or t
tcagacatacgcgtcacgaccggtgctcgatttagtatctgatagttgggtttggggagtgactcctgtgcccgaccatggacacactttgctccacgctcctgctgctgaccatcccttcatgggtcttgtcccagatcacctgaaggagtctggtcctacgctggtacgaaacccacacacgaccctcacgctgacctgctaccttctctgggttctcactcaactcgtagtggngtgggtggtgggtctcggtccgtcacgccccgaaggaacggcctggagtgggtgtctacttagtttagtggtagtcggtacggttaccgctactacgtcctatctcgtaggaggacggacgtactacacactaccaaccgaaacggaacccaaaccccgaaaacgtacgggttacgtcgtaacaaacgtacaacccacacgtacgacccgtagtacgacacacacctaactattacgttctcggtcacactactacgtaggtaacgggataccgtacgtacggtactcgtacgtacctaaacggtttccgggttacccggacccggggtccgggggtaaccccgggttaaccgttccggttacccgaccggtttccctacggttacccttcttaccccgtaacccgaaacccgtaacccgggggtcctaacccggttccggttccccgttccccggtcccggg

SEQ ID NO: 325897 - DNA, 690 bp, Homo sapiens
  misc_feature: GZ8MTXP01AWS0E.22.38.D05.1.454.CMB.2.raw
  modified_base (298)..(298): a, c, t, g, unknown or other
  misc_feature (298)..(298): n is a, c, g, or t
  modified_base (323)..(323): a, c, t, g, unknown or other
  misc_feature (323)..(323): n is a, c, g, or t
  modified_base (489)..(489): a, c, t, g, unknown or other
  misc_feature (489)..(489): n is a, c, g, or t
  modified_base (542)..(542): a, c, t, g, unknown or other
  misc_feature (542)..(542): n is a, c, g, or t
  modified_base (620)..(620): a, c, t, g, unknown or other
  misc_feature (620)..(620): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtacgaaacccacacacgaccctcacgctcgacctgcctaccttctcgtgggttctctacctcaactcgtaggtggaggtgggtggtgggtctcggttccgtcacgccccgaggaacgccgtggagtggtnctattattagtggatggacggtacnctacagtccatctcgtgaggtaggacacgtacacactaccccaaccgaaacgaacccaaaccccgaaaacgtaacgggttaccgtaacctaaacaactaccgaacccaccgacgtacggtaaccctggtacgaaccaaccgacgaccctaattacttacttttcgnggtacaccaacctacttaacgttacggggaaggcgaccttacggtaggttacncgtaccgaaccgtacgttccggtacccggccccgggtccgggggaaccccgtccgttcggtcccgaccgttcgtcccncgttacccgccccgtaaccgaaaccggtccggtaccctacggttcccccggttccgttccccgggtccgg

SEQ ID NO: 325898 - DNA, 567 bp, Homo sapiens
  misc_feature: GZ8MTXP01BGWB3.22.38.D05.1.454.CMB.2.raw
  modified_base (178)..(178): a, c, t, g, unknown or other
  misc_feature (178)..(178): n is a, c, g, or t
  modified_base (413)..(413): a, c, t, g, unknown or other
  misc_feature (413)..(413): n is a, c, g, or t
  modified_base (421)..(421): a, c, t, g, unknown or other
  misc_feature (421)..(421): n is a, c, g, or t
  modified_base (424)..(424): a, c, t, g, unknown or other
  misc_feature (424)..(424): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccanacagaccctcacgctgacctgcaccttctctgggttctcactcaactctagtggagtgggtgtggggctgggttccgtcagccccccaggaaaggccctggaatgggtgcacttattatgggatgacggttacgctacagtccatctctgaggaggagactcaccatcaccaaggacaccccaaaaaccaagtggtccttacaaatgaccaccatggaccctgtgacacagccanatatttcngtncacactactagtagagacacgtgtagtcgtcgactaacgtacgtccgtacccgtccggggaacccgggaacccgttcggtcgaccgtcctccttccgcgcctaacccaccgaacggaccgacgttccgtccgttccccgtccg

SEQ ID NO: 325899 - DNA, 677 bp, Homo sapiens
  misc_feature: GZ8MTXP01C2L8E.22.38.D05.1.454.CMB.2.raw
  modified_base (287)..(287): a, c, t, g, unknown or other
  misc_feature (287)..(287): n is a, c, g, or t
  modified_base (311)..(311): a, c, t, g, unknown or other
  misc_feature (311)..(311): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtctgtcccagatcacctgaaggagtctggtcctacgctggtacgaaacccacacacgaccctcacgctcgacctgccaccttctcgtggttctcactcaactcgtagtggagtgggtgtgggcttggtccgtcacgccccgaggaacggcctaggatggtnctattattagtggatgtacggtcnctacagtcatctcgtaggaggaaggacactacacactaccccaaaccgaaacggaacccaaacccccgaaaaccgtaacgggttacgtaacccttaaacgaaacgtacgaacccacgactacgggaccctaggtacgacacgacgaccaagtatttacgttctagtcactactaaccttagtacggtacggacgtactacgtaggtacgtcgtacgacccgtaaacggtcggttaccccggaccccgggtccgggggaaccccggtacgttccgggtcccgttaccgttaccctccgacccgcgttccccgtaacccgaacccgtaacggccccgtacgttcccgttccccgttccccggtccggg

SEQ ID NO: 325900 - DNA, 712 bp, Homo sapiens
  misc_feature: GZ8MTXP01AG6DL.22.38.D05.1.454.CMB.2.raw
  modified_base (260)..(260): a, c, t, g, unknown or other
  misc_feature (260)..(260): n is a, c, g, or t
  modified_base (480)..(480): a, c, t, g, unknown or other
  misc_feature (480)..(480): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtacgaaacccacacacgaccctcacgctcgacctgccaccttctcgtggttctcactcaactctagtggaggtgggtgtgggtctggttccncacgaccccgaaggaacggccgtggagtgggtgtactactttagttagtggtatacggtacggttaccgctacacgtcctatctcgtagaggaggagacctacacactacccaaccgaacggaacccaaaccccgaaacgtaacggtacgtaacctaacaactacgaaccacgtacgtacggtaccctgtacgacacgacgaccctaatattactttcgngtacactactaacttacgtagtaaggggacctcgtaacccggttaggttcgtaccgttacggtaaaccccgttaaacggttcccgggtacccccggtaaccccgggtccggggggtaacccccgggtaaaccgttcgggtaaccccaccggttcccctaccgttccgttaccgccctaaccccgaacgaacccggggtcccaccggttcccggtccccgttcccgtcccggg

SEQ ID NO: 325901 - DNA, 670 bp, Homo sapiens
  misc_feature: GZ8MTXP01A1PE6.22.38.D05.1.454.CMB.2.raw
  modified_base (254)..(254): a, c, t, g, unknown or other
  misc_feature (254)..(254): n is a, c, g, or t
  modified_base (269)..(269): a, c, t, g, unknown or other
  misc_feature (269)..(269): n is a, c, g, or t
  modified_base (277)..(278): a, c, t, g, unknown or other
  misc_feature (277)..(278): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtagaaacccacacagaccctcacgctgacctgcaccttctctgggttctcactcaactctagtggagtgggtgtggctggtcctcncgccccaggaagccnggatggtnnacttattatggatgacgttacgctcactcatctctagaggagacgactcacactacccaaccaacggaacccaaaccccgaaaacgtaacggtacggtccttacaacgtacgaccaccagtacggaccctgtacgaaccgacacgcccaagtattactttcaggtcacctaactacttacctaaggggtaacggacgtacctaaccggttggttaacgtccgttacggaaccccttaaacggttccggggttaccccgaccccgggtcgggggaacccccggtaaccgttcgggtacccacccgggttccttccccgaccgccgttaccccgaacccgaacccggaaccgggcccctacggtttccccgggtcccctttccccggtcccggg

SEQ ID NO: 325902 - DNA, 638 bp, Homo sapiens
  misc_feature: GZ8MTXP01ATDR4.22.38.D05.1.454.CMB.2.raw
  modified_base (455)..(455): a, c, t, g, unknown or other
  misc_feature (455)..(455): n is a, c, g, or t
  modified_base (460)..(460): a, c, t, g, unknown or other
  misc_feature (460)..(460): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgccccaggaaggcctggaatgggtgcacttatttagttggatgacggttaccgctacagtccatctctgaggaggagactcacatcccaaccaacggaaccaaacccccaaaacgaacggtacggtcctaacaaactacgacccaaccacgtacgggacccctggtacgaaccacgacgcccaactaattacttttcnggtanccaacctacttaccgtaaggttaacggggactccgtaacccgttggggtactccgttacgacccgtaaacgttccgggtacccgtaccccggtcgggggccccggtaaccttcggtaccaccgtcctccttcgcgccctaaccgaccgaacggcccagttcccggtccttccccgcgg

SEQ ID NO: 325903 - DNA, 718 bp, Homo sapiens
  misc_feature: GZ8MTXP01BDO3P.22.38.D05.1.454.CMB.2.raw
  modified_base (151)..(151): a, c, t, g, unknown or other
  misc_feature (151)..(151): n is a, c, g, or t
  modified_base (500)..(500): a, c, t, g, unknown or other
  misc_feature (500)..(500): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggngtctggtcctacgctggtacgaaacccacaccagaccctcaacgctgacctgcctaccttctcgtggttctcactcaactctagtggagtgggtgtggctggttccgtcacgccccgaaggaaacggcccgtggaacgtgggttgctacttagtttagttgggatggtaaccggttaccgtctactacgtcatctcgtggaggagacgacctcgaccactaccccgaaacccgaacggaaccccgaaaccccccaaaaaccgtaacgggttacgggtaaccttaacaaacgtccgacccaccacgtcggaaccctggacggaaccacgacgcccaatacgttactttcncgtacgaccactacttacacggtaggacgttaccacccgttagggttacctccgttacgaacccgttaaacgtccgggtttccccgaacccccggggtcgggggtaacccccggtaaacgttccgggtcccttaaccgggttccctaccgttacccgccgacccgtaaccccacggtaaccgggcccctacggttcccgtccccgttccccggccggg

SEQ ID NO: 325904 - DNA, 675 bp, Homo sapiens
  misc_feature: GZ8MTXP01DNDO9.22.38.D05.1.454.CMB.2.raw
  modified_base (296)..(296): a, c, t, g, unknown or other
  misc_feature (296)..(296): n is a, c, g, or t
  modified_base (480)..(480): a, c, t, g, unknown or other
  misc_feature (480)..(480): n is a, c, g, or t
  modified_base (484)..(484): a, c, t, g, unknown or other
  misc_feature (484)..(484): n is a, c, g, or t
  modified_base (604)..(604): a, c, t, g, unknown or other
  misc_feature (604)..(604): n is a, c, g, or t
tcagacatacgcgtcacgaccggtgctcgatttagtatctgatagttgggtttgggggagtgactcctgtgccccaccatggacacactttgctccacgctcctgctgctgaccatcccttcatgggtcttgtcccagatcaccctgaaggagtctggtcctacgctggtacgaaacccacacacgaccctcacgctcgacctgcctaccttctctgggttctcactcaactcgtaggtggaggtggggtggtgggtctggttccgtcacgccccgaggaacggcctggagtggtnctacttattagtggagtcgtacggttaccgactacacgtctatctcgtaggaggagacgactacacactacccaaccaacggaacccaaaccccaaaaccgtaacgggtacgtaacctaacaaactcgaaccctacacgtacggtaccctagtcgaacacacgacccattaatttacttttcgngtanccaactactacgtaaggtaggacgtcctaccggtggtactacgtcgaacctaacgttcgggtacccgaccccggggtcggggaaccccggtaacccttcgggtccacccggtccttaccnccgaccgttccccgtaacccgaccgaacccggggtcccacggttccccgggttccccgttccccgtccggg

SEQ ID NO: 325905 - DNA, 780 bp, Homo sapiens
  misc_feature: GZ8MTXP01B44W1.22.38.D05.1.454.CMB.2.raw
  modified_base (311)..(311): a, c, t, g, unknown or other
  misc_feature (311)..(311): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtacgaaacccacacacgaccctcacgctcgacctgcctaccttctcgtggttctctactcaactctaggtggtaggtggggtggtgggtcgttcgggttccgtcgacggcccccgaagggaacggcccgtaggaagtgggtanacgtaactttagtttagtgggactcggtaccggttaccgtactactacgtcctattcgtcgtaggaggacggacgtacctaccaacgactacccgaaccgaacggaacccaaaccccgaaacgtaacggtacgtcctacaactcgaaccacctacgtacggtacctagtacgacaacgacgaccaacttattacgtttcgtacggtactacctaactaccgttaacgttaacggggtaacggtaaccgtcccgtaacccggttaggtaaccgttaccgtaccgtaacccgttaaaccgttcccggggtaccccggtacccccgggttccgggggtaacccccggtaacccggttccgggtacccttacccgtaaaccttcccgttacccgttccgacccggtaacccctaccccggaaccggtaccccgggacccgttaccgttccccggttccccgtttccccccggg

SEQ ID NO: 325906 - DNA, 689 bp, Homo sapiens
  misc_feature: GZ8MTXP01DDNUS.22.38.D05.1.454.CMB.2.raw
  modified_base (273)..(273): a, c, t, g, unknown or other
  misc_feature (273)..(273): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtacgaaacccacacagaccctcacgctgacctgcaccttctctggttctcactcaactctagtggagtgggtgtgggctggtccgtcacgccccgaggaacgccnggagtggtgctacttatttagtggatggtacggttacgctacagtcatctcgtgaggaggagactacacactacccaaccaacggaccctaaaccccaaaacgaggttacgtcctaacaacacgaccacctactacggaccctgtacggacacgacgaccaactattactttctaggtacacaactacgtacctaggttaacgggacgtaccaccgttgggtaaccgttcgtacgtaacccgtaaacgggttccggttaccccgggacccccggtcggggggtaacccccgggaacccgtttcgggtacccgttaccccggtttcctaacccggttcccgaaccggttcccctaacccgaaacccggtaaccgggtccccacggtttcccgggttaaccccttcccccggtccggg

SEQ ID NO: 325907 - DNA, 706 bp, Homo sapiens
  misc_feature: GZ8MTXP01CENNH.22.38.D05.1.454.CMB.2.raw
  modified_base (308)..(308): a, c, t, g, unknown or other
  misc_feature (308)..(308): n is a, c, g, or t
  modified_base (334)..(334): a, c, t, g, unknown or other
  misc_feature (334)..(334): n is a, c, g, or t
  modified_base (425)..(425): a, c, t, g, unknown or other
  misc_feature (425)..(425): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcacctgaaggagtctggtcctacgctaggtacgaaacccacacacgaccctcaccgctcgacctgcctacctttctcgttcggttctcactcaactcgtaggtggaggttgggtggtcgggtcgttcggttccgtcgacgcccccgaaggaacggccgtggaagtggtnctatttattgtggatgaccggttacnctacactccattctcgtggaggacggacgactcaaccactaccccaaccgaaacggaacccaaaccccgaaacgacggttacgtaacctanaactacgaccacgacgtacgaccctgtacgacacgacgaccactaatttacgttctcggactacactacgttacgttaaggtacggacgtacccgaccgttcgggttacctccgtacgtaaccgtaaaccggttcccgggttacccggaccccgggttccgggggaacccccggtaacccgttcggggtacccttaccccgggttcctcccgaccgttccgcccctaaccaacccggtaacccggtccccaccggttcccgtccccgttccccggtcccgg

SEQ ID NO: 325908 - DNA, 669 bp, Homo sapiens
  misc_feature: GZ8MTXP01E02IP.22.38.D05.1.454.CMB.2.raw
  modified_base (439)..(439): a, c, t, g, unknown or other
  misc_feature (439)..(439): n is a, c, g, or t
  modified_base (461)..(461): a, c, t, g, unknown or other
  misc_feature (461)..(461): n is a, c, g, or t
tcagacatacgcgtcacgaccggtgctcgatttagtatctgatagttgggtttgggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctggttctcactcaactctagtggagtgggtgtgggctggtccgtcacgcccccgaggaacggccctggaagtgggttgctacttagtttagtggatggacggttaccgctacagtccatctcgtaggaggaggagactcaccactacccaaccgaaacgaacccaaacccccaaaaccgaacgggtcgtaacctacaactacgaccacagtacggaccctgacggacacncgaccactattagtttctggtnaccaactactactaggtaggacgcctaccgtggtactcgtacgaccctaaacgtcggttaccccggaccccggtcggggggaacccccggtaaccgttcgggtacccgttacccggttccctccccgttacgcccggttccccttaaccccgacccggtaaaccgggccccgtacgttcccggttcccccgtttccccgtccccgggg

SEQ ID NO: 325909 - DNA, 653 bp, Homo sapiens
  misc_feature: GZ8MTXP01CCPCW.22.38.D05.1.454.CMB.2.raw
  modified_base (314)..(314): a, c, t, g, unknown or other
  misc_feature (314)..(314): n is a, c, g, or t
  modified_base (594)..(594): a, c, t, g, unknown or other
  misc_feature (594)..(594): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtacgaaacccacacacgaccctcacgctcgacctgcctaccttctctggttctcactcactctagtggagtgggtgtggtctcggttccgtcacgccccgaggaacggccctggagtgggtgctattattagtggatgtacgtacnctacagtctatctcgtggaggaggacgactacaccactaccccaaccgaacgaacccaaaccccaaaaccgtaacggtacgtcctaacaacgtacgaccacctacgtacgaccctagtacggacacgacgaccctaagtactttattcgtcgtacgacctactacgttactaaggtacgacgtacctacgtggtacgtccgacgaccgtaacgtcggtacccggtcccggtcggggaaccccggtacgttccgtaccgttaccgtcccgtcaccgttccncccgtaacccacccgtccggtacccctacgttccccggttccccgttccccgtcccggg

SEQ ID NO: 325910 - DNA, 658 bp, Homo sapiens
  misc_feature: GZ8MTXP01DM4U5.22.38.D05.1.454.CMB.2.raw
  modified_base (299)..(299): a, c, t, g, unknown or other
  misc_feature (299)..(299): n is a, c, g, or t
  modified_base (612)..(612): a, c, t, g, unknown or other
  misc_feature (612)..(612): n is a, c, g, or t
  modified_base (651)..(651): a, c, t, g, unknown or other
  misc_feature (651)..(651): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtacgaaacccacacacgaccctcacgctcgacctgcctaccttctcgtggttctcactcaactcgtaggtggaggtgggtggtggcttcggtccgacgaccgaccccgagggaacgccgtaggagtgggtnactactttagttagtggagtcggtaccggttaccgctactacgtcctagtctacgtaggaaggagagtacctaccgacactaccccgaaaccgaaaccggaaccccaaaccccgaaaacggtacgggttaccgttaacctaacactacgaacccacgacgtcggaccctaggacgacacgacaccaagttatttacttctgaccactaactacttacgtaaggtacggacgtacttaccgtggtactccgtacaaccggtacgtcggtacccgcccgggtcgggaaccccgtcgttggcccttacgctccgcnccgccctaaccgaccgtaaccggccctagcccgttcccncccgtcg

SEQ ID NO: 325911 - DNA, 621 bp, Homo sapiens
  misc_feature: GZ8MTXP01DOV3D.22.38.D05.1.454.CMB.2.raw
  modified_base (455)..(455): a, c, t, g, unknown or other
  misc_feature (455)..(455): n is a, c, g, or t
  modified_base (460)..(460): a, c, t, g, unknown or other
  misc_feature (460)..(460): n is a, c, g, or t
  modified_base (481)..(481): a, c, t, g, unknown or other
  misc_feature (481)..(481): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtggctggttccgtcacgccccgaggaacggccctggaagtggtgctacttagtttatgggatgtacggttaccgctacagtccatctctgaggaggagactcacactacccaaccgaaacggaacccaaacccccaaaacgtaacgggtacgtaaccgtaacaactacgaaccaccgacgtacggaccctgtacgacacacgaccatattattcncgtanacacactactaaggtacgganactaccgtgtacgtctacgaacctaaacgtccgggttacccgaccccggtcgggggaaccccgaaccgttcggtcccgttaccgtcctccgttcgcgccctaaccgaacgaacggtcccagttcccgtccttccccgcgg

SEQ ID NO: 325912 - DNA, 617 bp, Homo sapiens
  misc_feature: GZ8MTXP01ECUW5.22.38.D05.1.454.CMB.2.raw
tcagacatacgcgtcacgaccggtgctcgatttagtatctgatagttgggtttgggggaggaactgctcagttaggacccagagggaaccatggaagccccagctcagcttctcttcctcctgctactctggctccagataccaccggagaaattgtgttgacacagtctccagccaccctgtctttgtcgtccggggaaagacgccaccctctcctgcaggccagtcaagaatgttagtagttacttagctagtaccagacaaacgctggccaggctccagactctcatctctagatacatacccaaacgacggccaacgtggcacgttccccacgaccgtagggttaccaagtcggcgaggttacgggtctaggggaacagtacctaccaaccgtcaccaactacgtacaacgccgacttacgacgtacctagaagttaattttcggatttaagtttacttacgtgtacagctagaccgttggctagtcgtcgccgtccgtaccgtacgtttacgggacccgtagggaacccaagtccgtaaggagaccttacgaaacgtacgtgttacggcttacgggcctaacgtaacttcgcttctaaccttcgtttccccg

SEQ ID NO: 325913 - DNA, 713 bp, Homo sapiens
  misc_feature: GZ8MTXP01EPUWR.22.38.D05.1.454.CMB.2.raw
  modified_base (525)..(525): a, c, t, g, unknown or other
  misc_feature (525)..(525): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggttttgtcccagatcaccctgaaggagtctggtcctacgctggtacgaaacccacacacgaccctcacgctgacctgctaccttctcgtggttctcactcaactcgtagtggagtgggtgtggcgtggtccgcgacgccccgaggaacggccgtggagtggttgctacttagtttagttgggatcggtacggttaccgctacagtcctatcgtcgtaggaggaggagacctcaccactaccaaccccgaaacggaaccaaaccccgaaaacgacggttaacgtacccttaagaactcgaacccaccgacgtacgggtacctggtacggaacacacgaccctaattatttaacgttttcgtacgtacacaaccgtacttacgttaagtaacgggggtaacnccgttaaacgtcggggttaaccttcgtaaccgaaccgttaaaccggtccgggtttacccggccccgggttacgggggaccccggtaacccgttcggttaccccgtaccgttcctcccgtaccgttcccgcccttacccgaacggtacccgggccctacgtcccggttcccctccccgttggaaccccg

SEQ ID NO: 325914 - DNA, 640 bp, Homo sapiens
  misc_feature: GZ8MTXP01BKX4B.22.38.D05.1.454.CMB.2.raw
  modified_base (295)..(295): a, c, t, g, unknown or other
  misc_feature (295)..(295): n is a, c, g, or t
  modified_base (336)..(336): a, c, t, g, unknown or other
  misc_feature (336)..(336): n is a, c, g, or t
  modified_base (461)..(461): a, c, t, g, unknown or other
  misc_feature (461)..(461): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtacgaaacccacacacgaccctcacgctcgacctgcctaccttctcttgggttctcactcaactcgtaggtggagtgggtggtgggtcgtcggtccgtcacgccccgaggaacggcctggagtggtnctatttagttgtggatgacgtacgactacactctatcgtgnggaggagacgactacacactacccaaccaacgaacccaaaccccaaacgaggttacgtcctaacaactacgaccacgtacgtacggtaccctggtacgaccacgacgaccataacgtttattcgngtacaccactacgtctagggagacgtcctacggtgtaacgtcgtacgaacctaacggtccggtacccgtaccccggggcgggtaaccccgggtaaccttgggtacccttacccggtctcccgttcgccgccctaaccgaccggaaccggtccctacgttcccgttcccgttcccgccgg

SEQ ID NO: 325915 - DNA, 664 bp, Homo sapiens
  misc_feature: GZ8MTXP01BIAA3.22.38.D05.1.454.CMB.2.raw
  modified_base (478)..(478): a, c, t, g, unknown or other
  misc_feature (478)..(478): n is a, c, g, or t
  modified_base (593)..(593): a, c, t, g, unknown or other
  misc_feature (593)..(593): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtccagatcacctgaaggagtctggtcctacgctggtacgaaacccacacacgaccctcacgctgacctgcctaccttctcttcggttctcactcaactctagtggaggtgggtggtgggtcttcggttccgtcgacgaccccgaaggaaacggcccgtaggaagtgggtgctactttagtttagtcggtagtcgtaccggttcgactacacgtccatctcgtagaggagacgactacacactacccaaccaaacggaacccaaaccccaaaaccgaacgtccgtaactaacaactacaaccaccactcggacccttgacgaccaacacgacctaatattaccgtttncgacactactaacgtactaacggagtacgactacggtagtactcgtacgtaacccgtacggttcccgggtacccggtaccccgggtaccggggtaacccgtaccgttcgtacccnccgttccgtaccacgccttacccgtaacccgacggtccgtcccgtcggttccccgttcccgttcccgtccg

SEQ ID NO: 325916 - DNA, 578 bp, Homo sapiens
  misc_feature: GZ8MTXP01DUHQG.22.38.D05.1.454.CMB.2.raw
  modified_base (280)..(280): a, c, t, g, unknown or other
  misc_feature (280)..(280): n is a, c, g, or t
  modified_base (325)..(325): a, c, t, g, unknown or other
  misc_feature (325)..(325): n is a, c, g, or t
  modified_base (333)..(333): a, c, t, g, unknown or other
  misc_feature (333)..(333): n is a, c, g, or t
  modified_base (364)..(364): a, c, t, g, unknown or other
  misc_feature (364)..(364): n is a, c, g, or t
  modified_base (367)..(368): a, c, t, g, unknown or other
  misc_feature (367)..(368): n is a, c, g, or t
  modified_base (374)..(374): a, c, t, g, unknown or other
  misc_feature (374)..(374): n is a, c, g, or t
  modified_base (379)..(379): a, c, t, g, unknown or other
  misc_feature (379)..(379): n is a, c, g, or t
  modified_base (405)..(405): a, c, t, g, unknown or other
  misc_feature (405)..(405): n is a, c, g, or t
  modified_base (431)..(431): a, c, t, g, unknown or other
  misc_feature (431)..(431): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcacctgaaggagtctggtcctacgctggtacgaaacccacacagaccctcacgctgacctgcaccttctctgggttctcactcaactctagtgagtgggtgtggctggtccgtcagccccaggaaagcctagaagtggtgnacttatttagtggatgacgtacgctacagtcatctctgaggaganactcacanaccacaagacaacccaaaacaagtagtctanaannacacangaccngtagacacagtccataacttatttcngtacacaacactctaagtaacggganaccgaccgttgtacgtctaggacctaaacgttcgggttaccgaccccggtcgggggaaccccggaacccgttgggtaccttaccgtcctcttcgcgttcccaacccgaaccgaacgggtcccagttcccggtccgtttccccgcggg

SEQ ID NO: 325917 - DNA, 701 bp, Homo sapiens
  misc_feature: GZ8MTXP01ADHXE.22.38.D05.1.454.CMB.2.raw
  modified_base (644)..(644): a, c, t, g, unknown or other
  misc_feature (644)..(644): n is a, c, g, or t
tcagacatacgcgtcacgaccggtgctcgatttagtatctgatagttggggtttgggggagtgactcctgtgccccaccatggacacactttgctccacgctcctgctgctgaccatcccttcatgggtcttgtcccagatcacctgaaggagtctggtcctacgctggtacgaaacccacacacgaccctcacgctgacctgctaccttctcgtggttcctcactcaactctaggtggaggtgggtggtgggtcgtcggttccgtcacggccccgaggaaacggccgtggaagtgggtgactactttaagtttagtagggtatacggtacggttaccgctacacgtccatctcgtggaggtaggacactcactactacccaaaccgaacggaaccccaaaccccgaaacgtaacgggttacgtcctaacaactacaccacagtacgaccctggacgacacgacgaccatattacttcgtacgtacactaactaccgttagtaacggggtacggacctccgtaaccgttgggtaacctcgtaccggtaaccaaaccgggtttccgggtaccccggtaaccccggggttccgggggaaccccggtacccgttcggggtacccttaccccgttaccgttcccgacncccgttacccaacccgacggaacccgtaccctcggttcccgtcccgttccccggcgg

SEQ ID NO: 325918 - DNA, 698 bp, Homo sapiens
  misc_feature: GZ8MTXP01BAYJ6.22.38.D05.1.454.CMB.2.raw
  modified_base (316)..(316): a, c, t, g, unknown or other
  misc_feature (316)..(316): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctggttctcactcaactctagtggagtgggtgtgggctcggttccgtcacgcccccgaggaaacggccctggaatgggtgctacttatttagtggatggacgttaccgntacagtccatctcgtgaggaggagactacaccatccccaaccgaaacgacccaaacccccaaaacgaaggtacgtccttaacaactacgacccacacgtcgaccctgtacgacacacgaccatattattttccaggtcacctaaactcttaacgtaggtaacggtacgtacctaaccgttacggggtaacttccgtaccggaacccgttaaaaccggttcgggttaaccccggtaccccgggtccggggggtaacccccggtaaacccgttcggggttaaccccaccgggttccctaccccgttcggacccgttccccgtaacccgaacccggaaccggggtccccctacggttccccgggtccctttccccccgggccggg

SEQ ID NO: 325919 - DNA, 667 bp, Homo sapiens
  misc_feature: GZ8MTXP01AYNZZ.22.38.D05.1.454.CMB.2.raw
  modified_base (488)..(488): a, c, t, g, unknown or other
  misc_feature (488)..(488): n is a, c, g, or t
  modified_base (614)..(614): a, c, t, g, unknown or other
  misc_feature (614)..(614): n is a, c, g, or t
tcagacatacgcgtcacgaccggtgctcgatttagtatctgatagttgggtttggggagtgactcctgtgcccgaccatggacacactttgctccacgctcctgctgctgaccatcccttcatgggtcttgtcccagatcaccctgaaggagtctggtcctacgctggtacgaaacccacacacgaccctcacgctcgacctgcctaccttctcgtgggttcctcactcaactctaggtggagtgggtgtgggctggtccgtcacgccccgaggaagccctaggagtggtgctacttagtttagtgggtatcggtacggtaccgctacgcgtccatctcgtgaggagacgactacacactacccgacgaacgacccaaaccccgaaacgtcgtacgtctaacaataccgaccacgagtcgtaccctggacgaccacgacgtaccaattagttactttcgctcgactaacgtcttacgagggtacgganaccgtaccggtagtcgttcgcgtaacccgtaacggtccgggttacccggaccccgggttcgggggaaccccggtaacccgttcggtaaccccgttccgttaccgtcccttaccgccggttaccccnccgaaccggtaaccgccccgtacgttccccggtaaccccgttcccggccccgg

SEQ ID NO: 325920 - DNA, 887 bp, Homo sapiens
  misc_feature: GZ8MTXP01AWFU7.22.38.D05.1.454.CMB.2.raw
tcagacatacgcgtcacgaccggtgctcgatttagtatctgatagttgggtttgggggagtgactcctgtgccccaccatggacacactttgctccacgctcctgctgctgaccatcccttcatgggtcttgtcccagatcaccctgaaggagtctggtcctacgctggtacgaaacccacacacgaccctcacgctcgacctgcctaccttctcgtggttctcactctaactcgtagtggtaggtggggtggtgggtcttcggggttcccgtacgaccgacccccggaagggaaacggtcccgtagggaaggttgggttacgtacttaacgtttaagtttaggttaggggtacgttacggtaacccgggttaccgtacctaaccgtacgttcctacgttccgttacggtagggaaggggtaacggtaccgtaacgtacccaactaaccgtaacccccgaaaccccgaaaaccgggaaaccccctaaaaaccccccgtaaaaaccggtaaaccggggttaccgttaaccccttaaacgaaaccgttacccggaaccccaaaccgtaccggtaccggtacccgtacggtacggaactaacgacctaaccgaatttaaccttacgtttaacgtcggtactaacctacccgtaaacttcgttaaacggggttaacgggaccgttaccgtaaccggttacggtaacgttcctaaccggtaacccgtaacggttcccgggttaccccggacccggggtcccgggggtaaccccggtaccgttcgggtacccacccgttaccgtcccgaccgttaccgttacccccgtaaccggtaaccccggaacccgtaccccgtacggttcccccgggttccccttccccgggtcccggg

SEQ ID NO: 325921 - DNA, 648 bp, Homo sapiens
  misc_feature: GZ8MTXP01B2A1W.22.38.D05.1.454.CMB.2.raw
  modified_base (455)..(455): a, c, t, g, unknown or other
  misc_feature (455)..(455): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtacgaaacccacacacgaccctcacgctcgacctgccaccttctctggttctcactcaactctagtggaggtgggtggtggtcgtcggttccgtcgacgccccgaggaacggcccgtaggaagtggtgctacttatttagttggatcggtacggtaccgactacacgtcactctcgtaggaggaggagactacacactacccaaccaacgaacccaaaccccaaacgtaacgtacgtctaacaatacaccacacgacgaccctgacgacacagaccatattacttcngtacaccaactactagtaaggtacggactaccacgttgtacgtcgtacgaaccctaacggtccgggtacccgacccgggtccgggggaaccccggtaacttcgggtacccttaccgtcccttaccgccgaccttaccccgtaacccgaaccgaacgggcccctacggttccccgtccccgttccccgtccggg

SEQ ID NO: 325922 - DNA, 604 bp, Homo sapiens
  misc_feature: GZ8MTXP01EGC7D.22.38.D05.1.454.CMB.2.raw
  modified_base (248)..(248): a, c, t, g, unknown or other
  misc_feature (248)..(248): n is a, c, g, or t
  modified_base (285)..(285): a, c, t, g, unknown or other
  misc_feature (285)..(285): n is a, c, g, or t
  modified_base (309)..(309): a, c, t, g, unknown or other
  misc_feature (309)..(309): n is a, c, g, or t
  modified_base (321)..(321): a, c, t, g, unknown or other
  misc_feature (321)..(321): n is a, c, g, or t
  modified_base (330)..(330): a, c, t, g, unknown or other
  misc_feature (330)..(330): n is a, c, g, or t
  modified_base (377)..(377): a, c, t, g, unknown or other
  misc_feature (377)..(377): n is a, c, g, or t
tcagacatacgcgtcacgaccggtgctcgatttagtatctgatagttggggtttggggagtgactcctgtgccccaccatggacacactttgctccacgctcctgctgctgaccatcccttcatgggtcttgtcccagatcaccctgaaggagtctggtcctacgctggtacgaaacccacacacgaccctcacgctgacctgctaccttctctggttctcactcaactctagtggagtgggtgtggntggtccgtcacgcccgaggaacgcctggaagtgggtnctacttattagtggatgacgtacntacagtcatctntggagaganactcacatacccaacaacgaccaaaccccaaacgtaacggcgtctanaactacgacccacatcgaccctgtcgacacgacaccatacttattctagcacacacgtactaggtacgacgtacacgttggatcgtacgaacctaaggttccggtaccgacccgggtcgggggaaccccggttaccgttcggttccgaaccgttcctacccgcgccgttacccgtaacccgaaccgaaccgggtcccctaccggttccgttccccttccccgtcggg

SEQ ID NO: 325923 - DNA, 647 bp, Homo sapiens
  misc_feature: GZ8MTXP01C5TEX.22.38.D05.1.454.CMB.2.raw
  modified_base (283)..(283): a, c, t, g, unknown or other
  misc_feature (283)..(283): n is a, c, g, or t
  modified_base (440)..(440): a, c, t, g, unknown or other
  misc_feature (440)..(440): n is a, c, g, or t
  modified_base (460)..(460): a, c, t, g, unknown or other
  misc_feature (460)..(460): n is a, c, g, or t
tcagacatacgcgtcacgaccggtgctcgatttagtatctgatagttgggtttggggagtgactcctgtgccccacatggacacactttgctccacgctcctgctgctgaccatcccttcatgggtcttgtcccagatcacctgaaggagtctggtcctacgctggtagaaaccacacagaccctcacgctgacctgtcaccttctctggttctcactcaactctagtggagtgggtgtgggctggtcctcacgaccccgaggaacggccctaggaatgggtnactacttatttagtggatggtacgttaccgctacacgtcatctacgtgaggtaggagactcacactaccccaaccgaaacgacccaaaccccaaaacgtaaggttacgtccgttaacaaacgtacgaaccacgataccggacccttagacgaaccanacgacctaacattactttcngtacactactacgtctaaggacgtacgctaccgtgttacgtacctacgtaccctaaacggtccggttacccgaccccgggtcgggggaacccccggtaacgttcgggtaccttaccggttcctccgttccgcgttccccaaccgacccgaacgggtcccacggttcccggttcccttccccggtcgg

SEQ ID NO: 325924 - DNA, 744 bp, Homo sapiens
  misc_feature: GZ8MTXP01BMPHX.22.38.D05.1.454.CMB.2.raw
  modified_base (490)..(490): a, c, t, g, unknown or other
  misc_feature (490)..(490): n is a, c, g, or t
  modified_base (500)..(500): a, c, t, g, unknown or other
  misc_feature (500)..(500): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtacgaaacccacacagacccctcaccgctcgacctgcctaccttctcgttggttcctcactcaactcgtagtggagtgggtgtgggctggttcctcacgccccgaggaacgcccgtaggagtggtgctacgtttatttagtgggagtagtacggttaccgactacacgtccatcgtcgtacgaggaggactacgtacaccactacccaaccgaaccgaacccaaaccccaaaaccgtacgggttacgtaaccttaacaaactaccgaccctaccgacgtccggtaccctggtacggaacacgacaccctaatacttatttcngtacaccaanacccttagttaaggaacggtcgacccgtaaccggttggtaacgtcccgtacgtaaacccgtaacgtttccggggtacccccgtaccccgggggttacccggggaacccccggggtaaacgttcccggggtaccccttaccgttccccgttacccgttccgaccccgttcccccgttaacccggaaccccgtaacccggggtaacccctcggttccccggttcccccgttcccccggttcccggg

SEQ ID NO: 325925 - DNA, 683 bp, Homo sapiens
  misc_feature: GZ8MTXP01AISW8.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggtccgtcacgcccccgaggaaacggccctaggaagtgggttcgctactttatttagtgggtatgaccggttaccgctacgcgtccatctctgaggagagactcaccactacccaaccaacggaacccaaaccccccaaaacgtaacggtacgtaacccttaacaaactacgaacccaccacgtacgggaaccctggtacggacacacgacccaatacttactttcagtacgacctaactacgttaccgtaaggttacggacggtacctaccgtggggttactccgttacgaacccgtaaacgttccgggttacccggccccggttaccgggggcccccggtaaccgttcgggtacccttaccggtcctacccttccgacttccccgtaacccaccggaacgggtcccctaggttcccgttcccgttcccccgtcgg

SEQ ID NO: 325926 - DNA, 755 bp, Homo sapiens
  misc_feature: GZ8MTXP01ATVFF.22.38.D05.1.454.CMB.2.raw
  modified_base (180)..(180): a, c, t, g, unknown or other
  misc_feature (180)..(180): n is a, c, g, or t
  modified_base (303)..(303): a, c, t, g, unknown or other
  misc_feature (303)..(303): n is a, c, g, or t
tcagacatacgcgtcacgaccggtgctcgatttagtatctgatagttggggtttgggggagtgactcctgtgccccaccatggacacactttgctccacgctcctgctgctgaccatcccttcatgggtctgtcccagatcacctgaaggagtctggtcctacgctggtacgaaacccanacagaccctcacgctgacctgctaccttctcgtcgggttcctctactactaactcgtaggtggtaggtgggtggtcggtcgtcggtccgtcgacgccccgaaggaacgtccgtagagtggtanactattagttagtggtagtacggtaccggttacgctacgacgtctatcgtcgtagaggaggagtactccaactaacctacccgaaaccgaaacggaaacccccaaaacccccgtaaaaccggtaaacgggtttacccgtaacccgtaaacgtaaaccgtaacccggaacccaaccgtaccggaaccgggtacccgttacgggaacggaaccctaaacccggacgtaaaccccttaattacctttaaccgtttatccggttaaccgactaaccgtaacttaaccgttaagggaacgggtaacctacgttaccggtagttaaccgtgtacccgttaacgtacgtccgggtacccgaccgggtacccgggaacccgcgttcgcccgttaacgtcctccttacgccgttcccaacgggaccgccgtaccctcgttaccccgttccgccccgtccgg

SEQ ID NO: 325927 - DNA, 554 bp, Homo sapiens
  misc_feature: GZ8MTXP02F2XL4.22.38.D05.1.454.CMB.2.raw
  modified_base (421)..(421): a, c, t, g, unknown or other
  misc_feature (421)..(421): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagccccccaggaaaggcccctggaatgggttgcacttatttattgggatgacggttaccgctacagtccatctctgaggaggagactcaccatccaccaaggacacccccaaaacagtgtcctacaatgaccaccatggaccctgtggacacagccacatatttcngtgcacactctataggagcacctggtacgtctgccaaactggttaccgaccccgtggggacccgggaaccctggtccaccggtctccctcacgccctccgaccaacgggcccagtccggtccttccccctcgg

SEQ ID NO: 325928 - DNA, 550 bp, Homo sapiens
  misc_feature: GZ8MTXP02J1Z8T.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagccccccaggaaaggcccctggaatgggttgcacttatttattgggatgacggttaccgctacagtccatctctgaggaggagactcaccatccaccaaggacacccccaaaacaggtggtccttacaatgaccaccatcggaccctgtggacacagccacatattctgtgcacactctataggagcaccgtggtatctgcctaaactggttccgaccccgtggggcccccgggaacctggtccaccgtctcctcacgcctccgaccacgggcccatccggtccttccccgcgg

SEQ ID NO: 325929 - DNA, 518 bp, Homo sapiens
  misc_feature: GZ8MTXP02GSSVJ.22.38.D05.1.454.CMB.2.raw
  modified_base (506)..(506): a, c, t, g, unknown or other
  misc_feature (506)..(506): n is a, c, g, or t
tcagacatacgcgtcacgaccggtgctcgatttagtatctgatagttgggtttgggggaggaactgctcagttaggacccagagggaaccatggaagccccagctcagcttctcttcctcctgctactctggctcccagataccaccggagaaattgtgttgacacagtctccagccaccctgtctttgtctccgggggaaagagccaccctctcctgcagggccagtcagaatgttagtagttacttagcctggtaccagcaaaagcctggccaggctcccagactcctcatctctgatacatccaacagggccactggcactcccagccaggttcagtggcagtcggtctgggacagacttcactctcaccatcagcgacctagacgcctagaagtatttgctagtttattactgtacagcagcgtagcatctggcctccgtactacctttggccaggggaccaagctaggagatacaaacgaactgtacggctgcaccatctntcttcacttccc

SEQ ID NO: 325930 - DNA, 526 bp, Homo sapiens
  misc_feature: GZ8MTXP02HOLXL.22.38.D05.1.454.CMB.2.raw
tcagacatacgcgtcacgaccggtgctcgatttagtatctgatagttgggtttgggggaggaactgctcagttaggacccagagggaaccatggaagccccagctcagcttctcttcctcctgctactctggctcccagataccaccggagaaattgtgttgacacagtctccagccaccctgtctttgtctccggggaaagagccacctctcctgcagggccagtcagaatgttagtagttacttagcctggtaccagcaaaagcctggccaggctcccagactcctcatctctgatacatccaacaggccactggcatcccagccaggttcagtggcagtgggtctggggacagacttcactctcaccatcagcgacctagagcctgaagattttgctagtttattactgtcagcagcgttagcatctggccctcgtactaccgtttggcccgagggggacccaaaggctgggagatacaaaacggtaactgtggcctgaaccaccattctgtcttcatttccc

SEQ ID NO: 325931 - DNA, 511 bp, Homo sapiens
  misc_feature: GZ8MTXP02FGLPF.22.38.D05.1.454.CMB.2.raw
tcagacatacgcgtcacgaccggtgctcgatttagtatctgatagttgggtttgggggaggaactgctcagttaggacccagagggaaccatggaagccccagctcagcttctcttcctcctgctactctggctcccagataccaccggagaaattgtgttgacacagtctccagccaccctgtctttgtctccgggggaaagagccaccctctcctgcagggccagtcagaatgttagtagttacttagcctggtaccagcaaaagctggccaggctcccagactcctcatctctgatacatccaacagggccactggcatcccagccaggttcagtggcagtcgggtctgggacagacttcactctcaccatcagcgactagagcctgaagtatttgctagtttattactgtcagcagcgtagcatctggcctccgtacacctttggccgtaggggaccaagctggagatacaaacgaactgtacgctgcgacatctgtctacactccc

SEQ ID NO: 325932 - DNA, 561 bp, Homo sapiens
  misc_feature: GZ8MTXP02I506T.22.38.D05.1.454.CMB.2.raw
  modified_base (380)..(380): a, c, t, g, unknown or other
  misc_feature (380)..(380): n is a, c, g, or t
  modified_base (388)..(388): a, c, t, g, unknown or other
  misc_feature (388)..(388): n is a, c, g, or t
  modified_base (405)..(405): a, c, t, g, unknown or other
  misc_feature (405)..(405): n is a, c, g, or t
  modified_base (424)..(424): a, c, t, g, unknown or other
  misc_feature (424)..(424): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggtgcacttattattggatgacgttacgctacagtccatctctgaggagagactcacatccaccaagacaaccccaaaacagtgtctacaatgaccacangaccctgngacacagcacatattcngtgacacactctataggancacctggtatcgtgaccaaacgtggttaccgacccccgtgggggaccccgggtaaaccctcgggtccaaccggttcctcccgtcacgccctaaccgacccgaaacgggccccaagtcccggtcctttcccccgcggg

SEQ ID NO: 325933 - DNA, 568 bp, Homo sapiens
  misc_feature: GZ8MTXP02JTBUV.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggttgcacttatttattgggatgacggttaccgctacagtccatctctgaggaggagactcaccatccaccaagaccacccccaaaacaggtgtccttacaatgaccacatgaccctgtggacacagccacatattctgtgcacactctataggagcacctggtacgtctgaccaaaacgtcgggttaccgaacccccgttgggggcccccgggaaacccgtcgggtccacccggtctccctcacgccctccgaccgaacgggcccagtccggtccttccccgtccgg

SEQ ID NO: 325934 - DNA, 555 bp, Homo sapiens
  misc_feature: GZ8MTXP02JCLVV.22.38.D05.1.454.CMB.2.raw
  modified_base (381)..(381): a, c, t, g, unknown or other
  misc_feature (381)..(381): n is a, c, g, or t
  modified_base (443)..(443): a, c, t, g, unknown or other
  misc_feature (443)..(443): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggtgcacttattatgggatgacgttaccgctacagtccatctctgaggaggagactcaccatcccaaccaaggacaaacccccaaaacaggtcgtccttanaaatcgaccaccatcgaccctgtcggacacagccaacatattctagtgcacactctataggngcactggtatctagaccaaactcggttaccgacccgtcggggcccggaacccgtggtccaccgtctcctcacgcctccgaccgaacgggcccagtccggtcctccccgtcgg

SEQ ID NO: 325935 - DNA, 590 bp, Homo sapiens
  misc_feature: GZ8MTXP02FXQ0W.22.38.D05.1.454.CMB.2.raw
  modified_base (372)..(372): a, c, t, g, unknown or other
  misc_feature (372)..(372): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggttgcacttatttattgggatgacggttaccgctacagtccatctctgaggaggagactcaccatcccaccaaggaccaacccccaaaacncggtcgtccttacaatcgaccaccatcggaccctgtggacacacgccaacatatttctgtgcacactctataggagcacctggtacgtctagaccctaaacgtggttaccgaccccgttcgggggaccccggtaacccgtgggtcccaccggtcctccgtaccacgtaccctccgaacccgaacgggccccacgttccgggtcccttcccccgtccgg

SEQ ID NO: 325936 - DNA, 533 bp, Homo sapiens
  misc_feature: GZ8MTXP02F1LAJ.22.38.D05.1.454.CMB.2.raw
tcagacatacgcgtcacgaccggtgctcgatttagtatctgatagttgggtttgggggaggaactgctcagttaggacccagagggaaccatggaagccccagctcagcttctcttcctcctgctactctggctcccagataccaccggagaaattgtgttgacacagtctccagccaccctgtctttgtctccggggaaagagccaccctctcctgcagggccagtcagaatgttagtagttacttagcctggtaccagcaaaagcctggccaggctcccagactcctcatctctgatacatccaacaggccactggcatcccagccaggttcagtgcagtggtctgggacagacttcactctcaccatcagcgacctagagcctgaagtatttgctagtttattactgtcagcagcgtagcatctggcctccgtacacctttggacccgagggggacccaagccgtagggagaactacgaaaacgaactgtacggcctggaaccaccattcgtgttacttctactttcccg

SEQ ID NO: 325937 - DNA, 570 bp, Homo sapiens
  misc_feature: GZ8MTXP02JIOHL.22.38.D05.1.454.CMB.2.raw
  modified_base (369)..(369): a, c, t, g, unknown or other
  misc_feature (369)..(369): n is a, c, g, or t
  modified_base (425)..(425): a, c, t, g, unknown or other
  misc_feature (425)..(425): n is a, c, g, or t
  modified_base (443)..(443): a, c, t, g, unknown or other
  misc_feature (443)..(443): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggttgcacttatttatggatgacggttaccgctacagtccatctctgaggagagactcaccatcccaccaaggaccaacccccaaaacnggtcgtccttacaatcgaccaccatcggaccctgtggacacagccaacatatttcngtgcacactctatagganccacctggtatctgaccctaaagtcggttaccgaccccgtcgggggaccccggaaccctgggcccaccggtctccgtccacgccctaaccaccgaacgggccccagtcccggtccttcccccgtcgg

SEQ ID NO: 325938 - DNA, 579 bp, Homo sapiens
  misc_feature: GZ8MTXP02H3NYS.22.38.D05.1.454.CMB.2.raw
  modified_base (270)..(270): a, c, t, g, unknown or other
  misc_feature (270)..(270): n is a, c, g, or t
  modified_base (274)..(274): a, c, t, g, unknown or other
  misc_feature (274)..(274): n is a, c, g, or t
  modified_base (438)..(438): a, c, t, g, unknown or other
  misc_feature (438)..(438): n is a, c, g, or t
tcagacatacgcgtcacgaccggtgctcgatttagtatctgatagttgggtttggggagtgactcctgtgccccaccatggacacactttccgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggtcgtcagccccaggaagccnggangggtgcatattatggatgacggttaccgctacagtccatctctgaggaggagactcacatcccaccaacgacaaccccaaaacaggtacgtcctaacaatacgaccaccatcgaccctgtacggacacacgaccacattattctagtgcacactctaataggancactggtatctgaccaaacgtcggttaccgaccccgtcgggggacccccggaacccgttgggacctacccggtcctcccgtaccacgcccctaacccgaaccgaacggggccccaacgttcccggtccctttcccccgcgg

SEQ ID NO: 325939 - DNA, 562 bp, Homo sapiens
  misc_feature: GZ8MTXP02JNXYE.22.38.D05.1.454.CMB.2.raw
  modified_base (386)..(386): a, c, t, g, unknown or other
  misc_feature (386)..(386): n is a, c, g, or t
  modified_base (413)..(413): a, c, t, g, unknown or other
  misc_feature (413)..(413): n is a, c, g, or t
  modified_base (416)..(416): a, c, t, g, unknown or other
  misc_feature (416)..(416): n is a, c, g, or t
  modified_base (431)..(431): a, c, t, g, unknown or other
  misc_feature (431)..(431): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggtgcacttattatgggatgacggttaccgctacagtccatctctgaggaggagactcacatccaccaagacaaccccaaaacagtcgtcctacaatcgaccacancgaccctgtgacacagccacatattcngtncacactctataggancaccgtggtacgtctagaccaaacgttcgggttacccgaccccgtgggggaccccggaaccctgggtccacccggtctcccgtcacgccctcccgaccgaacgggcccagtcccggtccttccccgtcggg

SEQ ID NO: 325940 - DNA, 629 bp, Homo sapiens
  misc_feature: GZ8MTXP02I3T99.22.38.D05.1.454.CMB.2.raw
  modified_base (405)..(405): a, c, t, g, unknown or other
  misc_feature (405)..(405): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggttgcacttatttattgggatgacggttaccgctacagtccatctctgaggaggagactcaccatccaccaagacaacccccaaaacagtacggtccttacaatcgaccaccatcggaccctgngacacagccacatattctgtgcacactctataggagcacctggtactcgtagaccctaaaacgtggtttaccgaacccccgttgggggacccccggggtaaaccctcggggtaccctaaccggttccctcccgttacccgaacggcccccttaacccgaaaccccgtaaaaccgggggccccctaaagttcccccgggggttaccctttcccccccgtccgggg

SEQ ID NO: 325941 - DNA, 599 bp, Homo sapiens
  misc_feature: GZ8MTXP02JPPZY.22.38.D05.1.454.CMB.2.raw
  modified_base (412)..(412): a, c, t, g, unknown or other
  misc_feature (412)..(412): n is a, c, g, or t
  modified_base (417)..(417): a, c, t, g, unknown or other
  misc_feature (417)..(417): n is a, c, g, or t
  modified_base (427)..(427): a, c, t, g, unknown or other
  misc_feature (427)..(427): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggtgcacttatttatgggatgacggttaccgctacagtccatctctgaggaggagactcaccatcccaccaacgaccaacccccaaaacaggtcgtccttacaatcgaccaccatcggaccctgtcgacacngccanatattctgtncacactctataggagcaccgtggtacgtctcggaccctaaacgtcgggttacccgaccccgtcgggggacccccgggtaaccctgggtacccaccggttcctcccctacgacgcccctaacccgaacccgaaacggggtccccaacgttcccggttcccttcccccggtcgg

SEQ ID NO: 325942 - DNA, 578 bp, Homo sapiens
  misc_feature: GZ8MTXP02FY8YI.22.38.D05.1.454.CMB.2.raw
  modified_base (413)..(413): a, c, t, g, unknown or other
  misc_feature (413)..(413): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggcccctggaatgggttgcacttatttattgggatgacggttaccgctacagtccatctctgaggaggagactcaccatccaccaaggacaacccccaaaacaggtgtcctacaatgaccacatcggaccctgtgacacagccanatatttctgtgcacactctataggagcaccgtgtagtctggacctaaaacgtcgggttccgacccccgtgggggaccccgggtaaccctcgggtccacccggtctcccgtcacgtccctccgaacccgaacggggccccacgttccggtcctttcccccgtcggg

SEQ ID NO: 325943 - DNA, 650 bp, Homo sapiens
  misc_feature: GZ8MTXP02GAMYO.22.38.D05.1.454.CMB.2.raw
  modified_base (449)..(449): a, c, t, g, unknown or other
  misc_feature (449)..(449): n is a, c, g, or t
  modified_base (466)..(466): a, c, t, g, unknown or other
  misc_feature (466)..(466): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgcccccaggaaaggccctggaatgggtgcacttattattgggatgacggttaccgctacagtccatctctgaggaggagactcaccatacccaccaaacggaaccaaaccccccaaaaacacggttacggtcccttaacaaatcgaacccaaccagtcggaccctgtacgacacagccaacatatttctgtnacacactctaataggancaccgtggtactctacgaccaaaacgttcggttacccgacccccggttcgggggacccccggggtaaaacccgttcgggtacccgtaacccggttcctcccgtaccgaaccggcccctaacccgaacccgaaaccgggggaccccctaacggtttccccgggttccctttccccccgtccgggg

SEQ ID NO: 325944 - DNA, 557 bp, Homo sapiens
  misc_feature: GZ8MTXP02FTNAS.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatggggttgcacttattattgggatgacggttaccgctacagtccatctctgaggaggagactcaccatccaccaaggacaacccccaaaaacaggtggtccttacaatgaccaccatggaccctgtggacacagccacatatttctgtgcacactctatagagcacctgtagtctgccaaaactggttaccgaccccgtgggggaccccgggaaccctggtccaccgtctccctcacgccctccgaccgaacgggcccagtccggtccttccccgtcgg

SEQ ID NO: 325945 - DNA, 638 bp, Homo sapiens
  misc_feature: GZ8MTXP02G36JR.22.38.D05.1.454.CMB.2.raw
  modified_base (429)..(429): a, c, t, g, unknown or other
  misc_feature (429)..(429): n is a, c, g, or t
  modified_base (432)..(432): a, c, t, g, unknown or other
  misc_feature (432)..(432): n is a, c, g, or t
  modified_base (448)..(448): a, c, t, g, unknown or other
  misc_feature (448)..(448): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagccccccaggaaaggccctggaatggggttgcacttatttattgggatgacggttaccgctacagtccatctctgaggaggagactcacatccaccaaggaccaacccccaaaaacaggtaggtccttaacaatcgaccaccatcggaccctgtgacacagccacatatttcngtncacactctatagggancaaccgtggtaacgtctaggacccaaaacttcgggtttccgaacccccgttgggggaccccccgggtaaaaccccgtggggttacccaacccggttcctttacccccgtaccgtacgtcccctaacccgaaacccggaaaccggggtccccctaacggttccccggttccccgtttaccccccggtcggg

SEQ ID NO: 325946 - DNA, 664 bp, Homo sapiens
  misc_feature: GZ8MTXP02GRI8C.22.38.D05.1.454.CMB.2.raw
  modified_base (320)..(320): a, c, t, g, unknown or other
  misc_feature (320)..(320): n is a, c, g, or t
  modified_base (339)..(339): a, c, t, g, unknown or other
  misc_feature (339)..(339): n is a, c, g, or t
  modified_base (418)..(418): a, c, t, g, unknown or other
  misc_feature (418)..(418): n is a, c, g, or t
  modified_base (424)..(424): a, c, t, g, unknown or other
  misc_feature (424)..(424): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgccccaggaacggcccgtggaatgggttgtaacttatttagttgggatgacggttacgctacngtccatctctgaggagganactcaccatcaacccaacggaccaacccccaaaacacggtacgtccttacaatcgaccaccatcgaccctgtagacacngaccanatattctagtcgacactactctaagtacggacgtaccaccgtgggttaacgtccgtacgacccgtaaaacggttcgggttacccggaacccccgggttcggggggaccccccgggtaaaaccgttcggggttacccgtaaacccggttcctcccgttaccaaccgccccttacccggaacccgtaaccggggccccctaagttccccggggtttccctttccccccggtcggtcccccgg

SEQ ID NO: 325947 - DNA, 600 bp, Homo sapiens
  misc_feature: GZ8MTXP02JS1SF.22.38.D05.1.454.CMB.2.raw
  modified_base (369)..(369): a, c, t, g, unknown or other
  misc_feature (369)..(369): n is a, c, g, or t
  modified_base (411)..(411): a, c, t, g, unknown or other
  misc_feature (411)..(411): n is a, c, g, or t
  modified_base (438)..(438): a, c, t, g, unknown or other
  misc_feature (438)..(438): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgccccaggaaacggccctggaatgggttgctacttatttagtgggatgtacggttaccgctacacgtccatctctgaggaggagactcacatccacagacaaccccaaaacngtcgtcctacaatcgaccacatacgccctgtgacacagccanattattctgtcgcacactctataggancacgtggtatctacgaccaaacgttcggttaccgaaccccggtcgggggaccccggtaacccgtcgggtacctacccgttccgtcccgttaccgaccgtacccctaacccgaacccgaaccggggtcccctaacgtcccggttccccgttcccccgtccggg

SEQ ID NO: 325948 - DNA, 562 bp, Homo sapiens
  misc_feature: GZ8MTXP02GOIO6.22.38.D05.1.454.CMB.2.raw
  modified_base (435)..(435): a, c, t, g, unknown or other
  misc_feature (435)..(435): n is a, c, g, or t
  modified_base (466)..(466): a, c, t, g, unknown or other
  misc_feature (466)..(466): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggtgcacttattattgggatgacggttaccgctacagtccatctctgaggaggagactcaccatcccaccaaggaccaacccccaaaaaccacggtacggtccttaacaaactcgaccaccatcgggaccctgtcggacacagccacatatttcngtgcacactctataggagcaccgtgtagtcngaccaaactggttccgaccccgtggggccccggaacctggtccaccggtctcctcacgccctccgaccacgggcccagtccggtcttcccccgtgg

SEQ ID NO: 325949 - DNA, 605 bp, Homo sapiens
  misc_feature: GZ8MTXP02G4BJQ.22.38.D05.1.454.CMB.2.raw
  modified_base (423)..(423): a, c, t, g, unknown or other
  misc_feature (423)..(423): n is a, c, g, or t
  modified_base (426)..(426): a, c, t, g, unknown or other
  misc_feature (426)..(426): n is a, c, g, or t
  modified_base (444)..(444): a, c, t, g, unknown or other
  misc_feature (444)..(444): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagccccaggaaggcctggaatgggtgctacttattatggatgacgtacgctacagtccatctctgaggagagactcacataccacaacgaccaacccccaaaacacggtacggtccttaacaatcgaccaccagtcggaccctgtcggacacacgccactattattcngtncacactctaagtacggancaccgtggtaacgtctcggaaccctaaacgttccgggttacccgaaccccggttcgggggacccccgggtaaccgtcgggtaccacccggttccttccgacctacggccccaacccgaaccgaaccgggtcccacgttcccggtcccttcccccgtccggg

SEQ ID NO: 325950 - DNA, 612 bp, Homo sapiens
  misc_feature: GZ8MTXP02FRXW1.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgcccccgaggaaacggccctggaatgggttgctactttattagttgggatggacggttaccgctacagtccatctctgaggaggagactcacatcccaccgaacgaccaaacccccaaaacacggtacggtccttaacaactcgacccaccagtcgaccctgtacgacacacgccactatatttcagtgacacacttcaagtaggagccaccgtggtactctacgacctaaacgtcggttaccgaccccggtcgggggacccccggtaaccgtcgggtaccaccggttcctaccctcgacgtcccctaacccgaacccgaacgggccccacgttcccggtccctttccccgccgg

SEQ ID NO: 325951 - DNA, 598 bp, Homo sapiens
  misc_feature: GZ8MTXP02F1Y8Q.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggttgcacttatttattggatgacggttaccgctacagtccatctctgaggaggagactcaccatccaccaacggacaacccccaaaaaccaggtacgtccttaacaatagaccaccatcggaccctgtcggacacacgccacactatttcagtgacacactctataggagcaaccgtgtacgtctagcctaaaacgtcggttaccgaccccggttcgggggaccccggtaacccgtcggtacccacccggttctccctccgacgccctcccgaaccgtaaacggggccccacgttcccgggtccttcccccgtcggg

SEQ ID NO: 325952 - DNA, 610 bp, Homo sapiens
  misc_feature: GZ8MTXP02HP44A.22.38.D05.1.454.CMB.2.raw
  modified_base (424)..(424): a, c, t, g, unknown or other
  misc_feature (424)..(424): n is a, c, g, or t
  modified_base (434)..(434): a, c, t, g, unknown or other
  misc_feature (434)..(434): n is a, c, g, or t
  modified_base (442)..(442): a, c, t, g, unknown or other
  misc_feature (442)..(442): n is a, c, g, or t
tcagacatacgcgtcacgaccggtgctcgatttagtatctgatagttgggtttggggagtgactcctgtgccccaccatggacacacgttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttcgtcagccccaggaaggccctggaatgggtgcacttattatggatgacggttaccgctacagtccatctctgaggagagactcaccatccaccaagaccaaccccaaaaaccacggtacggtccttaacaaatcgaccaccatacggaccctgtcggacacagccacatattcngtgcacactntataggancacctggtagtctcggacctaaaacgttcggttaccgtacccccggtcgggggacccccggggtaaaccccttcggggtaccaccccgttccgtccccgtccgaacgtcccctaacccgaacccgaaacggggcccccaagtccccggtccctttccccccgtccggg

SEQ ID NO: 325953 - DNA, 759 bp, Homo sapiens
  misc_feature: GZ8MTXP02I8YS6.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagccccaggaaaggccctggaatgggttgcacttattattgggatggacggttaccgctacagtccatctctggaggaggagactcacatccaccaacgaccaaacccccaaaaaccgacggtacggtccttaacaactacgaacccaccaacgtcggaaccctgtacggaaccaacacgacccaactaactttactttcctgttacgaccaactaaccttacctaaagttaacggggaacgtaccctaacccggtttagggttaacgttccgtacggtaccccgttaaaaaccggttccggggtttaaccccggtaaaccccccggggttccggggggaaccccccgggggttaaaaccccggttccggggttacccgtaaacccccgggttccttcccccgtaccgtaacccggtcccccttaaccccgaaacccggaaaacccgggggtccccctaaacggtttcccccggggttccccttttacccccccggtcccgggg

SEQ ID NO: 325954 - DNA, 584 bp, Homo sapiens
  misc_feature: GZ8MTXP02HFBIR.22.38.D05.1.454.CMB.2.raw
  modified_base (397)..(397): a, c, t, g, unknown or other
  misc_feature (397)..(397): n is a, c, g, or t
  modified_base (420)..(420): a, c, t, g, unknown or other
  misc_feature (420)..(420): n is a, c, g, or t
  modified_base (448)..(448): a, c, t, g, unknown or other
  misc_feature (448)..(448): n is a, c, g, or t
  modified_base (533)..(533): a, c, t, g, unknown or other
  misc_feature (533)..(533): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggttgcacttatttattgggatggacggttaccgctacagtccatctctgaggaggagactcaccatccaccaaggaccaacccccaaaacaggtcgtccttacaatcgaccaccancgaccctgtggaccacagcccanattattctagtgacacactctataggancacctggtactcgtgccaaacgttcggttaccgaccccgttcgggggaccccggaacccgtcgggtcctaccggtcctccgtccncgaccctaacccgaccgaacgggccccacgtcccggtccttcccccgtcgg

SEQ ID NO: 325955 - DNA, 646 bp, Homo sapiens
  misc_feature: GZ8MTXP02INRNP.22.38.D05.1.454.CMB.2.raw
  modified_base (396)..(396): a, c, t, g, unknown or other
  misc_feature (396)..(396): n is a, c, g, or t
  modified_base (424)..(424): a, c, t, g, unknown or other
  misc_feature (424)..(424): n is a, c, g, or t
  modified_base (443)..(443): a, c, t, g, unknown or other
  misc_feature (443)..(443): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggtgcacttattattgggatgacggttaccgctacagtccatctctgaggaggagactcacatccaccaaggaccaacccccaaaaacacggtagtccttacaaatcgaccaccancgaccctgtgacacagaccacatattcngtgcacactctagtaaggngcaccttgggtatctacggaccctaaacgtcgggtttacccgaacccccggttcggggggaccccccgggtaaaacccgttcgggggtccctaaaccccgggttcccttaccccgttacccgtacggacccccttccccgaaaccccgaaccgggggacccccaaggttcccccggttcccgttttacccccccgtcccgggg

SEQ ID NO: 325956 - DNA, 625 bp, Homo sapiens
  misc_feature: GZ8MTXP02I8P6G.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtagaaacccacacagaccctcacgctgacctgcaccttctctgggttctcactcaactctagtggagtgggtgtgggctggttccgtcagccccaggaaacggccctggaatgggtgctactttattagttgggatggtacggttaccgctacagtccatctcgtgaggaggagactcacataccaccgaacggaccgaacccccaaaaacgacggtacggtccttaacaactcgacccaccatcggaccctgtcggaacacacgacccactattactttctgtcgacacacttactagtagggacacctacgttggtaacgtcgtacgacctaaacgttcgggttacccgaccccggtcgggggtaccccggacccgttcgggtacccaccggttcctccctacgaccgtcccaaccgacccgacgggcccacgttccggtcccttccccgtccgg

SEQ ID NO: 325957 - DNA, 567 bp, Homo sapiens
  misc_feature: GZ8MTXP02JDXQ0.22.38.D05.1.454.CMB.2.raw
  modified_base (424)..(424): a, c, t, g, unknown or other
  misc_feature (424)..(424): n is a, c, g, or t
  modified_base (430)..(430): a, c, t, g, unknown or other
  misc_feature (430)..(430): n is a, c, g, or t
tcagacatacgcgtcacgaccggtgctcgatttagtatctgatagttgggtttggggagtgactcccgtgccccaccatggacacactttgccccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggcccctggaatgggttgcacttattattgggatgacggttaccgctacagtccatctctgaggagagactcaccatcaccaacggaccaacccccaaaaaccaggtcgtaccttacatgaccaccatcgacctgtggacacagccacatatttcngtgcanactctataggagcaaccgtggtagtctgaccaaaactcgggttccaccccgttgggggccccggaaccctggtccaccggtctcctcacgccctccaccgaacgggcccagtccggtcctcccccgtggccctcccg

SEQ ID NO: 325958 - DNA, 576 bp, Homo sapiens
  misc_feature: GZ8MTXP02FQ1CB.22.38.D05.1.454.CMB.2.raw
  modified_base (365)..(365): a, c, t, g, unknown or other
  misc_feature (365)..(365): n is a, c, g, or t
  modified_base (402)..(402): a, c, t, g, unknown or other
  misc_feature (402)..(402): n is a, c, g, or t
  modified_base (410)..(410): a, c, t, g, unknown or other
  misc_feature (410)..(410): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggtgcacttattatgggatgacgttaccgctacagtccatctctgaggaggagactcaccatccaccaagacaccccaaaacagngtcctacaatgaccacatgaccctgtgacacagccanatatttcngtgcacactctaataggagcacctggtaacgtctaggcctaaaacgtcggttaccgaacccccgttgggggacccccggtaaacccgtgggtccaacccggttcctcccttcacgtccctaaccgaacccgaacggggccccagtccggtcctttcccccgtcggg

SEQ ID NO: 325959 - DNA, 565 bp, Homo sapiens
  misc_feature: GZ8MTXP02GKGM6.22.38.D05.1.454.CMB.2.raw
  modified_base (436)..(436): a, c, t, g, unknown or other
  misc_feature (436)..(436): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggttgcacttatttattgggatgacggttaccgctacagtccatctctgaggaggagactcaccatcccaaccaacggacaacccccaaaaacacggtaggtccttaacaatcgaccaccatcggaccctgtcggacacagccacatatttctgtncacactctataggagcacctggtagtctgaccaaacgtggttccgaccccgtgggggaccccggaacctggtccaccgtctccctcacgcctccgaccgaacgggcccagtccggtccttccccgtcgg

SEQ ID NO: 325960 - DNA, 590 bp, Homo sapiens
  misc_feature: GZ8MTXP02ITAEV.22.38.D05.1.454.CMB.2.raw
  modified_base (334)..(334): a, c, t, g, unknown or other
  misc_feature (334)..(334): n is a, c, g, or t
  modified_base (447)..(447): a, c, t, g, unknown or other
  misc_feature (447)..(447): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggttgcacttatttatgggatgacggttacgctacagtccatctctgaggaggngactcaccatccaccaaggaccaacccccaaaacaggtcggtccttacaatcgaccaccatcggaccctgtcgacacagccacatatttcagtgcacactctaatacgggacnctaccgtggtacgtctacgaccaacgttcggttacccgaccccggtcgggggacccggacccgtcggtacctaccgtcctacctccgaccgccctaacccgaaccgaaccggccctacgtccccggttcccttcccccgtcgg

SEQ ID NO: 325961 - DNA, 608 bp, Homo sapiens
  misc_feature: GZ8MTXP02GJKU1.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggtgcacttattatggatgacggttaccgctacagtccatctctgaggaggagactcaccatcccaaccaaacggaccaaacccccaaaaaccacggtacggtccttaacaaatcgacccaaccatcgggaccctgtcgacacacgccacatatttctgtgacacactctaataggagcaccgtgtacgtcacgacccaaacgtcgggttacccgaccccgttcgggggacccccgggtaaacccgtgggtaccccaccggtcctcccgtaccgaccgccctaaccgacccgaaacgggcccccagtcccggtcccttcccccgtcgg

SEQ ID NO: 325962 - DNA, 641 bp, Homo sapiens
  misc_feature: GZ8MTXP02I5VSD.22.38.D05.1.454.CMB.2.raw
  modified_base (416)..(416): a, c, t, g, unknown or other
  misc_feature (416)..(416): n is a, c, g, or t
  modified_base (445)..(445): a, c, t, g, unknown or other
  misc_feature (445)..(445): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggttgcacttattattgggatgacggttaccgctacagtccatctctgaggaggagactcaccatccaccaacggaccaacccccaaaacacggtcgtccttacaatgaccacatcggaccctgtgacacagccanattattctagtcgacacactctataggancaccgtggtacgtctcgacctaaacgtcggttacccgaccccggttcgggggacccccggggtaaacccgttcgggtacccgtaacccggttcccttccccgtacccgtaccggtccccgttaacccccgaaacccggaaaccgggggtccccctaacgttccccgggtttcccctttccccccccggtccggggg

SEQ ID NO: 325963 - DNA, 586 bp, Homo sapiens
  misc_feature: GZ8MTXP02I6HCU.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggtgcacttatttatggatgacggttaccgctacagtccatctctgaggagagactcacatccaccaacgaccaacccccaaaacaggtcgtccttacaaatcgaccaccatcggaccctgtggaacacacgccaactatatttctagtgccactactctataggcacacctggtacgtctgaccctaaacgttcggttaccgaccccgttcgggggacccccggaacccgtgggtacccaccggtctaccctccgacgccctaacccgaccgaacggccccacgtccggtaccttcccccgtcgg

SEQ ID NO: 325964 - DNA, 555 bp, Homo sapiens
  misc_feature: GZ8MTXP02G8JPY.22.38.D05.1.454.CMB.2.raw
  modified_base (203)..(203): a, c, t, g, unknown or other
  misc_feature (203)..(203): n is a, c, g, or t
tcagacatacgcgtcacgaccggtgctcgatttagtatctgatagttgggtttgggggaggaactgctcagttaggacccagagggaaccatggaagccccagctcagcttctcttcctcctgctactctggctcccagataccaccggagaaattgtgttgacacagtctccagccaccctgtctttgtctccgggggaaanagccaccctctcctgcagggccagtcagaatgttagtagttacttagcctggtaccagcaaagcctggccaggctcccagactcctcatctctgatacatccaacagggccacgtggcactcccagccaggttcagtggcagtcgggtctgggacagacttcactctcaccatcagcgacctagacgtcctagaatatttgactagtttattactgtcagtcagcgtagctatctcggtccctccgtactaccgtttcggccgtacgggggaccaagtccgtaggacgataccgaaaacgtaacgtgacggtctacgaaccaccgtacttcgtcgtcctttacactttcccc

SEQ ID NO: 325965 - DNA, 533 bp, Homo sapiens
  misc_feature: GZ8MTXP02HC5H1.22.38.D05.1.454.CMB.2.raw
  modified_base (204)..(204): a, c, t, g, unknown or other
  misc_feature (204)..(204): n is a, c, g, or t
  modified_base (354)..(354): a, c, t, g, unknown or other
  misc_feature (354)..(354): n is a, c, g, or t
  modified_base (399)..(399): a, c, t, g, unknown or other
  misc_feature (399)..(399): n is a, c, g, or t
  modified_base (519)..(519): a, c, t, g, unknown or other
  misc_feature (519)..(519): n is a, c, g, or t
tcagacatacgcgtcacgaccggtgctcgatttagtatctgatagttgggtttgggggaggaactgctcagttaggacccagagggaaccatggaagccccagctcagcttctcttcctcctgctactctggctcccagataccaccggagaaattgtgttgacacagtctccagccaccctgtctttgtcgtccgggggaaanagccaccctctcctgcagggccagtcagaatgttagtagttacttagcctggtaccagcaaagcctggccaggctcccagactcctcatctctgatacatccaaacagggccactggcactcccagccaggttcagtggcagtcgggtcngggacagacttcactctcacatcagcgacctagagcctagaagtntttgacttagtttattactgtcagcagcgtagctatcgtcggacctccgtactaccgttggccgagggaccagcgtaggacgtatacgaaacgtaactggtacgctagcctacactcgtntcttctacttcccg

SEQ ID NO: 325966 - DNA, 576 bp, Homo sapiens
  misc_feature: GZ8MTXP02JR916.22.38.D05.1.454.CMB.2.raw
  modified_base (363)..(363): a, c, t, g, unknown or other
  misc_feature (363)..(363): n is a, c, g, or t
  modified_base (419)..(419): a, c, t, g, unknown or other
  misc_feature (419)..(419): n is a, c, g, or t
tcagacatacgcgtcacgaccggtgctcgatttagtatctgatagttgggtttgggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggttgaacttatttatgggatgacggttacgctacagtccatctctgaggagagactcacatcacccagaccaaccccaaaacnggtcgtcttacaatcgaccacatcggaccctgtcgacacacgccacattactttcngtcgcacacttcagtacggatcaccgtgggtatctgacctaaacgtcggttacccgaccccgtgggggccccggtaacccgtggtcctacccggtctcccgtcaccgccctaccaacccgacgggcccacgtccggtccctttccccgcgggccccg

SEQ ID NO: 325967 - DNA, 574 bp, Homo sapiens
  misc_feature: GZ8MTXP02HBK62.22.38.D05.1.454.CMB.2.raw
  modified_base (429)..(429): a, c, t, g, unknown or other
  misc_feature (429)..(429): n is a, c, g, or t
  modified_base (432)..(432): a, c, t, g, unknown or other
  misc_feature (432)..(432): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggtgcacttattattggatgacggttacgctacagtccatctctgaggaggagactcaccatcccaccaaggaccaacccccaaaaacacggtacggtcccttacaactcgaccaccatcgggaccctgtgacacagccacatatttcngtncacactctataggagcaaccgtggtacgtctcgaccaaacgttcggtaccgaccccgtcgggggaccccgggaacccgtggtccaccgtcctccgtcacgcctaaccgaccgaacgggccctagtccggtccttccccgcgg

SEQ ID NO: 325968 - DNA, 555 bp, Homo sapiens
  misc_feature: GZ8MTXP02H5QEN.22.38.D05.1.454.CMB.2.raw
  modified_base (337)..(337): a, c, t, g, unknown or other
  misc_feature (337)..(337): n is a, c, g, or t
  modified_base (386)..(386): a, c, t, g, unknown or other
  misc_feature (386)..(386): n is a, c, g, or t
  modified_base (432)..(432): a, c, t, g, unknown or other
  misc_feature (432)..(432): n is a, c, g, or t
  modified_base (444)..(444): a, c, t, g, unknown or other
  misc_feature (444)..(444): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggttgcacttatttattggggatgacggttaccgctacagtccatctctgaggaganactcacatccacaagacaaccccaaaacagtgtctacaatcgaccacangaccctgtggacacagccacattattctgtgcacactctataggancactggtactcngccaaacgtcggttacgaccccgtcgggggaccccggacccgttggtcccaccggtccttccctcgacgccctaaccaccgacggccctacgtccgtcctttccccgccgg

SEQ ID NO: 325969 - DNA, 589 bp, Homo sapiens
  misc_feature: GZ8MTXP02I3SBL.22.38.D05.1.454.CMB.2.raw
  modified_base (422)..(422): a, c, t, g, unknown or other
  misc_feature (422)..(422): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggtccgtcagcccccaggaaaggccctggaatgggtgcacttatttattgggatgacggttaccgctacagtccatctctgaggaggagactcacatccaccaagacaacccccaaaacacggtcgtccttacaatcgaccaccatcggaccctgtggacacagccacatatttcngtcgcacactctagtaggagcaccgtggtacgtcgtcggacctaaaacgttcggtttaccgaacccccggttgggggacccccgggtaacccgttcgggtaccacccggttcctcccgtcacgccctcccaccgaacggccccacgtcccggtccttcccccgtcgg

SEQ ID NO: 325970 - DNA, 565 bp, Homo sapiens
  misc_feature: GZ8MTXP02GWBZH.22.38.D05.1.454.CMB.2.raw
  modified_base (421)..(421): a, c, t, g, unknown or other
  misc_feature (421)..(421): n is a, c, g, or t
  modified_base (429)..(429): a, c, t, g, unknown or other
  misc_feature (429)..(429): n is a, c, g, or t
  modified_base (448)..(448): a, c, t, g, unknown or other
  misc_feature (448)..(448): n is a, c, g, or t
tcagacatacgcgtcacgaccggtgctcgatttagtatctgatagttgggtttggggagtgactcctgtgccccaccatggacacactttgctccacgctcctgctgactgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatggggttgcacttatttattggggatgacggttaccgctacagtccatctctgtaggaggagactcaccatccaccaaggacaacccccaaaacaggtacggtccttacaatcgaccaccatggaccctgtgacacagccanatatttcngtgcacactctaataggancaccgtgtagtctgaccaaactcggttaccgccccgtgggggccccgggaaccctggtccaccggtctccctcacgccctccgaccaacgggcccagtccggtcctttcccccgcgg

SEQ ID NO: 325971 - DNA, 592 bp, Homo sapiens
  misc_feature: GZ8MTXP02JUWFZ.22.38.D05.1.454.CMB.2.raw
  modified_base (424)..(424): a, c, t, g, unknown or other
  misc_feature (424)..(424): n is a, c, g, or t
  modified_base (432)..(432): a, c, t, g, unknown or other
  misc_feature (432)..(432): n is a, c, g, or t
  modified_base (451)..(451): a, c, t, g, unknown or other
  misc_feature (451)..(451): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggcttgttccgtcagcccccaggaaaggccctggaatgggttgcacttatttattgggatgacggttaccgctacagtccatctctgaggaggagactcaccatccaccaaggaccaacccccaaaaccaggtcggtccttaacaatcgaccaccactcggaccctgtcggacacagcccanatatttcngtcgcacactctataggancaccgtggtacgtcagccaaactgggttaccgaccccgtcgggggacccccgggtaaccctggtaccgacccggtctcccgtccgacgccctcccgaaccgaacggggcccccaggtcccggttcccttccccccggcccg

SEQ ID NO: 325972 - DNA, 535 bp, Homo sapiens
  misc_feature: GZ8MTXP02GGTP0.22.38.D05.1.454.CMB.2.raw
  modified_base (522)..(522): a, c, t, g, unknown or other
  misc_feature (522)..(522): n is a, c, g, or t
tcagacatacgcgtcacgaccggtgctcgatttagtatctgatagttgggtttgggggaggaactgctcagttaggacccagagggaaccatggaagccccagctcagcttctcttcctcctgctactctggctcccagataccaccggagaaattgtgttgacacagtctccagccaccctgtctttgtctccgggggaaagagccaccctctcctgcagggccagtcagaatgttagtagttacttagcctggtaccagcaaaagcctggccaggctcccagactcctcatctctgatacatccaaacagggccactggcactcccagccaggttcagtggcaggtgggtctggggacagtacttcactctcacatcagcgacctagacgcctagaatatttgctagtttattactgtcagcagcgtagctatctgtccctccgtactaccgtttcggaccgaggggacccaagcgtaggagagtacgaaaacgaactgtcggactcgaacaccagtctntactcactttccc

SEQ ID NO: 325973 - DNA, 569 bp, Homo sapiens
  misc_feature: GZ8MTXP02I2QRL.22.38.D05.1.454.CMB.2.raw
tcagacatacgcgtcacgaccggtgctcgatttagtatctgatagttgggtttgggggaggaactgctcagttaggacccagagggaaccatggaagccccagctcagcttctcttcctcctgctactctggctcccagataccaccggagaaattgtgttgacacagtctccagccaccctgtctttgtctccgggggaaagagccaccctctcctgcagggccagtcagaatgttagtagttacttagcctggtaccagcaaaagcctggccaggctcccagactcctcatctctgatacatccaacaggccactggcactcccagccaggttcagtgcagtggtctgggacagactcactctcacatcagcgactagagcctagacgtatttgctagtttattactgtcagcagcgtagctatctcgggtcctccgtactaccgtttcggaccgtacgggggaccaaaggccgttacggagtaacgtaccgtaaaacggtaaaccttggtacgggtcttacggaaccgtacccgtaacttcgttacgttcctttacactttccccg

SEQ ID NO: 325974 - DNA, 569 bp, Homo sapiens
  misc_feature: GZ8MTXP02ITS0K.22.38.D05.1.454.CMB.2.raw
  modified_base (203)..(203): a, c, t, g, unknown or other
  misc_feature (203)..(203): n is a, c, g, or t
  modified_base (401)..(401): a, c, t, g, unknown or other
  misc_feature (401)..(401): n is a, c, g, or t
tcagacatacgcgtcacgaccggtgctcgatttagtatctgatagttgggtttgggggaggaactgctcagttaggacccagagggaaccatggaagccccagctcagcttctcttcctcctgctactctggctcccagataccaccggagaaattgtgttgacacagtctccagccaccctgtctttgtctccgggggaaanagccaccctctcctgcagggccagtcagatgttagtagttacttagctggtaccagacaaagcctggccaggcctccagacctcctcatctctgatacataccaacgagggccacgtggcactcccagccaggttcagtggctaggtcggtctgggacagtacttcactctcaccatcagcactagacgctagaagtntttgacttagttttacttacgttgttacgagcgaggtcgttagactagttccgtcggtccccttaccgtacctaccgtttcgggaccgacggggtaaccaagcgtagggagtactaacgaaaacgtacgtggtcggctgaacctacacttctgtccttactacttccc

SEQ ID NO: 325975 - DNA, 642 bp, Homo sapiens
  misc_feature: GZ8MTXP02G0O2X.22.38.D05.1.454.CMB.2.raw
  modified_base (427)..(427): a, c, t, g, unknown or other
  misc_feature (427)..(427): n is a, c, g, or t
  modified_base (430)..(430): a, c, t, g, unknown or other
  misc_feature (430)..(430): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagccccaggaaaggccctggaatgggtgcacttattatgggatgacggttaccgctacagtccatctctgaggagagactcacatccaccaaagaccaacccccaaaacaggtagtccttaacaatacgaccaccatacggaccctgtcgaacacagcccaactatactttngtnacactactctaataggagcaaccgtggtaacgtctacggaccaaaacgttcgggttacccgaacccccggtcgggggtaacccccgggtaaaccccgttgggtacccctaacccggttcctccccgtccaaaccgtcccccgtaacccgaaaccccgaaaaccgggggtcccccaaggttcccccgggttccctttacccccccgtccgggg

SEQ ID NO: 325976 - DNA, 521 bp, Homo sapiens
  misc_feature: GZ8MTXP02IA5Q0.22.38.D05.1.454.CMB.2.raw
  modified_base (340)..(341): a, c, t, g, unknown or other
  misc_feature (340)..(341): n is a, c, g, or t
  modified_base (503)..(503): a, c, t, g, unknown or other
  misc_feature (503)..(503): n is a, c, g, or t
  modified_base (516)..(516): a, c, t, g, unknown or other
  misc_feature (516)..(516): n is a, c, g, or t
tcagacatacgcgtcacgaccggtgctcgatttagtatctgatagttgggtttgggggaggaactgctcagttaggacccagagggaaccatggaagccccagctcagcttctcttcctcctgctactctggctcccagataccaccggagaaattgtgttgacacagtctccagccaccctgtctttgtcgtccggggaaagagccaccctctcctgcagggccagtcagaatgttagtagttactagctgtacagcaaaagctggccaggctccagactcctcatctctgatacatacccaaacagggccactggcactccccagccaggtcagtggnngtggcgtggggacagacttcactctcacatcagcgactagacgccagaagtattttgcttagtttattactgtcagcagcgtaagctagtctggccctcgtaccacgtttggccgaggggaccaaggctaggagatacgaaacgaactgcgtctagcaaccnctctcgtcttacnctccg

SEQ ID NO: 325977 - DNA, 579 bp, Homo sapiens
  misc_feature: GZ8MTXP02JVEZH.22.38.D05.1.454.CMB.2.raw
  modified_base (443)..(443): a, c, t, g, unknown or other
  misc_feature (443)..(443): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaacggccctggaatgggtgcacttatttattgggatgacggttaccgctacagtccatctctgaggaggagactcaccatcccaccaaggaccaacccccaaaacaggtcgtcctaacaatcgaccacactcggaccctgtcggacacacgccacatattctgtcgcacactctaanaggagcaccgttggtacgtctagaccaaacgttcggttaccgaccccggtcggggacccccggaaccgtcggtacccgaccgtctcctcaccgccgtaacccaccgaacgggcccagtccggtccttccccgtcgg

SEQ ID NO: 325978 - DNA, 625 bp, Homo sapiens
  misc_feature: GZ8MTXP02IC2ZH.22.38.D05.1.454.CMB.2.raw
  modified_base (424)..(424): a, c, t, g, unknown or other
  misc_feature (424)..(424): n is a, c, g, or t
  modified_base (445)..(445): a, c, t, g, unknown or other
  misc_feature (445)..(445): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagccccaggaaggccctggaatgggtgcacttattattggatgacggttaccgctacagtcatctctgaggaggagactcacatcccaaccaacggaccaacccccaaaacacggtcgtccttacaactcgaccaccatcgaccctgtgacacagccaactatatttcngtgcacactcgtaagtagganctaaccgttggtacgtctacgacctaaaacgttcgggttacccgacccccggttcgggggacccccgggtaacccgttcggggtaccctaccccgggttccttccccgtcgtaaccggcccctaacccgaacccgaacggggtcccccaacgtttcccgggtcccctttcccccggcggg

SEQ ID NO: 325979 - DNA, 678 bp, Homo sapiens
  misc_feature: GZ8MTXP02JGTMC.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaacggccctggaatgggtgcacttattatgggatgacggttacgctacagtccatctctgaggaggagactcaccatcccaccaacggaccaaacccccaaaacgagtacggtccttaacaatcgaccaccagtacgaccctgtacggacacacgacccaacattactttactgtcgacactacctctaaagtagggactccaccgttgggtaactccgtacggacccaaaacgttcgggttaccccgacccccggtcgggggtacccccgggtaaacccgttcgggtaccccgtaacccggttcccttacccgtacccgaaccggtacccccttaaccccgaaaccccggtaaaacccgggggccccctaacggtttccccggtttcccccgttacccccgttcccggggg

SEQ ID NO: 325980 - DNA, 680 bp, Homo sapiens
  misc_feature: GZ8MTXP02JTQV2.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgccccaggaaacggccctggaagtgggttgctacttatttagttgggatggacggttaccgctacagtccatctctgaggagagactcacatccaccaagaccaacccccaaaacacggtcgtccttacaatcgaccacatcgaccctgtcgacacacgccactattacttctgtgacacactcttaagtagggacgctacccggtaggtacgttactacgtacccgtaaacgttcgggtttacccgaccccccggtacgggggtaccccccggggtaaaccccgttcggggtacccgtacccccggttccttacccccgtaccgtaacccgcccccgttaaccccgaaacccccggtaaccgggggaccccccttaacggtttacccccggggtttccccctttacccccccggtcccgggg

SEQ ID NO: 325981 - DNA, 695 bp, Homo sapiens
  misc_feature: GZ8MTXP02FNPOU.22.38.D05.1.454.CMB.2.raw
  modified_base (255)..(255): a, c, t, g, unknown or other
  misc_feature (255)..(255): n is a, c, g, or t
  modified_base (307)..(307): a, c, t, g, unknown or other
  misc_feature (307)..(307): n is a, c, g, or t
  modified_base (660)..(660): a, c, t, g, unknown or other
  misc_feature (660)..(660): n is a, c, g, or t
  modified_base (674)..(674): a, c, t, g, unknown or other
  misc_feature (674)..(674): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtagaaacccacacagaccctcacgctgacctgcaccttctctgggttctcactcaactctagtggagtgggtgtggctggttccgtnacgccccaggaaagccctggaatgggtgctacttattagtggatgacgtacnctacagtccatctcgtagaggaggagactcaaccataccccaaaccgaaacggaaccctaaaacccccccgaaaaaacgtacgggttaccgggttacccttaaacaaaacgttacggaaacccccaaacccgtaacgtaccgggtaaacccccgttggtaacgggaacccaacaacggacccttaacctaagttaaacttttcctaggttactaccaacttaacccttacggttaaagtaacgggacgtaccctaaacggtttcgtaaacggttctacgaacccgtaaacgttcggtacccgtacccggcgggggaccccgtaaccgtgtaccctaccgtctccacgactccnccgacgaacggccngttccggtcctttcccgccgg

SEQ ID NO: 325982 - DNA, 585 bp, Homo sapiens
  misc_feature: GZ8MTXP02F2SOW.22.38.D05.1.454.CMB.2.raw
  modified_base (411)..(411): a, c, t, g, unknown or other
  misc_feature (411)..(411): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggcccctggaatgggtgcacttattattgggatgacggttaccgctacagtccatctctgaggaggagactcaccatccaccaagacaacccccaaaacagtggtccttacaatgaccacatggaccctgtgacacacgccanatactttctgtgcacactcaataggagccacctggtacgtctggaccctaaaacgtcgggttaccgacccccgtgggggacccccggtaaccctgggtaccacccggttcctcccgtacgcgcccctccgaaccgaaacgggccccacgttcccggtccctttcccccgtcggg

SEQ ID NO: 325983 - DNA, 599 bp, Homo sapiens
  misc_feature: GZ8MTXP02H2RKI.22.38.D05.1.454.CMB.2.raw
  modified_base (314)..(314): a, c, t, g, unknown or other
  misc_feature (314)..(314): n is a, c, g, or t
  modified_base (454)..(454): a, c, t, g, unknown or other
  misc_feature (454)..(454): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggtgcacttatttattgggatggacggttaccgntacagtccatctctgaggagagactcaccatccaccaacggaccaacccccaaaacaggtcgtccttacaatcgaccaccatcggaccctgtgacacagacccactaattactttctgtcgacactactctaatacggancaccgtggtagtcacgacctaaacgttcgggttaccgacccccggttcgggggaccccggtaacccgtgggtcccaccggttcctccctccgacgcccctaaccgacccgtaacggcccctagtcccggttccttcccccgtcgg

SEQ ID NO: 325984 - DNA, 570 bp, Homo sapiens
  misc_feature: GZ8MTXP02JANJB.22.38.D05.1.454.CMB.2.raw
  modified_base (418)..(418): a, c, t, g, unknown or other
  misc_feature (418)..(418): n is a, c, g, or t
  modified_base (526)..(526): a, c, t, g, unknown or other
  misc_feature (526)..(526): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagccccccaggaaaggccctggaatgggttgcacttatttattgggatgacggttacgctacagtccatctctgaggaggagactcaccatccaccaaggacaacccccaaaacaggtacgtccttacaatgaccaccatcggaccctgtggacacagcccanatactttactgtgcacactctataggagcacgtggtacgtctcgccaaaactcggttaccgaccccgttcgggggcccgggaacccgtggtccaccgtcctccgtccncgccctccaccgaacgggcccagtcccggtcttcccccgtccgg

SEQ ID NO: 325985 - DNA, 620 bp, Homo sapiens
  misc_feature: GZ8MTXP02F4Y61.22.38.D05.1.454.CMB.2.raw
  modified_base (371)..(371): a, c, t, g, unknown or other
  misc_feature (371)..(371): n is a, c, g, or t
  modified_base (420)..(420): a, c, t, g, unknown or other
  misc_feature (420)..(420): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagccccccaggaaaggccctggaatggggttgcacttattatgggatgacggttaccgctacagtccatctctgaggaggagactcaccatccaccaaggacaacccccaaaaacnggtgtccttacaatgaccacatgaccctgtgacacagccacatatttcngtgcacactctataggagcaccgtggtaacgtctagaccctaaaactcgggttacccgaacccccggttgggggacccccgggaaacccgttcgggtacccgtaaccccggttccttaccccttccgaaccggtccccctaaccgaaaccccgaaacgggggtccccctaagtcccgggttcccttccccccggttcggg

SEQ ID NO: 325986 - DNA, 610 bp, Homo sapiens
  misc_feature: GZ8MTXP02JVPW3.22.38.D05.1.454.CMB.2.raw
  modified_base (371)..(371): a, c, t, g, unknown or other
  misc_feature (371)..(371): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaggccctggaatgggtgctacttatttattgggatgacggttaccgctacagtccatctctgaggaggagactcaccatcccaccaaggaccaacccccaaaacncggtgtcctacaatcgaccaccatcgaccctgtcgacacgagccaacatactttctagtcgcaactactctaagtaggacgctaccgtgggtactcgtacgaccgtaaacgttcggttacccgacccccgttcgggggacccccgggtaacccgttggtacccacccggttcctcccgtcaccggtccctaaccgacccgaacggggccccacgttcccggtccctttcccccgccggg

SEQ ID NO: 325987 - DNA, 542 bp, Homo sapiens
  misc_feature: GZ8MTXP02I9PZF.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggcccctggaatgggtgcacttatttattgggatgacggttaccgctacagtccatctctgaggaggagactcaccatcccaccaaggaccaacccccaaaaccaggtgtccttacaatgaccaccatgaccctgtggacacagccacatattctgtgcacactctataggagcacctggtagtctgccaaatggtccgaccccgtggggccccggaacccttggccaccggtctcctcagccctcaccaacggcccatccggtctcccctcgg

SEQ ID NO: 325988 - DNA, 536 bp, Homo sapiens
  misc_feature: GZ8MTXP02H7ZWS.22.38.D05.1.454.CMB.2.raw
  modified_base (387)..(387): a, c, t, g, unknown or other
  misc_feature (387)..(387): n is a, c, g, or t
  modified_base (393)..(393): a, c, t, g, unknown or other
  misc_feature (393)..(393): n is a, c, g, or t
tcagacatacgcgtcacgaccggtgctcgatttagtatctgatagttgggtttggggaggaactgctcagttaggacccagagggaaccatggaagccccagctcagcttctcttcctcctgctactctggctcccagataccaccggagaaattgtgttgacacagtctccagccaccctgtctttgtcgtccggggaaagagccacctctcctgcagggccagtcagaatgttagtagttacttagctggtacagcaaagcctggccaggctccagactcctcatctctgataccatacccaaacgagggccacgtggcactcccagctaggtcagtggcaggtggctggacagacttcactctcacatcagcgactagacgccngaagtntttgacttagtttattacgtgtcagcagcgtagctatcgtaggccttccgtactaccgtttcggaccgtacggggacctagcgtaggagatacaaaacgtactacggacgcgtacgccacgtactctgttctactacttcccg

SEQ ID NO: 325989 - DNA, 532 bp, Homo sapiens
  misc_feature: GZ8MTXP02IOQLY.22.38.D05.1.454.CMB.2.raw
  modified_base (287)..(287): a, c, t, g, unknown or other
  misc_feature (287)..(287): n is a, c, g, or t
tcagacatacgcgtcacgaccggtgctcgatttagtatctgatagttgggtttgggggaggaactgctcagttaggacccagagggaaccatggaagccccagctcagcttctcttcctcctgctactctggctcccagataccaccggagaaattgtgttgacacagtctccagccaccctgtctttgtctccggggaaagagccaccctctcctgcagggccagtcagaatgttagtagttacttagcctggtacagcaaagcctggccaggctcccagactccncatctctgatacatccaacagggccaactggcatccccagccaggttcagtggcagtgggtctgggacagacttcactctcacatcagcgacctagagcctagaagtatttgctagtttatactgtcagcagcgtagctatctcggcctccgtactaccgtttggccgaggggaccaagcctagggacactacaaaacgtactggtacgctacgcaaccgtatccgtatccttactactttcccc

SEQ ID NO: 325990 - DNA, 636 bp, Homo sapiens
  misc_feature: GZ8MTXP02GQO9V.22.38.D05.1.454.CMB.2.raw
  modified_base (445)..(445): a, c, t, g, unknown or other
  misc_feature (445)..(445): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggtgcacttattattgggatgacggttacgctacagtccatctctgaggaggagactcaccatcccaccaaggaccaacccccaaaaaccaggtacgtccttacaatcgaccaccatcggaccctgtgacacagccacatatttctgtgcacactctaataggancaccgtggtacgtctagaccctaaacgtcgggttaccccgacccccggtcgggggtacccccgggaaaccccgttcggggtaccctacccgggttacctccccgttaccgaccggtaccccctaacccgaacccgtaaaaccgggggccccctaacgttcccggggttccccctttcccccggtccccggg

SEQ ID NO: 325991 - DNA, 550 bp, Homo sapiens
  misc_feature: GZ8MTXP02IT4SO.22.38.D05.1.454.CMB.2.raw
  modified_base (284)..(284): a, c, t, g, unknown or other
  misc_feature (284)..(284): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggtncacttattatgggatgacggttacgctacagtccatctctgaggagagactcacatccaccaagacacccccaaaacacggtgtccttacaatcgaccaccatggaccctgtcggacacagccacatactttctgtgcacactctataggagcacgtggtagtctgcaaaactcggtaccgacccgtggggccccggaaccgtcggtccaccgtctcctctacgccctcccgaccaacgggcccagtccggtccttcccccgtcgg

SEQ ID NO: 325992 - DNA, 631 bp, Homo sapiens
  misc_feature: GZ8MTXP02IFWMA.22.38.D05.1.454.CMB.2.raw
tcagacatacgcgtcacgaccggtgctcgatttagtatctgatagttgggtttgggggaggaactgctcagttaggacccagagggaaccatggaagccccagctcagcttctcttcctcctgctactctggctcccagataccaccggagaaattgtgttgacacagtctccagccaccctgtctttgtctccgggggaaagagccaccctctcctgcagggccagtcagaatgttagtagttactagcctgtacagcaaagctggcaggctcccagactctcatctctgatacatccaaacacgggccactggcactcccagccaggttcagtgcgagtggtctggggacaggtacttcactctcacagtcagcgactagacgtccagtaaagtactttttaggaccttaagttttaactttaacgttacggtacctaaggtccgaaaggtcggttaacggacttaacgttcgttacgggtccccttcccggtaaccttaccgtttcgggacccgaaggggacccgtaaagccgtacgggagtagtaaccaaaaacggtaaaccgtcggtaggtcctacggaacctaacccgtaattccggttacgtttcctttactaactttcccccg

SEQ ID NO: 325993 - DNA, 604 bp, Homo sapiens
  misc_feature: GZ8MTXP02GAYPC.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggtgcacttattatgggatgacgtaccgctacagtccatctctgaggagagactcacatccacaagacaccccaaaacagtgtcctacaatgaccacatgaccctgtgacacagccacatatttcagtgcacactcaataggagcaaccgtggtaacgtctaggacccaaaacgtcgggtttaccgaacccccgtgggggacccccggggtaaaaccccgttcggggtcccaacccggttcctccccgttaccaaccggtcccctaacccgaacccgaaaacggggtcccccaaagttcccgggtccctttccccccgtccggg

SEQ ID NO: 325994 - DNA, 592 bp, Homo sapiens
  misc_feature: GZ8MTXP02HEQIY.22.38.D05.1.454.CMB.2.raw
  modified_base (272)..(272): a, c, t, g, unknown or other
  misc_feature (272)..(272): n is a, c, g, or t
  modified_base (287)..(287): a, c, t, g, unknown or other
  misc_feature (287)..(287): n is a, c, g, or t
  modified_base (426)..(426): a, c, t, g, unknown or other
  misc_feature (426)..(426): n is a, c, g, or t
  modified_base (454)..(454): a, c, t, g, unknown or other
  misc_feature (454)..(454): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagccccaggaaagcccnggaatggtgaacttnttatggatgacgttaccgctacagtccatctctgaggaggagactcacatacacccaacggaccaacccccaaaaaccgaggtacggttaccttacgaaatacgaaccaccacgtacggaccctgcgacacagcccaanattattctgtcgcacactctagtaggancactggtaacgtctgaccaaacgtcggttacccgaccccggtcgggggaccccggtaaccgtcggtaccaccgtcctccgtaccacgccctaccgaacccgaacgggccccacgtccggtcccttccccgtggccccg

SEQ ID NO: 325995 - DNA, 627 bp, Homo sapiens
  misc_feature: GZ8MTXP02JO1IS.22.38.D05.1.454.CMB.2.raw
  modified_base (312)..(312): a, c, t, g, unknown or other
  misc_feature (312)..(312): n is a, c, g, or t
  modified_base (370)..(370): a, c, t, g, unknown or other
  misc_feature (370)..(370): n is a, c, g, or t
  modified_base (431)..(431): a, c, t, g, unknown or other
  misc_feature (431)..(431): n is a, c, g, or t
  modified_base (617)..(617): a, c, t, g, unknown or other
  misc_feature (617)..(617): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggtgaacttattattgggatgacggtttaccnctacagtccatctctgaggaggagactcaccatcacccaaggaccaacccccaaaacnggtacgtaccttacaatcgaaccaccatcggaccctgtcgacacgacgccacatatttccngtcgcacactactagtaggacgcaccgtgggtatcctcggaccctaaaacgtcggttacccggaacccccgttcgggggacccccggtaaacccgtcgggtcccgaacccggtccttccccgttccgaccgtccccacccgaaccccgaaacggggtccccaacgtcccggtccctttccccccgnggtcccccgg

SEQ ID NO: 325996 - DNA, 554 bp, Homo sapiens
  misc_feature: GZ8MTXP02G79PG.22.38.D05.1.454.CMB.2.raw
  modified_base (332)..(332): a, c, t, g, unknown or other
  misc_feature (332)..(332): n is a, c, g, or t
  modified_base (366)..(366): a, c, t, g, unknown or other
  misc_feature (366)..(366): n is a, c, g, or t
  modified_base (376)..(376): a, c, t, g, unknown or other
  misc_feature (376)..(376): n is a, c, g, or t
  modified_base (422)..(422): a, c, t, g, unknown or other
  misc_feature (422)..(422): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggtgcacttattatggatgacggttaccgctacagtccatctctgaggaggngactcacatccacagacaccccaaacagtgctanatgaccacangaccctgtggacacagccatatattctgtgcacactctatagggancactggtacgtctcgacctaaacgtcggtccgacccgtgggggaccccggaaccctcggtcacccggtctccctacgacgccctaaccgacccgtaacggggcccctagtcccggtcccttcccccgtcggg

SEQ ID NO: 325997 - DNA, 562 bp, Homo sapiens
  misc_feature: GZ8MTXP02G1KUT.22.38.D05.1.454.CMB.2.raw
  modified_base (431)..(431): a, c, t, g, unknown or other
  misc_feature (431)..(431): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggtgcacttatttatgggatgacggttaccgctacagtccatctctgaggagagactcacatccaccaagacacccccaaaacaggtgtcctacaatgaccaccatcgaccctgtgacacagccacatattctgtgcacactctataggancacctggtacgtctcgacctaaacgtcggttaccgaccccgtcgggggccccggaacccgtggtcccaccggtctccctcgacgccctaaccgaccgaaccgggcccagtcccggtcccttcccccgtcgg

SEQ ID NO: 325998 - DNA, 556 bp, Homo sapiens
  misc_feature: GZ8MTXP02HGMJS.22.38.D05.1.454.CMB.2.raw
tcagacatacgcgtcacgaccggtgctcgatttagtatctgatagttgggtttgggggaggaactgctcagttaggacccagagggaaccatggaagccccagctcagcttctcttcctcctgctactctggctcccagataccaccggagaaattgtgttgacacagtctccagccaccctgtctttgtctccggggaaagagccaccctctcctgcagggccagtcagaatgttagtagttacttagcctggtaccagcaaaagcctggccaggctcccagactcctcatctctgatacatccaacagggccactggcatcccagccaggtcagtggcagtggtctgggacagacttcactctcacatcagcgactagacgcctagaagtatttgactagtttattactgtcagcagcgtagctatcgtggtccctccgtactaccgtttcgggcccggtaacgggaccgacgtccgtaggacgacgttaaacgaaacgtacgtcggtacgcgtcgaaccgtactacgttcgtcgttcctactacctttccccg

SEQ ID NO: 325999 - DNA, 577 bp, Homo sapiens
  misc_feature: GZ8MTXP02FG11H.22.38.D05.1.454.CMB.2.raw
  modified_base (431)..(431): a, c, t, g, unknown or other
  misc_feature (431)..(431): n is a, c, g, or t
  modified_base (574)..(574): a, c, t, g, unknown or other
  misc_feature (574)..(574): n is a, c, g, or t
tcagacatacgcgtcacgaccggtgctcgatttagtatctgatagttgggtttggggagtgactcctgtgcccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgcccccaggaaaggccctggaatgggttgcacttattattgggatgacggttacgctacagtccatctctgaggaggagactcaccatacccaccaacggaccaaccccccaaaaaccacggttcggtccttaacaactcgacccaccatcggaccctgtaggacacagcccaanatatttcagtgcacactcataggacgcacctggtagtctgacctaaacgtcggttaccgaccccgtcgggggaccccggaaccctgggtaccaccgtcctcctcacgccctccgaccgaacggcccagtccggtccttccccncgg

SEQ ID NO: 326000 - DNA, 576 bp, Homo sapiens
  misc_feature: GZ8MTXP02JTW1Q.22.38.D05.1.454.CMB.2.raw
  modified_base (412)..(412): a, c, t, g, unknown or other
  misc_feature (412)..(412): n is a, c, g, or t
  modified_base (439)..(439): a, c, t, g, unknown or other
  misc_feature (439)..(439): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggtgcacttattattgggatgacggttaccgctacagtccatctctgaggaggagactcaccatcccaccaaggaccaacccccaaaacaggtgtccttacaatgaccaccatgaccctgtgacacagccanatatttctgtgcacactcttataggancaccgtggtagtctgaccctaaacgttcggttccgacccccgtgggggacccccgggaaccgtcggtccacccggtcctccctccgacgccctcccgaccgaacggggccccacgtcccggtccttcccccgtcggg

SEQ ID NO: 326001 - DNA, 567 bp, Homo sapiens
  misc_feature: GZ8MTXP02GP6KF.22.38.D05.1.454.CMB.2.raw
  modified_base (441)..(441): a, c, t, g, unknown or other
  misc_feature (441)..(441): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagccccaggaaggccctggaatgggtgcacttatttattgggatgacggttaccgctacagtccatctctgaggaggagactcaccatccaccaacggacaacccccaaaaccaggtacggtcctacaatgaccaccatgaccctgtgacacagccaacatatttctgtcgcacactctataggancaccgtggtactctgccaaacgtcggttaccgaccccggtcgggggaccccggaacccgtgggtccaccggtcctcctccacgccctccgaccgaacggccccagtccggtcccttccccgtccgg

SEQ ID NO: 326002 - DNA, 601 bp, Homo sapiens
  misc_feature: GZ8MTXP02JM4RM.22.38.D05.1.454.CMB.2.raw
  modified_base (446)..(446): a, c, t, g, unknown or other
  misc_feature (446)..(446): n is a, c, g, or t
  modified_base (449)..(449): a, c, t, g, unknown or other
  misc_feature (449)..(449): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggtgcacttatttattgggatgacggttaccgctacagtccatctctgaggaggagactcaccatacccaccaacggacccaaccccccgaaaaaccacggttacgggtccttaacaaacttcgacccaccatacggaccctgtcggacacacgccaacatattcngtncacactcagtaggagcaccgtggtactctagaccaaacgttggttacccgaccccgtcgggggaccccggtaccctgggcccaccggtcctccgccacgccctaaccgacccgaacgggccccaacgtcccggttcccttcccccgtccggg

SEQ ID NO: 326003 - DNA, 737 bp, Homo sapiens
  misc_feature: GZ8MTXP02I2YK1.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgcccccgaggaaacggccctggaagtgggtgctacttattagttgggatgacggttaccgctacagtccatctctgaggagagactcacatacccaaccaacggaacccaaacccccaaaaaccgacggtacggtaccttaacaaactacgaaccaccagtacgggaccctgtacggaccaacgacgacccaactattactttctaggtcacctaacctaccttacgtaaagttaacgggacgtacctaacccggttagggtacgttaccgtacggtaacccctaaaacgttccggggtttaccccggaaccccccgggtacggggggtaaccccccgggtaaaccccgttcggggtaccccgtaacccggtttcccttccccgttacccgaaccgtacccccgtaaccccgaaaacccggaacccgggggtaccccctaacggtttccccggtttccccctttaccccccggtccgggg

SEQ ID NO: 326004 - DNA, 569 bp, Homo sapiens
  misc_feature: GZ8MTXP02JYD2L.22.38.D05.1.454.CMB.2.raw
  modified_base (420)..(420): a, c, t, g, unknown or other
  misc_feature (420)..(420): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggtgcacttatttattgggatgacggttaccgctacagtccatctctgaggaggagactcacatccaccaagacaacccccaaaacaggtcgtcctacaatcgaccacatcgaccctgtcggacacagccacatatttcngtgcacactctataggagcacgtggtagtctgacctaaacgtcggttacccgaccccgtcgggggcccccgggaacctcgggtcccacccgttcctcctcaccgccctcccgaccgacgggccccagtcccggtccttcccccgtcggg

SEQ ID NO: 326005 - DNA, 567 bp, Homo sapiens
  misc_feature: GZ8MTXP02F9DBC.22.38.D05.1.454.CMB.2.raw
  modified_base (425)..(425): a, c, t, g, unknown or other
  misc_feature (425)..(425): n is a, c, g, or t
  modified_base (428)..(428): a, c, t, g, unknown or other
  misc_feature (428)..(428): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggttgcacttatttattgggatgacggttaccgctacagtccatctctgaggaggagactcaccatcccaccaaggacaacccccaaaacaggtgtcctacaatgaccaccatcggaccctgtaggacacagaccacatatttcngtncacactctataggagcaccgtggtagtctgacctaaaacgtggttaccgaccccgtgggggacccccggaaccctgggtccaccggtctccctacacgccctccgaccaacgggcccagtccggtccttcccccgtcgg

SEQ ID NO: 326006 - DNA, 586 bp, Homo sapiens
  misc_feature: GZ8MTXP02HQ4TY.22.38.D05.1.454.CMB.2.raw
  modified_base (444)..(444): a, c, t, g, unknown or other
  misc_feature (444)..(444): n is a, c, g, or t
  modified_base (454)..(454): a, c, t, g, unknown or other
  misc_feature (454)..(454): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagccccaggaaacggccctggaatgggtgcacttatttatggatgacggttaccgctacagtccatctctgaggaggagactcacatccaaccaagaccaacccccaaaaacacggtacgtccttaacaatacgaccaccatcggaccctgtcgacacacgccacatattctgtgcacatctatagganctactggtancgtgaccaaacgttcggtaccgaccccgtcgggggaccccggacccgttcggtacccaccggttcctaccgtccgacgccctaacccgaaccgtaacgggcccctagtcccggtccctttcccccgcccggg

SEQ ID NO: 326007 - DNA, 618 bp, Homo sapiens
  misc_feature: GZ8MTXP02JGPAY.22.38.D05.1.454.CMB.2.raw
  modified_base (338)..(338): a, c, t, g, unknown or other
  misc_feature (338)..(338): n is a, c, g, or t
tcagacatacgcgtcacgaccggtgctcgatttagtatctgatagttgggttcggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggtccgtcagccccaggaaggccctggaatgggtgctacttattatggatgacggttaccgctacagtccatctctgaggaggagactcacntccaccaagaccaccccaaaacagtgcctacaatcaccacatcgacctgcgacacagccactatactttctgtgacactactctataggacgaccaccgttaggtacgtccttcgaccctaaacgttcggggttaccgacccccggttcgggggacccccggtaaccccgttcgggtacccgtaccccggtccttacccgtacccgacggcccccttaaccccgaacccgaaaccggggtccccaacgttcccgggttcccctttcccccggtcccgggg

SEQ ID NO: 326008 - DNA, 578 bp, Homo sapiens
  misc_feature: GZ8MTXP02JYYFA.22.38.D05.1.454.CMB.2.raw
tcagacatacgcgtcacgaccggtgctcgatttagtatctgatagttgggtttgggggaggaactgctcagttaggacccagagggaaccatggaagccccagctcagcttctcttcctcctgctactctggctcccagataccaccggagaaattgtgttgacacagtctccagccaccctgtctttgtctccgggggaaagagccaccctctcctgcagggccagtcagaatgttagtagttacttagcctggtaccagcaaaagcctggccaggctcccagacctcctcatctctgatacatccaaacgacgggcccacgtggcactccccagcctaggttcagtggcaggtcgggtctgggacagacttcactctcaccatcagcgactagacgcctagaagtatttgcttagtttacttacttgtcagcagcgtagcatcgtacggcctccgtactaccgtttcggccgtacggggaccaaggccgtagggaagacttaaccgaaaacgaaccgtaggtacggtactacggaaccaaccgtacttcgtacgttacctttacgactttcccccg

SEQ ID NO: 326009 - DNA, 590 bp, Homo sapiens
  misc_feature: GZ8MTXP02JOBKO.22.38.D05.1.454.CMB.2.raw
  modified_base (475)..(475): a, c, t, g, unknown or other
  misc_feature (475)..(475): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagccccaggaaggccctggaatgggtgcacttatttatgggatgacggttaccgctacagtccatctctgaggaggagactcaccatcccaccaacggacccaacccccaaaaacacggtacggtccttaacaaactcgaccaccacgtcgaccctgtgaaccacacgccaactattacttctgtcgacacactactagtaggacgctaccgtgtactcncgactaaacgtggttaccgaccccgtcggggaccccggaccgtgggtacccacggtcctcctcgacgccctaaccgacccgaacgggccctacgttccggtccctccccgtccgg

SEQ ID NO: 326010 - DNA, 595 bp, Homo sapiens
  misc_feature: GZ8MTXP02I0RC8.22.38.D05.1.454.CMB.2.raw
  modified_base (284)..(284): a, c, t, g, unknown or other
  misc_feature (284)..(284): n is a, c, g, or t
  modified_base (395)..(395): a, c, t, g, unknown or other
  misc_feature (395)..(395): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaagccctggaatgggttncacttatttatgggatgacgttaccgctacagtccatctctgaggaggagactcacatccaccaacgacaaccccaaaacagtgtcctacaatcgaccacatcgaccctgngacacagccaacatacttactgtgacacactctaataggagcaaccgtgtacgtctgacctaaacgtcggttaccgaaccccgtcgggggacccccgggaacccttcggtacccgacccggttcctcccttaccgacgacccctaacccgacccgaaacgggacccctaacgttcccgggttccctttacccccgtcggg

SEQ ID NO: 326011 - DNA, 680 bp, Homo sapiens
  misc_feature: GZ8MTXP02GWYTE.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaacggccctggaatgggtgctacttatttagttgggatgacggttaccgctacagtccatctctgaggaggagactcaccatacccaaccaacggaacccaaacccccaaaaccgacggtacggtccttacaatcgacccaccatcggaccctgtacgacacacgacccaactacttatttctagtcgacacctactctaatagggacgacctaccgtggtacgtccgtacgaccctaaaacgttccgggtttaccccggaacccccgggttccgggggaacccccggtaacccccggttcggttaccccgtaaccccggttccttacccccgtaccgacccggtaccccctccggaaacccccgtaccggggacccctacggttcccggtttccccgttccccccggtccggg

SEQ ID NO: 326012 - DNA, 687 bp, Homo sapiens
  misc_feature: GZ8MTXP02HM68G.22.38.D05.1.454.CMB.2.raw
  modified_base (282)..(282): a, c, t, g, unknown or other
  misc_feature (282)..(282): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggtccgtcagccccaggaacgccctggaatgggttncacttatttagttggatggacggttaccgctacagtccatctctgaggagagactcaccatcccaccaaacgacccaaacccccaaaacgacggtacgtcccttaacaaactacgacccaaccagtacggacccctgtcggaaaccacgaacgaccctaataactttacttttcgtagttcgacctaaccaccttaccttaaagtaacggggtacaccgtacccggttagggtacgttccgttacgacccgtaaaacggttccgggttacccggacccccgggttcgggggacccccgggtaaacccgttcgggtacccgtacccggttccctcccttaccgaccgtcccctaacccgacccgaaccggggtccctacgtcccgggttcccttcccccgtccggg

SEQ ID NO: 326013 - DNA, 550 bp, Homo sapiens
  misc_feature: GZ8MTXP02HFUU5.22.38.D05.1.454.CMB.2.raw
  modified_base (359)..(359): a, c, t, g, unknown or other
  misc_feature (359)..(359): n is a, c, g, or t
  modified_base (364)..(364): a, c, t, g, unknown or other
  misc_feature (364)..(364): n is a, c, g, or t
  modified_base (507)..(507): a, c, t, g, unknown or other
  misc_feature (507)..(507): n is a, c, g, or t
  modified_base (548)..(548): a, c, t, g, unknown or other
  misc_feature (548)..(548): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaagccctggaatgggtgcacttattattggatgacggttaccgctacagtcatctctgaggagagactcacatccacagacacccaaaacagngctanatgacacatgaccctgtgacacagcacatattctgtgcacactctataggagcaccgtgagtctgacctaaaactcggttaccgaacccccgtcgggggaccccggaaacccgtggtacccacccggtctccctcacgtcccnccgaaccaacggggccccaagtcccggtccttccccccggngg

SEQ ID NO: 326014 - DNA, 638 bp, Homo sapiens
  misc_feature: GZ8MTXP02H7X3N.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccaccccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgccccaggaaacggccctggaagtgggttgctacttatttagttgggatgacggttaccgctacagtccatctctgaggaggagactcaccatacacccaacggacccaacccccaaaaacacggtacggtaccttacaaactcgacccaccacgtcggaccctggtacgacacacgccaacattactttctgtcgactacacttactatacgggactaccgaccgttggtacgtctacggacctaaacgtcggttacccgaccccggtcgggggacccccggtaacgtcggtaccacccggttcctaccgtaccacgtcccctacccgaaacccgaaccgggccctaacgttcccgggtacccctttccccgcggccccg

SEQ ID NO: 326015 - DNA, 607 bp, Homo sapiens
  misc_feature: GZ8MTXP02IJL2Q.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagccccaggaaaggccctggaatgggttgcacttattattgggatgacggttacgctacagtccatctctgaggagagactcacatccaccaagaccaacccccaaaacacggtcgtccttacaatacgaccaccatcggaccctgtggacacagccacatatttctgtgacacacgtctaataggacgctacctggttacgactgacccaaacgttgggtttaccgaccccggtcgggggacccccgggtaaacccgtcggtaccgtaccccgtctccctaccaacggccccttaaccgaaccccgaaacggggcccctaacgttcccgggttccctttcccccgtccggg

SEQ ID NO: 326016 - DNA, 574 bp, Homo sapiens
  misc_feature: GZ8MTXP02HHSZD.22.38.D05.1.454.CMB.2.raw
  modified_base (365)..(365): a, c, t, g, unknown or other
  misc_feature (365)..(365): n is a, c, g, or t
  modified_base (415)..(415): a, c, t, g, unknown or other
  misc_feature (415)..(415): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggtccgtcagcccccaggaagccctggaatgggtgaacttattattggatgacggttaccgctacagtccatctctggaggaggagactcaccatcacccaagaccaacccccaaaacnggtgtccttacaatgaccaccatcgacctgtcgacacagccacatattcngtgcacactctatagacgcacctggtactctgaccaaacgtcgggtacccgaccccggtcgggggacccccggtaacccgtcggtaccacccggtcctaccctcgacgtccctaccaaccgacgggcccctacgtccggtcccttcccccgtggccccg

SEQ ID NO: 326017 - DNA, 576 bp, Homo sapiens
  misc_feature: GZ8MTXP02GDJDQ.22.38.D05.1.454.CMB.2.raw
  modified_base (448)..(448): a, c, t, g, unknown or other
  misc_feature (448)..(448): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggttgcacttatttattgggatgacggttaccgctacagtccatctctgaggaggagactcaccatcccaccaacggaccaacccccaaaaaccacggtaggtccttacaaatgaccaccatggaccctgtgacacagccacatatttctgtgcacactctataggancacctggtacgtctgaccaaactcggttaccgaccccgtgggggacccccggaacccgtggtcccaccgtctcccgtcacgcccctccgacccgaacgggccccagtcccggtcccttcccccgtcgg

SEQ ID NO: 326018 - DNA, 580 bp, Homo sapiens
  misc_feature: GZ8MTXP02HPDYA.22.38.D05.1.454.CMB.2.raw
  modified_base (328)..(328): a, c, t, g, unknown or other
  misc_feature (328)..(328): n is a, c, g, or t
  modified_base (370)..(370): a, c, t, g, unknown or other
  misc_feature (370)..(370): n is a, c, g, or t
  modified_base (412)..(412): a, c, t, g, unknown or other
  misc_feature (412)..(412): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaagccctggaatgggtgcacttattatgggatgacgttaccgctacagtccatctctgaggngagactcacatccaccaagacacccccaaaacagtgccttanaatgaccacaatggaccctgtgacacagccacatattctgtnacacactctagtagacgactacgtagtacgtctacgacctaaacgttcggtaccgaccccggtcgggggaccccggtaacccgtcggtacctacccgttcctcccgtaccgtaccgaccgtaacccgacccgaaccggacccgaccgtaccgtcccgttcccgtccgg

SEQ ID NO: 326019 - DNA, 526 bp, Homo sapiens
  misc_feature: GZ8MTXP02H7PDD.22.38.D05.1.454.CMB.2.raw
  modified_base (414)..(414): a, c, t, g, unknown or other
  misc_feature (414)..(414): n is a, c, g, or t
  modified_base (419)..(419): a, c, t, g, unknown or other
  misc_feature (419)..(419): n is a, c, g, or t
  modified_base (428)..(428): a, c, t, g, unknown or other
  misc_feature (428)..(428): n is a, c, g, or t
  modified_base (435)..(435): a, c, t, g, unknown or other
  misc_feature (435)..(435): n is a, c, g, or t
  modified_base (443)..(443): a, c, t, g, unknown or other
  misc_feature (443)..(443): n is a, c, g, or t
  modified_base (452)..(452): a, c, t, g, unknown or other
  misc_feature (452)..(452): n is a, c, g, or t
  modified_base (490)..(490): a, c, t, g, unknown or other
  misc_feature (490)..(490): n is a, c, g, or t
  modified_base (493)..(493): a, c, t, g, unknown or other
  misc_feature (493)..(493): n is a, c, g, or t
  modified_base (495)..(495): a, c, t, g, unknown or other
  misc_feature (495)..(495): n is a, c, g, or t
  modified_base (497)..(497): a, c, t, g, unknown or other
  misc_feature (497)..(497): n is a, c, g, or t
  modified_base (499)..(499): a, c, t, g, unknown or other
  misc_feature (499)..(499): n is a, c, g, or t
  modified_base (501)..(501): a, c, t, g, unknown or other
  misc_feature (501)..(501): n is a, c, g, or t
  modified_base (503)..(503): a, c, t, g, unknown or other
  misc_feature (503)..(503): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggtccgtcagcccccaggaaaggccctggaatgggtgcactattattgggatgacggttaccgctacagtccatctctgaggagagactcaccatccaaccaaaggacaacccccaaaaacaggtggtcctttaacaaatgaccaaccatggacccctgtgaacacancccanatattctgncacactntataggancacgtgtantcgacaacgtacgtccgacccgccggccggaccgcgcnccncncncncncnccacacgccactcgtcctcctcg

SEQ ID NO: 326020 - DNA, 650 bp, Homo sapiens
  misc_feature: GZ8MTXP02IOOQY.22.38.D05.1.454.CMB.2.raw
  modified_base (302)..(302): a, c, t, g, unknown or other
  misc_feature (302)..(302): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcacctgaaggagtctggtcctacgctggtacgaaacccacaccagaccctcacgctgacctgctaccttctctggttctcactcaactctagtggagtgggtgtggctggtcgtcacgccccaggaacgcctggatggtgctattattatggatgacgttacnctacagtccatctctaggaggagacgactcaaccactaccaacccgaacgaaccccaaaacccccaaaaaccgtacggttacgtccttaacaactaccgaacccacctacgtacggaccctgtacgacacgacacctaactaatttctttacgtcgtacgacactaacttcttaaagacggtaacgcctacggttacggttacgtccgtacgtaccgtaaaacggttcgggttaccccggtacccgggtcccgggggaccccgggtaacccgttcggacctacccggtctccgtaccaccgccctaaccgaacccggacggccctagtcccggttcccttcccgccgg

SEQ ID NO: 326021 - DNA, 624 bp, Homo sapiens
  misc_feature: GZ8MTXP02FJAAZ.22.38.D05.1.454.CMB.2.raw
  modified_base (325)..(325): a, c, t, g, unknown or other
  misc_feature (325)..(325): n is a, c, g, or t
  modified_base (472)..(472): a, c, t, g, unknown or other
  misc_feature (472)..(472): n is a, c, g, or t
  modified_base (603)..(603): a, c, t, g, unknown or other
  misc_feature (603)..(603): n is a, c, g, or t
  modified_base (619)..(619): a, c, t, g, unknown or other
  misc_feature (619)..(619): n is a, c, g, or t
tcagacatacgcgtcacgaccggtgctcgatttagtatctgatagttgggtttggggagtgactcctgtcgccccaccatggacacactttgctccacgctcctgctgctgaccatcccttcatgggtcttgtcccagatcaccctgaaggagtctggtcctacgctggtacgaaacccacacacgaccctcacgctgacctgctaccttctcgttgggttctcactcaactctagtggagtgggtgtggctggtccgtcacgccccgaggaacgcctggaagtgggtgctacttatttagtgggatggtaccggttaccgtacncgtccatctcgtggagggaggagactcaccactaccaaccccgaaaccggaaccccaaaccccccgaaaaaccgtagggtaccggttaccttacaaactacgaccaccagtcggaccctggtacgacacacgaccactattacttcngtcacaccacgttactaagtaggactccgtaccgttgggtactcgtacgacctaaacgttcggtacccggacccggtcggggacccggtacctcggtccaccgtctccacacgccaccaaccgacggcccngttccgtccctcccgngcccg

SEQ ID NO: 326022 - DNA, 617 bp, Homo sapiens
  misc_feature: GZ8MTXP02H7WP0.22.38.D05.1.454.CMB.2.raw
  modified_base (463)..(463): a, c, t, g, unknown or other
  misc_feature (463)..(463): n is a, c, g, or t
tcagacatacgcgtcacgaccggtgctcgatttagtatctgatagttgggtttgggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgccccgaggaacggccctggaagtgggtgcacttatttagttgggatgacggttaccgctacagtccatctctggaggaggagactcacatccaccaacgaccaacccccaaaacaggtacgtcctaacaatcgaccaccatacgaccctgacgacacacgacccaatattactttcgtgtacgccaacacttactaagtacgggancctaaccgtgggtactcgtacgaacctaaacgttccgggttaccgaccccggtcgggggaccccggtaaccgtcggtacccacccggtctacctaccgcgtaccctaacccgaccgaaccgggccctacgttcccggtccctttcccccggcgg

SEQ ID NO: 326023 - DNA, 725 bp, Homo sapiens
  misc_feature: GZ8MTXP02JALCA.22.38.D05.1.454.CMB.2.raw
  modified_base (272)..(272): a, c, t, g, unknown or other
  misc_feature (272)..(272): n is a, c, g, or t
  modified_base (281)..(281): a, c, t, g, unknown or other
  misc_feature (281)..(281): n is a, c, g, or t
  modified_base (439)..(439): a, c, t, g, unknown or other
  misc_feature (439)..(439): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggtccgtcacgccccaggaaggcccnggatgggtncacttattatgggatgacggttacgctacagtccatctctgaggaggagactcaaccataccccaaccgaacggaccaaacccccaaaacgacggtacggtcctaacaatacgaccacactacgaccctgtacggacacacgccaacgtattacttcngttcgaccactactctaaagtacgggacgtacctacccgttagggtaacgtttcctacgggtaaccctaaaacggtttccgggtttaacccccggaacccccgggttcggggggtaacccccccggggtaaaacccgttccgggggtaccccgtaaacccccgggtttcccttacccccgtaccgtaacccgggaccccctttaaccccggaaaaccccgtaaaaccgggggccccctaaacgtttcccccgggggtttaccccctttccccccgggttcccgggg

SEQ ID NO: 326024 - DNA, 624 bp, Homo sapiens
  misc_feature: GZ8MTXP02J075Q.22.38.D05.1.454.CMB.2.raw
  modified_base (366)..(366): a, c, t, g, unknown or other
  misc_feature (366)..(366): n is a, c, g, or t
  modified_base (412)..(412): a, c, t, g, unknown or other
  misc_feature (412)..(412): n is a, c, g, or t
  modified_base (420)..(420): a, c, t, g, unknown or other
  misc_feature (420)..(420): n is a, c, g, or t
  modified_base (424)..(424): a, c, t, g, unknown or other
  misc_feature (424)..(424): n is a, c, g, or t
  modified_base (442)..(442): a, c, t, g, unknown or other
  misc_feature (442)..(442): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgcccccaggaaaggccctggaatgggtgcacttatttatggatgacgttaccgctacagtccatctctgaggagagactcacatcccaccaagaccaacccccaaaacncggtgtcctacaatcgaccaccatcgaccctgtcgacacagaccanatatttcngtcncacactctaagtacgganacaccgttggtaacgtcgtacggaccctaaaacgttcgggttacccgaacccccggttcggggggacccccgggtaaacccgtcgggtacccgtaacccggttcctcccgttccgaccggtccctaacccgaacccgaaaccggggtcccctaacgtcccggttccccttcccccgtccggg

SEQ ID NO: 326025 - DNA, 667 bp, Homo sapiens
  misc_feature: GZ8MTXP02F66WS.22.38.D05.1.454.CMB.2.raw
  modified_base (453)..(453): a, c, t, g, unknown or other
  misc_feature (453)..(453): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtagaaacccacacagaccctcacgctgacctgctaccttctctggttctcactcaactctagtggagtgggtgtgggctggttccgtcacgccccgaggaaacggccctggaagtgggtgctacttattagtggatgtacgttacgctacagtccatctctaggaggaggacgactcaccactcccaaaccgaacggaaccaaacccccaaaaccgacggttacgtacccgttaacaaactcgaaacccacctacgtacggaaccctggtacggaaccaaccganacccaacttaacttacttttctggttacacctactacttactaaagtcgggacgcctaaccgtgggtaactctcggaaccctaaacgttccgggttacccggacccccggggtcgggggtacccccgggaaccgttcgggtaccctaccggtcctcctaccgccgccctaaccgacccgaaccggtccctacgtcccggtcccttccccgccgg

SEQ ID NO: 326026 - DNA, 613 bp, Homo sapiens
  misc_feature: GZ8MTXP02HIM68.22.38.D05.1.454.CMB.2.raw
  modified_base (425)..(425): a, c, t, g, unknown or other
  misc_feature (425)..(425): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgccccaggaaggccctggaatgggtgcacttatttatggatgacggttacgctacagtccatctctgaggaggagactcacatcccaccaacgaccaacccccaaaacacggtcgtcctaacaatcgaccaccatcggaccctgtaggacacgagccacattacttcngtcgcacactctagtaggagcaccgtggtacgtctacgaccctaaaacgttcgggttacccgacccccggttacggggggacccccggtaaaccctcggggtaccctacccggttcctaccccgttcaaccggtcccctaacccgaaccgaaccgggcccctagtcccgggtccctttcccccgccgg

SEQ ID NO: 326027 - DNA, 650 bp, Homo sapiens
  misc_feature: GZ8MTXP02GR7VE.22.38.D05.1.454.CMB.2.raw
  modified_base (436)..(436): a, c, t, g, unknown or other
  misc_feature (436)..(436): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgcccccaggaaaggccctggaatgggtgcacttatttatggatgacggttacgctacagtccatctctggaggaggagactcaccatcccaaccaaggaccaaacccccaaaaaccgaggtcggtccttaacaaatcgaccaccatcggaccctgtaggacacagaccactatatttcngttcgacactactactaataggacgctaccgttggtaacgtctacgaccctaaaacgttcgggttacccgacccccggttcgggggacccccggggtaaaccccgtcggggtacccctacccggttcctcccgtaccgaccggtcccctaaccccgaacccgaaaccggggtccccctaacggtccccggttccccgtttacccccgtcccggg

SEQ ID NO: 326028 - DNA, 654 bp, Homo sapiens
  misc_feature: GZ8MTXP02F2PTZ.22.38.D05.1.454.CMB.2.raw
  modified_base (510)..(510): a, c, t, g, unknown or other
  misc_feature (510)..(510): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgcccccgaggaaacggccctggaagtgggtgctactttattagttgggatggtacggttaccgctacacgtccatctcgtggaggaggagactcaaccactacccaacccgaaacggaaaccccaaaaccccccgaaaaaccgtacgggttacggtacccttaacaaactacgaaacccaccacgtcggaccctgtacggaaccacacgaccaatattcttacgtgtcaccactacctactaagacgggtacnctaccgtggtaactcgtacgaccctaaagttccggttaccgaccccggtcgggggaccccggtaaccgttccggtaccaccgtcctcccgtaccgccgaccctaaccgaccgacgggccctacgtcccggtccctccccgtcgg

SEQ ID NO: 326029 - DNA, 699 bp, Homo sapiens
  misc_feature: GZ8MTXP02HE7HJ.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacctacacagaccctcacgctgacctgcaccttctctgggttctcactcaactctagtggagtgggtgtgggctggttccgtcacgccccaggaaacggccctggaatgggtgctactttattagtggatggacgttaccgctacacgtccatctctggaggagagactcaccactacccaaccaacggaacccaacccccaaaacgtacggtacggtacctaacaactacgacccaccacgtacgtaccctgacgaccacacgcctaactattacttcgtgtacacctaactacgttacctaaagtacgggtaactccgtaccggttaggtacgtacgtacgtaacccgtaaacggttccgggttaccccgaaccccgggttccgggggtaacccccgggtaacccgttccgggttaccccgtaacccggttcccgttaccctacccgaccggttacccccaacccggtaaacccgaaccggggtcccctacggttccccgtaccccggtttcccccggccccggg

SEQ ID NO: 326030 - DNA, 593 bp, Homo sapiens
  misc_feature: GZ8MTXP02IMK2B.22.38.D05.1.454.CMB.2.raw
  modified_base (371)..(371): a, c, t, g, unknown or other
  misc_feature (371)..(371): n is a, c, g, or t
  modified_base (396)..(396): a, c, t, g, unknown or other
  misc_feature (396)..(396): n is a, c, g, or t
  modified_base (409)..(409): a, c, t, g, unknown or other
  misc_feature (409)..(409): n is a, c, g, or t
  modified_base (412)..(412): a, c, t, g, unknown or other
  misc_feature (412)..(412): n is a, c, g, or t
  modified_base (427)..(427): a, c, t, g, unknown or other
  misc_feature (427)..(427): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggttgcacttattatggatgacggttaccgctacagtccatctctgaggagagactcacatccaccaagacaccccaaaacagtgtcctanaatgaccaccatgaccctgtgacanagcacatatttcngtncacatctatagggancacctgtacgtctgaccaaaactggttaccgaccccgttcgggggaccccggaaacccgttcgggtcctaacccggtccttcccgttacctaacgccccgttaacccaaacccgaaacggggaccccctaacgttcccgggttaccctttccccccgttcccgggg

SEQ ID NO: 326031 - DNA, 699 bp, Homo sapiens
  misc_feature: GZ8MTXP02HJZWO.22.38.D05.1.454.CMB.2.raw
  modified_base (482)..(482): a, c, t, g, unknown or other
  misc_feature (482)..(482): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtagaaacccacacagaccctcacgctgacctgcaccttctctgggttctcactcaactctagtggagtgggtgtgggctggttccgtcacgcccccaaggaaacgccctggaatgggtgctacttatttatggatgacggtaccgctacagtccatctctgaggagagactcacatacccaaccaaacggaacccaaacccccaaaaactacgggtacgggttacccttaaacaaacgtcgaacccaaccaacgtacggacccctagtacggaacaacacgtacccaaactactttaactttccgtaggttacncctaaacgtacttaccttaaagttaacgggacgaccgtacccgttaggggttaactccgttacgaacccgtaaaacggttccgggtttaaccccgacccccgggttcgggggacccccggtaaacccgttcgggtaccctaccggttcttccctacgaccggccctaacccgaaccgaaccggccccgtaagttccccggtcccctttccccgccgg

SEQ ID NO: 326032 - DNA, 606 bp, Homo sapiens
  misc_feature: GZ8MTXP02GUQKH.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggtgctacttattatgggatgacggttaccgctacagtccatctctgaggaggagactcacatccaccaacggaccaacccccaaaacaggtacgtccttacaatcgaccaccatcgaccctgtcgacacacgccacatactttctagtgacacactctaataggagcacctggtacgtctacggaccaaacgttcggttacccgaccccgttcgggggaccccgggtaacccgtcggtacccgtacccggttcctcccgtacgacgtcccctaacccgaacccgaaacggggcccctacgtcccgggtccctttcccccgtccgg

SEQ ID NO: 326033 - DNA, 631 bp, Homo sapiens
  misc_feature: GZ8MTXP02JMGVH.22.38.D05.1.454.CMB.2.raw
  modified_base (367)..(367): a, c, t, g, unknown or other
  misc_feature (367)..(367): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggtgcacttatttatgggatgacggttaccgctacagtccatctctgaggagagactcacatccaccaaggaccaacccccaaaacnggtcgtcctacaatcgaccacatcggaccctgtcgacacacgcccaacattatttctgtcacactactctataggacgcaccgtggtagtcgtagaccctaaacgtcgggttacccgaacccccgtcgggggacccccgggtaaacccgtcgggtaccctacccggtccttcccgttaccgaccggtcccccttaacccgaaaccccggaaaccgggggtccccctaacggttcccgggttccccctttccccccggtccgggg

SEQ ID NO: 326034 - DNA, 602 bp, Homo sapiens
  misc_feature: GZ8MTXP02IAC6A.22.38.D05.1.454.CMB.2.raw
  modified_base (311)..(311): a, c, t, g, unknown or other
  misc_feature (311)..(311): n is a, c, g, or t
  modified_base (334)..(334): a, c, t, g, unknown or other
  misc_feature (334)..(334): n is a, c, g, or t
  modified_base (367)..(367): a, c, t, g, unknown or other
  misc_feature (367)..(367): n is a, c, g, or t
  modified_base (417)..(417): a, c, t, g, unknown or other
  misc_feature (417)..(417): n is a, c, g, or t
  modified_base (445)..(445): a, c, t, g, unknown or other
  misc_feature (445)..(445): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaggccctggaatgggtgcacttatttattggatgacggttaccgntacagtccatctctgaggagganactcaccatccaccaagaccaaccccaaaaacnggtacgtccttacaatcgaccaccatgaccctgtaggaccacacgaccanattatttctgtgcacactctagtaggancacgtggtagtctagacccaaacgttggttaccgacccccggttcgggggacccccgggaaacccgtttcggacctacccggtcctacccgtcgaccggccctaacccgaaccgaaccgggggccctaccgtcccggttaccgtttcccccgccggg

SEQ ID NO: 326035 - DNA, 647 bp, Homo sapiens
  misc_feature: GZ8MTXP02F5PCQ.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgcccccaggaaaggccctggaatgggtgctacttattattgggatgacggttaccgctacagtccatctctgaggaggagactcaccatccaaccaacggaaccaaacccccaaaaacacggtacggtccttaacgaaatcgaacccaccatcgggaccctgtggaacacacgaccaactattactttctgtgaccactacttcgtaattaaggagcctaccgtaggtaacgtctgaccctaaaacgttcgggtaccgtacccccggtcgggggaacccccggtaacccgtcgggttacccacccgttcctacccgtccgaacgtcccctaacccgaaacccgaaccggggtacccccacgttcccggttaccccttcccccggtccggg

SEQ ID NO: 326036 - DNA, 578 bp, Homo sapiens
  misc_feature: GZ8MTXP02JHHGG.22.38.D05.1.454.CMB.2.raw
  modified_base (418)..(418): a, c, t, g, unknown or other
  misc_feature (418)..(418): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggcccctggaatgggttgcacttatttattgggatgacggttacgctacagtccatctctgaggaggagactcaccatccaccaaggaccaacccccaaaacaggtcggtccttacaatgaccaccatcggaccctgtggacacagccanatatttctgtgcacactctataggagcaccgtggtagtctagcctaaactcggttaccgaccccgtgggggccccggtaaacccgtcggtccgacccggttctcccgtccgacgccctccgaacccaacggggcccactccggttccttcccccgtcggg

SEQ ID NO: 326037 - DNA, 649 bp, Homo sapiens
  misc_feature: GZ8MTXP02JTNL8.22.38.D05.1.454.CMB.2.raw
  modified_base (458)..(458): a, c, t, g, unknown or other
  misc_feature (458)..(458): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgccccaggaaggccctggaagtgggtgctacttatttatggatgacggttaccgctacagtccatctctgaggaggagactcacatcccaccaacgaccaacccccaaaacacggtacgtcctacaatcgaccaccacgtcggaccctgtacgacacgacgcccactattactttctgtcgacactactctaagtacggancctaccgttaggtacgtccgtacgaccgtaaacgttcgggttacccgtacccccgggtcgggggacccccgggtaaccgttcgggtacccgtacccggttccgttaccccgtaccgtacccgcccttaacccgaacccggaaaccggggtccccctaccgtccccgggtttccccttcccccgttccgggg

SEQ ID NO: 326038 - DNA, 726 bp, Homo sapiens
  misc_feature: GZ8MTXP02HLXY5.22.38.D05.1.454.CMB.2.raw
  modified_base (280)..(280): a, c, t, g, unknown or other
  misc_feature (280)..(280): n is a, c, g, or t
  modified_base (390)..(390): a, c, t, g, unknown or other
  misc_feature (390)..(390): n is a, c, g, or t
tcagacatacgcgtcacgaccggtgctcgatttagtatctgatagttgggtttggggagtgactcctgtgccccacatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtggctggttcgcacgccccgaggaaggccctggagtgggtncacttattatggatgacggtaccgctacgcgtcatctctggaggagagctacacatacccaaccaacggacccaaaacccccaaaacgtacggttcggtaccctttaaanaaactcgaacccaccgtagtcgggtacccctaggtacgaaccaacacgaccctaatattactttctggtcaccaactacgttacgttaaagtacgggtaacgccttaaccgtagggttacgttaccgtacgtaaacccgtaaaacggtttccggggttaccccggaacccccggggttcccgggggaacccccgggtaccccgttcggggtaccccctacccggttcccttacccgaccgtacccggaccccttaaccccggaaccggtaaaaccccgggggtcccctaacccggtttcccccgggttcccccgtttttacccccggcccccgggg

SEQ ID NO: 326039 - DNA, 557 bp, Homo sapiens
  misc_feature: GZ8MTXP02I7MCK.22.38.D05.1.454.CMB.2.raw
  modified_base (414)..(414): a, c, t, g, unknown or other
  misc_feature (414)..(414): n is a, c, g, or t
  modified_base (417)..(417): a, c, t, g, unknown or other
  misc_feature (417)..(417): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggtccgtcagcccccaggaaaggccctggaatgggtgcacttatttatgggatgacggttaccgctacagtccatctctgaggaggagactcaccatccaccaagacacccccaaaacaggtgtcctacaatgaccaccatgaccctgtgacacagccaacatattcngtncacactctataggagcacctggtatctgacctaaacgtcgggttaccgacccccgttgggggacccccggtaacctggggtacccaccggtctccgtcacgccctccgaccgaacggcccatccggtccttccccgtcgg

SEQ ID NO: 326040 - DNA, 626 bp, Homo sapiens
  misc_feature: GZ8MTXP02HTPSF.22.38.D05.1.454.CMB.2.raw
  modified_base (459)..(459): a, c, t, g, unknown or other
  misc_feature (459)..(459): n is a, c, g, or t
  modified_base (471)..(471): a, c, t, g, unknown or other
  misc_feature (471)..(471): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagccccaggaaggccctggaatgggtgcacttatttattgggatgacggttaccgctacagtccatctctgaggaggagactcaccatcccaccaacggaccaacccccaaaacacggtacggtccttaacaatacgacccaccactcgaccctgtcggaccacagcccactattactttctgtcgacacacttctagtaggancacgtggagtcncgaccaaacgtcggttacccgaccccggtacgggggcccccgggtaaccgttcgggtacccacccggttcctccccgtaccgaaccgtcccctaacccgaacccgaaccgggggtaccccacggttccccgggtttcccttccccccggtccggg

SEQ ID NO: 326041 - DNA, 598 bp, Homo sapiens
  misc_feature: GZ8MTXP02JNYXI.22.38.D05.1.454.CMB.2.raw
  modified_base (370)..(370): a, c, t, g, unknown or other
  misc_feature (370)..(370): n is a, c, g, or t
  modified_base (427)..(427): a, c, t, g, unknown or other
  misc_feature (427)..(427): n is a, c, g, or t
  modified_base (438)..(438): a, c, t, g, unknown or other
  misc_feature (438)..(438): n is a, c, g, or t
  modified_base (447)..(447): a, c, t, g, unknown or other
  misc_feature (447)..(447): n is a, c, g, or t
  modified_base (460)..(460): a, c, t, g, unknown or other
  misc_feature (460)..(460): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggtccgtcagcccccaggaaacggccctggaatgggtgaacttatttagttgggatggacggttaccgctacagtccatctctgaggaggagactcaccatcacccaagaccaaccccaaaacnggtacgtcctacaactcgaccaccatcggacctggtcgacacagccactatatttcngtcgcacactntataggacncacgtggtactcncgaccaaacgttcgggttcccgacccggtcgggggacccccggtaaccgttcggtaccgtacccggtctccctaccgacgccccttaccaacccgaaacggggtcccacgtcccggtcccttcccccggcggtccccg

SEQ ID NO: 326042 - DNA, 656 bp, Homo sapiens
  misc_feature: GZ8MTXP02HGUGB.22.38.D05.1.454.CMB.2.raw
  modified_base (439)..(439): a, c, t, g, unknown or other
  misc_feature (439)..(439): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtagaaacccacacagaccctcacgctgacctgcaccttctctgggttctcactcaactctagtggagtgggtgtggctggtcgcacgccccaggaacggccctggaatggtgctacttattagtggatgacgttacgctacagtcatctcgtgaggagagactcacataccaccaacgacccaaacccccaaaacgacggtacggtaccttaacaatacgacccacacgtacggaccctgtacggacacacgaccactattacttctgtcncaactactacgtagtacggacgactaccgtaggttacgtccgtacgtaaccgtaaaccggttccggttaccccggaccccgggttaccgggggacccccgggtaaccgttccggtacccgtacccgttccgtacccgtccgtaaccgcccctaacccgacccgtaaacccggggtcccctaacgtttcccccgggtcccctttcccccggtcccggg

SEQ ID NO: 326043 - DNA, 604 bp, Homo sapiens
  misc_feature: GZ8MTXP02IM9U5.22.38.D05.1.454.CMB.2.raw
  modified_base (427)..(427): a, c, t, g, unknown or other
  misc_feature (427)..(427): n is a, c, g, or t
  modified_base (445)..(445): a, c, t, g, unknown or other
  misc_feature (445)..(445): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagccccaggaaaggccctggaatgggttgcacttattattggatgacggttaccgctacagtccatctctgaggagagactcacatccaccaacgaccaacccccaaaacacggtcgtccttaacaatcgaccaccagtcgaccctgtgacacacgccaactattactttcngtgcacactctataggancacgtggtagtctaggacctaaacgtcggttacccgaccccgtcgggggacccccggaaacccgttcggtacccacccggttcctcccgtaccgaccgtcccctaacccgaacccgaacggggtcccctacgttcccggttccccttcccccgtccggg

SEQ ID NO: 326044 - DNA, 645 bp, Homo sapiens
  misc_feature: GZ8MTXP02JPKLJ.22.38.D05.1.454.CMB.2.raw
  modified_base (398)..(398): a, c, t, g, unknown or other
  misc_feature (398)..(398): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggtccgtcagcccccaggaaaggccctggaatgggtgcacttattagtgggatgacggttaccgctacagtccatctctgaggaggagactcaccatcccacaacgacaacccccaaaacaggtcgtcctacaatcgaccacatcgccctgnggacacagccacattattctagcgtacactactctaatacggagtccaccgttagggtaacgtctacggtacccgtaaaacgttccggggtttacccgaacccccgggttcgggggacccccgggtaacccgttcgggtacccaccccgggttacctcccgtaccgtaccggcccctaacccgaaccccggtaaaacgggggtcccccaacggttccccggttcccccgtttacccccgtcccgggg

SEQ ID NO: 326045 - DNA, 624 bp, Homo sapiens
  misc_feature: GZ8MTXP02JTKO8.22.38.D05.1.454.CMB.2.raw
  modified_base (455)..(455): a, c, t, g, unknown or other
  misc_feature (455)..(455): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgccccgaggaaacggccctggaatgggtgctacttatttagtgggatgacggttaccgctacagtccatctcgtgaggaggagactcaccactccaccaacggaccaacccccaaaacgaggtacgtcctacaatcgaccacacgtcgaccctgtacgacacagccactattacttctgtcacacacttcagtaggancctacgtgtacgtccgtacgaccctaaacgttcggttacccgacccccggttgggggacccccgggtaacccttggggtaccctacccggtcctcccgtaccgaccgaccctaacccgaacccgaacggggtcccccacgttcccgggtcccctttacccccgcccggg

SEQ ID NO: 326046 - DNA, 630 bp, Homo sapiens
  misc_feature: GZ8MTXP02G1BCR.22.38.D05.1.454.CMB.2.raw
  modified_base (385)..(385): a, c, t, g, unknown or other
  misc_feature (385)..(385): n is a, c, g, or t
  modified_base (392)..(392): a, c, t, g, unknown or other
  misc_feature (392)..(392): n is a, c, g, or t
  modified_base (436)..(436): a, c, t, g, unknown or other
  misc_feature (436)..(436): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgccccaggaaacggccctggaatgggtgcacttattatgggatgacgttaccgctacagtccatctctggaggaggagactcacatccaccaagacaaccccaaaacagtgtctacaatcgaccacancgacccngtagacacagaccacatattctgtagcacactctaagtaggacncctaccgtaggtactctacgaccctaaaacgttccggttaccgaacccccggtgggggaccccccgggtaaacccttcggggtaccctaacccggtccttccccgtaccgacccgtacccgtaaccccgaacccgaaaaccgggggtccccctaacgttccccgggtttcccccgtttaccccccgtcccgggg

SEQ ID NO: 326047 - DNA, 611 bp, Homo sapiens
  misc_feature: GZ8MTXP02I2BDQ.22.38.D05.1.454.CMB.2.raw
  modified_base (334)..(334): a, c, t, g, unknown or other
  misc_feature (334)..(334): n is a, c, g, or t
  modified_base (418)..(418): a, c, t, g, unknown or other
  misc_feature (418)..(418): n is a, c, g, or t
  modified_base (427)..(427): a, c, t, g, unknown or other
  misc_feature (427)..(427): n is a, c, g, or t
  modified_base (430)..(430): a, c, t, g, unknown or other
  misc_feature (430)..(430): n is a, c, g, or t
  modified_base (446)..(446): a, c, t, g, unknown or other
  misc_feature (446)..(446): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggttgcacttatttattggggatgacggttaccgctacagtccatctctgaggnggagactcacatccaccaaggacaacccccaaaacaggtcgtccttaacaatcgaccaccatcggaccctgtggacacagccanatagtttcngtncacactctatacgganccaccgtggtacgtctgaccaaaacgttcgggttaccgaacccccgttgggggacccccgggtaaaccctcgggtaccctaacccggtccttcccgtacaccgtccctaacccgaacccgaaacggggtcccccacgttccccgggttcctttccccccgtcggg

SEQ ID NO: 326048 - DNA, 636 bp, Homo sapiens
  misc_feature: GZ8MTXP02F0U1R.22.38.D05.1.454.CMB.2.raw
  modified_base (434)..(434): a, c, t, g, unknown or other
  misc_feature (434)..(434): n is a, c, g, or t
  modified_base (453)..(453): a, c, t, g, unknown or other
  misc_feature (453)..(453): n is a, c, g, or t
  modified_base (470)..(470): a, c, t, g, unknown or other
  misc_feature (470)..(470): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgccccgaggaaacggccctggaatgggtgctacttattagtggatgacgttacgctacagtccatctctgaggaggagactcacatccaaccaacgaaccaaacccccaaaaacgaggtacgtcctaacaatacgaccacatcggaccctgtagacacagccaactatattactgtnacacactactaagtagganacctacgtaggtaactntacgaacctaaaacgttcggttacccgaccccggtaccgggggacccccggtaaacccgtggtacccgaacccggttccgttccctaccgaccgtacccctaacccgaaacccgaaaaccggggccccctaaacgttcccgggtccccctttacccccggtcccgg

SEQ ID NO: 326049 - DNA, 597 bp, Homo sapiens
  misc_feature: GZ8MTXP02JXNHI.22.38.D05.1.454.CMB.2.raw
  modified_base (423)..(423): a, c, t, g, unknown or other
  misc_feature (423)..(423): n is a, c, g, or t
  modified_base (438)..(438): a, c, t, g, unknown or other
  misc_feature (438)..(438): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagccccaggaaaggccctggaatgggtgcacttatttattgggatgacggttaccgctacagtccatctctgaggaggagactcaccatcccaccaagaccaacccccaaaacaggtgtccttacaatcgaccacatcggaccctgcgacacagccacatattctgtncacactctataggancacgtggtatcgtagacctaaacgtcgggttacccgaccccggttcgggggacccccgggtaacccgtcggtacccgacccggttcctcccgtccgaccggtcccctaacccgacccgaaacggggcccctaacgtcccgggtccttccccccgtcggg

SEQ ID NO: 326050 - DNA, 714 bp, Homo sapiens
  misc_feature: GZ8MTXP02JIJXP.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtacgaaacccacacacgaccctcacgctgacctgcctaccttctcttgggttctcactcaactcgtgggtggaggtgggtggtgggcgttcggttccgtcgacgaccccgagggaaacggcccgtggaagtgggtgctacttagttagttggatgtacggtccgctacacgtccatctcgtaggaggaggacgactacaacctactaccccaaccgaaaccggaacccaaaacccccgaaaacgacggtacgtaccttaacaactacgacccactacgtacggacccttggacgaccacgacgacccaacttattactttcgtggtacacctaactaacgttacgtaaagtacggggaactccgtaaccggtttggtaaccgttccgtaaccgaacccgtaaacggttccggggttaacccccggccccgggtacgggggacccccgggtaacccttggggtacccctaccgttccgttcccaccgaccgtaccccgaaccgaaccggacccggtcctaccgttcccggtccccttcccgaccggg

SEQ ID NO: 326051 - DNA, 602 bp, Homo sapiens
  misc_feature: GZ8MTXP02HQDFU.22.38.D05.1.454.CMB.2.raw
  modified_base (436)..(436): a, c, t, g, unknown or other
  misc_feature (436)..(436): n is a, c, g, or t
  modified_base (439)..(439): a, c, t, g, unknown or other
  misc_feature (439)..(439): n is a, c, g, or t
  modified_base (443)..(443): a, c, t, g, unknown or other
  misc_feature (443)..(443): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggtccgtcagccccaggaaaggccctggaatgggtgcacttatttattgggatgacggttaccgctacagtccatctctgaggaggagactcacactccaccaaggaccaacccccaaaaacgacggtaggtccttaacaatcgacccaaccactggacccctgtcggacacgacgccactattatttcngtncacnctctagtaggacgcaccgtgtacgtctgaccctaaacgttcggtaccgaccccggtcgggggacccccggtaaccgtcgggtacccaccggttcctaccctcgaccgcccgtaacccgaccgaacggccccctagtcccggttccctcccccgtccggg

SEQ ID NO: 326052 - DNA, 677 bp, Homo sapiens
  misc_feature: GZ8MTXP02I8AZ4.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctggttctcactcaactctagtggagtgggtgtgggctggttccgtcacgccccgaggaaacggccctggaagtgggtgctacttagtttagtgggatggtacggtaccgctacacgtccatctctggaggaggagactcacatacccaaccaacgaaccaaacccccaaaaaccgaggtacgtacctaacaactacgaacccaccacgtacggaccctagtacgaccaacacgaccaactattattcgtgtcgacacactctaagacggacgcctaaccgtggtaacgtcgtacgaccgtaaacgttccggttacccgaccccgggtcgggggtacccccggtaaaccggttcggtaccccgtaacccgtccgttacccgtaccgtacccgtaccccgtaacccgaaaccccgggtaaaccggaccccttaccggttcccggtttacccccgttcccccggttcccggg

SEQ ID NO: 326053 - DNA, 590 bp, Homo sapiens
  misc_feature: GZ8MTXP02GMINK.22.38.D05.1.454.CMB.2.raw
  modified_base (423)..(423): a, c, t, g, unknown or other
  misc_feature (423)..(423): n is a, c, g, or t
  modified_base (442)..(442): a, c, t, g, unknown or other
  misc_feature (442)..(442): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggtgcacttatttattgggatgacggttaccgctacagtccatctctgaggaggagactcaccatccaccaaggaccaacccccaaaacaggtcgtcctacaatcgaccaccatcggaccctgtgacacagccacatatttcngtgcacactctaataggancaccgtggtatctgaccctaaacgtcggttaccgacccccggttcgggggacccccgggtaacccgtcgggtcccacccggtcctcccgtccgaccgccctaacccgaccgaacgggccccacgtcccggtccctttcccccgtcggg

SEQ ID NO: 326054 - DNA, 584 bp, Homo sapiens
  misc_feature: GZ8MTXP02FMWJ4.22.38.D05.1.454.CMB.2.raw
  modified_base (410)..(410): a, c, t, g, unknown or other
  misc_feature (410)..(410): n is a, c, g, or t
  modified_base (418)..(418): a, c, t, g, unknown or other
  misc_feature (418)..(418): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggcccctggaatggggttgcacttatttattgggatgacggttaccgctacagtccatctctgaggaggagactcaccatccaccaagacacccccaaaacaggtgtcctacaatgaccacatgaccctgtgacacagccanatatttcngtgcacactctaataggagcaccgtggtagtctggacccaaacgtggttaccgacccccgtcgggggacccccgggtaaacccgtgggtacccacccggttctcccgttccacgccctaacccgaccgaaacggggcccccagttcccggtccttcccccgtcggg

SEQ ID NO: 326055 - DNA, 610 bp, Homo sapiens
  misc_feature: GZ8MTXP02HOG9Q.22.38.D05.1.454.CMB.2.raw
  modified_base (270)..(270): a, c, t, g, unknown or other
  misc_feature (270)..(270): n is a, c, g, or t
  modified_base (463)..(463): a, c, t, g, unknown or other
  misc_feature (463)..(463): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggtcgtcagccccaggaaggcccnggaatgggtgcacttattatggatgacgttaccgctacagtccatctctgaggaggagactcaccatacccaaccaacggaccaacccccaaaaacgacggtacggtccttaacaaatcgaccaaccatacggaccctgtacggaacaccgacgcccaatattaatttcctgtcgacacactctaagtaggancctacgtggtagtctagacctaaacgtcggttacccgacccccggtcgggggaccccggaaacccgttcgggacccacccggtctcccgtcaccgccctaacccgaccgaaccggggtcccacgttcccggtccctttccccgccgg

SEQ ID NO: 326056 - DNA, 654 bp, Homo sapiens
  misc_feature: GZ8MTXP02I9M2V.22.38.D05.1.454.CMB.2.raw
  modified_base (283)..(283): a, c, t, g, unknown or other
  misc_feature (283)..(283): n is a, c, g, or t
  modified_base (464)..(464): a, c, t, g, unknown or other
  misc_feature (464)..(464): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgccccaggaacgccctggaatgggtnctacttattagtgggatggtacggttaccgctacagtccatctcgtgaggaggagactcacactaccaccaacggaccaaacccccaaaacgacggtacgtaccttaacaactacgaaccacctagtacgggacccttggacggaaccaaccgacgacccaactatttactttctggtacncaacctacttactaagtacggacgacctaccgttggtacgtcgtacgaccctaaagttccggttaccgaccccgggtcgggggaccccggtaacccgtcgggtaccacccggttcctcccgtaccgaccgtcccgtaacccgaaccggaaccgggtccccacggttcccgtccccgttccccgtcccggg

SEQ ID NO: 326057 - DNA, 570 bp, Homo sapiens
  misc_feature: GZ8MTXP02G2757.22.38.D05.1.454.CMB.2.raw
  modified_base (426)..(426): a, c, t, g, unknown or other
  misc_feature (426)..(426): n is a, c, g, or t
  modified_base (445)..(445): a, c, t, g, unknown or other
  misc_feature (445)..(445): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgccccaggaaacggccctggaatgggtgcacttattatgggatgacggttaccgctacagtccatctctgaggaggagactcaccatcccaccaacgaccaacccccaaaaacaggtacgtccttacaaatcgaccaccatcgaccctgtgacacagccaacatattcngtgcacactactagagtanacaccgtggtactcgtacgacctaaacgtcggtacccgacccgtccggggaccccggacccgtcgtccaccgtctcctcacgtccaaccgaccgaacggcccacgtccggtccctccccgtccgg

SEQ ID NO: 326058 - DNA, 589 bp, Homo sapiens
  misc_feature: GZ8MTXP02IN91G.22.38.D05.1.454.CMB.2.raw
  modified_base (417)..(417): a, c, t, g, unknown or other
  misc_feature (417)..(417): n is a, c, g, or t
  modified_base (444)..(444): a, c, t, g, unknown or other
  misc_feature (444)..(444): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggttgctacttattattgggatgacggttacgctacagtccatctctgaggaggagactcacatccaccaagaccaacccccaaaacacggtcgtccttacaatcgaccaccatcggaccctgtggacacacgccanatatttctgtgcacactctaataggancaccgtggtacgtctcgaccgtaaactggtttacccgaccccgttcgggggacccccgggtaacccgtcgggtccaacccggtcctccgactccgccctcccgaacccgtacgggccctacgtccggttcccttcccccgtcggg

SEQ ID NO: 326059 - DNA, 693 bp, Homo sapiens
  misc_feature: GZ8MTXP02GM5VX.22.38.D05.1.454.CMB.2.raw
  modified_base (426)..(426): a, c, t, g, unknown or other
  misc_feature (426)..(426): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggtgcacttattatggatgacgttacgctacagtccatctctgaggaggagactcaccatcccaaccaacggaaccaacccccaaaaacaggtacggtccttacaaatgacccacatcgaccctgtcgacacagccacatatttcngtcgacactactctaagttacggagacctaaccgttgggtaacgtccgttacgaacccgtaaaaacgtttcggggtttaccccggaaaaccccccggttcggggggaaccccccgggtaaaacccccggttacgggggttcccctaaaccccgggttccctttccccgtacccgtaacccgccccggttaaccccaaaacccggtaaaacccgggggccccctaaacggtccccgggggtttcccctttcccccccgtacccggggg

SEQ ID NO: 326060 - DNA, 626 bp, Homo sapiens
  misc_feature: GZ8MTXP02HDB2A.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtagaaacccacacagaccctcacgctgacctgcaccttctctgggttctcactcaactctagtggagtgggtgtgggctggttccgtcacgccccaggaacgccctggaatgggtgcacttattagttggatggacggttacgctacacgtccatctctgaggagagactcaccataccccaaccgaacggaacccaaacccccgaaaaacgtacggtacggtaccttaacaaactacgacccaaccagtcggaccctgtacggaaccaacgacgaccaactattacgtttctagtcgacacactactaagtacggagcctacgtgtacgttcacgaccaaacgttcggtacccgacccggtcggggaccccggtaccgtcggtcctaccggtcctccctacgaccgccctaacccgaaccgaaccggcccacggttccccgtcccttccccgtccgg

SEQ ID NO: 326061 - DNA, 633 bp, Homo sapiens
  misc_feature: GZ8MTXP02JR6UT.22.38.D05.1.454.CMB.2.raw
  modified_base (335)..(335): a, c, t, g, unknown or other
  misc_feature (335)..(335): n is a, c, g, or t
  modified_base (434)..(434): a, c, t, g, unknown or other
  misc_feature (434)..(434): n is a, c, g, or t
  modified_base (450)..(450): a, c, t, g, unknown or other
  misc_feature (450)..(450): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggttgcacttatttatggatgacggttaccgctacagtccatctctgaggagganactcacatccaccaagaccaacccccaaaacaggtacgtccttacaatcgaccaccatacggaccctgtggaaccacgacgcccaactattattctgtncacactctaataggancctaccgttggtagtcttacgaccctaaacgttcgggttacccgaccccgtcgggggtaccccccggtaaacccgttcggggtacccctacccggttccttccccgtaccgaccggtcccctaacccgaacccgaaaccggggcccctaacgtcccggtttcccccgtcccccgttcccgggg

SEQ ID NO: 326062 - DNA, 540 bp, Homo sapiens
  misc_feature: GZ8MTXP02GZ2J8.22.38.D05.1.454.CMB.2.raw
tcagacatacgcgtcacgaccggtgctcgatttagtatctgatagttgggtttgggggaggaactgctcagttaggacccagagggaaccatggaagccccagctcagcttctcttcctcctgctactctggctcccagataccaccggagaaattgtgttgacacagtctccagccaccctgtctttgtctccggggaaagagccaccctctcctgcagggccagtcagaatgttagtagttacttagctggtaccagcaaaagcctggccaggctcccagactcctcatctctgatacatccaaacaggccactggcactccccagcccagggttcaagtggcaggtcgggtctgggacagacttcactctcacatcagcgacctagacgcctagaaagtatttgctagtttataactgtcagcagcgtagctatctcggccctaccgtacaccgtttggaccgaggggaaccaaggctaggacgtaatacaaaacgaaactgtacggcctgaacaaccatcctgtacttcacttccc

SEQ ID NO: 326063 - DNA, 572 bp, Homo sapiens
  misc_feature: GZ8MTXP02GY696.22.38.D05.1.454.CMB.2.raw
  modified_base (412)..(412): a, c, t, g, unknown or other
  misc_feature (412)..(412): n is a, c, g, or t
tcagacatacgcgtcacgaccggtgctcgatttagtatctgatagttgggtttgggggaggaactgctcagttaggacccagagggaaccatggaagccccagctcagcttctcttcctcctgctactctggctcccagataccaccggagaaattgtgttgacacagtctccagccaccctgtctttgtcgtccgggggaaagacgccaccctctcctgcagggccagtcagaatgttagtagttacttagctggtaccagacaaaagcctggccaggctcccagactcctcatctctgatacataccaaacgacgggccacgtggccactccccagccgaggttcagtggcgtaggtcggggtcgtaggggacaggacttcactccgtacaccatccagaccactagacnccgtagaagtatttgacttagtttacttactgtcagcgagtcgtagctatcgtcggtacctccgtactaccgttcggaccgtacgggaccagcgtaggagactaacgaaacgtacgtcgtcgctacgaacgactacttctacgtccttactacttccccg

SEQ ID NO: 326064 - DNA, 625 bp, Homo sapiens
  misc_feature: GZ8MTXP02HVTGQ.22.38.D05.1.454.CMB.2.raw
  modified_base (421)..(421): a, c, t, g, unknown or other
  misc_feature (421)..(421): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagccccaggaaggccctggaatgggtgcacttattatgggatgacgttaccgctacagtccatctctgaggagagactcacatcccaccaacgaccaacccccaaaacacggtcgtccttacaatcgaccacatcgaccctgtgacacacgccactattactttcngtgacacactctaataggagcaccgtggtagtctcgaccaaacgttcggttacccgaccccgttcgggggacccccgggtaaacccgttcgggtacccacccggttcctcccgtaccgaaccggtcccccttaacccgaaacccggtaaaaccgggggccccctaacggtttccccgggttccccttttccccccggtccgggg

SEQ ID NO: 326065 - DNA, 607 bp, Homo sapiens
  misc_feature: GZ8MTXP02JLJXQ.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggtgcacttattattgggatgacggttaccgcgtacagtccatctctgaggaggagactcaccatacccaccaacggaccaacccccaaaaccacggtgggtccttaacaaatcgacccaccatacggaccctagtcggacacacgccaacatattctagtgcacactctataggagcacctggtagtcctggaccctaaacgtcgggtttaccgaacccccgttcgggggcccccggtaaacccgtcgggtaccgacccggttcacccgtcacggccctaacccgaccgtaacggggccctacgtcccggtcccttcccccgtcgg

SEQ ID NO: 326066 - DNA, 604 bp, Homo sapiens
  misc_feature: GZ8MTXP02IM3HJ.22.38.D05.1.454.CMB.2.raw
  modified_base (332)..(332): a, c, t, g, unknown or other
  misc_feature (332)..(332): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgccccaggaaaggtcctggaatgggtgcacttattatggatgacggttaccgctacagtccatctctgaggaganactcacatccaccaacggaccaacccccaaaacacggtcgtccgttaacaatacgaccaccagtcggaccctgtcgacacacgccaactattatttctgtcacacacttctataggacgctacgtaggtagtctacgacctaaaacgttcgggttacccgaccccggtcgggggacccccgggaccgttcggtccctacccggtcctcccgtccgaccgccctaaccgaaccgaaccgggcccacgtcccggtttcccttccccgtcccggg

SEQ ID NO: 326067 - DNA, 635 bp, Homo sapiens
  misc_feature: GZ8MTXP02HTH1U.22.38.D05.1.454.CMB.2.raw
  modified_base (376)..(376): a, c, t, g, unknown or other
  misc_feature (376)..(376): n is a, c, g, or t
  modified_base (412)..(412): a, c, t, g, unknown or other
  misc_feature (412)..(412): n is a, c, g, or t
  modified_base (443)..(443): a, c, t, g, unknown or other
  misc_feature (443)..(443): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggtgcacttattatgggatgacggttacgctacagtccatctctgaggagagactcacatcccacaacgacaacccccaaaacacggtgtccttanaaatgaccaccatcgaccctgtggacacagcccaanattactttctgtgacacactctaataggganctacctggtagtcgtagacctaaaacgtcggttaccggaccccgttcgggggacccccggtaacccccgttggggaccctaacccggttcctcccgttaccgaccggtaccccttccccgaaacccggaaaacccgggggtccccctaacggtttcccccgggtacccccgttttaccccccgtcccggggg

SEQ ID NO: 326068 - DNA, 666 bp, Homo sapiens
  misc_feature: GZ8MTXP02G34TB.22.38.D05.1.454.CMB.2.raw
  modified_base (341)..(341): a, c, t, g, unknown or other
  misc_feature (341)..(341): n is a, c, g, or t
  modified_base (440)..(440): a, c, t, g, unknown or other
  misc_feature (440)..(440): n is a, c, g, or t
  modified_base (465)..(465): a, c, t, g, unknown or other
  misc_feature (465)..(465): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctggttctcactcaactctagtggagtgggtgtgggctggtccgtcacgccccgaggaacggccctggaatgggtgctacttagttatggatgacggtacgctacagtccatctctggaggagagactcaccancccaaccaacgaacccaaacccccaaaacgacggtacgtaccttaacaatcgaccacacgacgacccgtagcggaccaacacgaccactattactttcngtcacaactactctaagtacggtanaccgtaccgtggtacgtaccgtacgtaacccgtaacgttccgggttacccccggaccccgggttacccggggggtacccccggaaaccccgttcggggtacccctaacccggttcccgtcccctcgaaccgtcccccgtaacccgaacccggtaaaccgggcccctaacggtcccccgggtttaccctcccccgtcccggg

SEQ ID NO: 326069 - DNA, 574 bp, Homo sapiens
  misc_feature: GZ8MTXP02HG3DQ.22.38.D05.1.454.CMB.2.raw
  modified_base (422)..(422): a, c, t, g, unknown or other
  misc_feature (422)..(422): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggttgcacttatttatggatgacggttaccgctacagtccatctctgaggaggagactcacatccaccaagacaaccccaaaaaccagtgccttacaatcgaccaccatcggaccctgtggacacagcacatagttctgtancacactctataggagcacctggtaacgtctagacctaaaacgtggttaccgaacccccgtcgggggacccggaaaccccgtgggtacccaccggtcctcccgtcacgtccctccgaaccaaacgggcccagtcccggtccttcccccgccgg

SEQ ID NO: 326070 - DNA, 693 bp, Homo sapiens
  misc_feature: GZ8MTXP02IF2CD.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgccccaggaaaggccctggaagtgggtgcacttatttagttggatgacggttaccgctacagtcatctctgaggaggagactcacatccaccaacgaccaacccccaaaacaggtcgtccttacaatacgacccaccatacgccctgtggacacacgccaactattacgtttctcgtgacctacaaccttacctaagttaagggacgaccgtacccgttagggtacgttaccgtacggtaaccctaaaaccggttcggggtttaccccggaaccccccgggttacggggggacccccccgggggtaaaacccgttccgggggtaaccctaccccggtccgttacccctccgtaacccggtcccctaaccccgacccggtaaaacggggccccctaacggtttcccccgggttacccgttttccccccgtcccgggg

SEQ ID NO: 326071 - DNA, 617 bp, Homo sapiens
  misc_feature: GZ8MTXP02JLIT8.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaacggccctggaatgggtgcacttattatggatgacgttacgctacagtccatctctgaggagagactcaccatccaaccaacggaccaaacccccaaaacgaggtacgtccttaacaatcgaaccaccactcggacccctgtacggaaccacgacgccaacctattactttctggtcactacactctagtaggacgctaccgtggtaacgtctacggaccctaaacgttcgggttacccgaccccgttcgggggacccccggggtaaccctggggtaccctaaccggttccttcccacgaccgtcccaaccgaaccgaacgggcccctagtcccggtccttcccccgcgg

SEQ ID NO: 326072 - DNA, 611 bp, Homo sapiens
  misc_feature: GZ8MTXP02JDHT8.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggcgtggttccgtcgacgccccaggaaaggccctggaagtgggttgctacttatttagtgggatgtacggttaccgctacagtccatctcgtgaggagagactcaccatacccaccaacgaccaaaccccaaacgagtcgtcctacatcaccaccagtcgaccctgcgacacacgacactattacttctagtcacctaactacttctaaagtacggtacgaccgtaaccgtaggtacgtctacggtacccaaacgttcggttacccgaccccggtcgggggaccccggaaccgtcgggtaccacccggtcctccgtaccgaccgtcccaaccgaccgaaaccggtccacgtccggtccctcccgtccgg

SEQ ID NO: 326073 - DNA, 711 bp, Homo sapiens
  misc_feature: GZ8MTXP02J17LS.22.38.D05.1.454.CMB.2.raw
  modified_base (285)..(285): a, c, t, g, unknown or other
  misc_feature (285)..(285): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgccccaggaacggccctggaatgggttnctacttattagttgggatggacggttaccgctacagtccatctctaggaggaggagactcacactccaccaacggaccaaacccccaaaacaggtacggtcctaacaactcgaccaccgactacggacccctgtcggaaccacgacgaccactattatttcctgtcgaccactaccttactagtaacggagtcccgtaaaccgttgggttaacgtccttaccggaacccctaaaaccggttcgggtttacccccgggaaccccccgggtttaccggggggacccccccggggtaaaaccccgttcggggtaccccctaaccccgggttccttccccgttaccgaacccgtcccccgtaaccccgaacccggaaaccgggtcccccgtaaccgttcccgggttaccccctttcccccggtcccgggg

SEQ ID NO: 326074 - DNA, 614 bp, Homo sapiens
  misc_feature: GZ8MTXP02JEWX8.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggtgcacttatttattgggatgacggttaccgctacagtccatctctgaggaggagactcacatccacaagaccaccccaaaacagtcgtcctacatagaccacatcggaccctgagacacagccacatactttctgtgacactactctagtacggagcaccgtggtacgtctaggacccaaacgttcggttaccgacccccgtgggggacccccggtaacccgtcgggtacccgtaacccggttcctcccgtccgtaaccgccccgtaacccgaaccccggaacggggtaccccctaacgttccccgggttcccctttcccccgtacccgggg

SEQ ID NO: 326075 - DNA, 607 bp, Homo sapiens
  misc_feature: GZ8MTXP02G9NR7.22.38.D05.1.454.CMB.2.raw
  modified_base (425)..(425): a, c, t, g, unknown or other
  misc_feature (425)..(425): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggtgcacttatttattgggatgacggttaccgctacagcccatctctgaggaggagactcacatccaccaagaccaacccccaaaacaggtcgtcctacaatacgaccaccatcggaccctgtagacacacgccacatactttcntgcacactctatagagcaaccgtggtaatctgaccctaaacgtcggttacccgacccccgttcgggggacccccgggtaaaccccttcgggtacccgtacccggtcctcccttaccaaccggccctaacccgaacccgaacggggcccctaacgttcccggtccccgtttcccccgtccggg

SEQ ID NO: 326076 - DNA, 535 bp, Homo sapiens
  misc_feature: GZ8MTXP02HMCSI.22.38.D05.1.454.CMB.2.raw
  modified_base (415)..(415): a, c, t, g, unknown or other
  misc_feature (415)..(415): n is a, c, g, or t
tcagacatacgcgtcacgaccggtgctcgatttagtatctgatagttgggtttgggggaggaactgctcagttaggacccagagggaaccatggaagccccagctcagcttctcttcctcctgctactctggctcccagataccaccggagaaattgtgttgacacagtctccagccaccctgtctttgtctccgggggaaagagccaccctctcctgcagggccagtcagaatgttagtagttacttagcctggtaccagcaaaagcctggccaggctcccagactcctcatctctgatacatccaaacgagggccactggcatccccagccaggttcagtgcaggtggtctgggacagacttcactctcacatcagcgactagacgcctagaatattttgctagttttatacngtcagcagctagctagtctcggccttccgactacgttgggaccgaaggggccaaaggcctaggacgtataccgaaaacgctaggtcgctgaacacacgttctggttactctactttcccg

SEQ ID NO: 326077 - DNA, 564 bp, Homo sapiens
  misc_feature: GZ8MTXP02G678Y.22.38.D05.1.454.CMB.2.raw
  modified_base (190)..(190): a, c, t, g, unknown or other
  misc_feature (190)..(190): n is a, c, g, or t
  modified_base (396)..(396): a, c, t, g, unknown or other
  misc_feature (396)..(396): n is a, c, g, or t
  modified_base (428)..(428): a, c, t, g, unknown or other
  misc_feature (428)..(428): n is a, c, g, or t
  modified_base (450)..(450): a, c, t, g, unknown or other
  misc_feature (450)..(450): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtacgaaacccacacagaccctnacgctgacctgcaccttctctggttctcactcaactctagtggagtgggtgtggctggtcgtcacgccccaggaagcctggatggtgctattattagtggatggacggtcgctacacgtccatctcgtagaggaggacgactacacactacccaacgaacgacccaaacccccgaaaacgacggtacgtcctaacatacgaccacntacgacctagagacacacgaccatattcttcnggtcactacacttcaagtgacncgacgtgactcgcaccgtaacgtcggtacccgaccggtcggggacccgtaccgtggccctacggtctaccgtcaactcccgaaccgaccgacggcctacgtccgtcctccgccg

SEQ ID NO: 326078 - DNA, 650 bp, Homo sapiens
  misc_feature: GZ8MTXP02G3OUN.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgccccgaggaaacggccctggaatgggtgctacttattatggatgacgtaccgctacacgtccatctctgaggaggagactcgacatacccaaccaacggaaccaaacccccaaaacgcggtacggtccttaacaactacgacccaccacgtcggaccctgtacggaaccacacgaccaactattactttctggtacacctaactaacctacttaaacgtagggacacctaccgttaggtacgtaccgtacgacctaaacggttcggtacccgaccccggtccggggtacccgggaaacccgttcggtacccgtaccgtccgtcccttacgaccggacctaacccgaccggaaccggtacccgacgttacccggtcccgttaccccgtcccgg

SEQ ID NO: 326079 - DNA, 646 bp, Homo sapiens
  misc_feature: GZ8MTXP02FRQPR.22.38.D05.1.454.CMB.2.raw
  modified_base (439)..(439): a, c, t, g, unknown or other
  misc_feature (439)..(439): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagccccaggaaaggccctggaatgggtgcacttattattgggatgacggttaccgctacagtccatctctgaggaggagactcacatccaccaagacaacccccaaaacaggtcgtcctacaatgaccaccatcggaccctgtcgacacagccaatatatttctagtgacacactctataggancacgtggtagtctacgacctaaaacgtcgggttacccgaccccggttcgggggacccccgggtaaacccgttcggggtaccctaaccccgggttcctaccccgttaccgaccggtacccccgttaaccccgaaacccccggaaaccgggggtacccccctaacggtttccccggggttaccccctttacccccccggttcccggggg

SEQ ID NO: 326080 - DNA, 660 bp, Homo sapiens
  misc_feature: GZ8MTXP02JZWGP.22.38.D05.1.454.CMB.2.raw
  modified_base (454)..(454): a, c, t, g, unknown or other
  misc_feature (454)..(454): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtggggtgtgggctggttccgtcagccccaggaaaggccctggaatgggttgcacttattattggatgacggttaccgctacagtccatctctgaggaggagactcaccatccaccaacggaaccaacccccaaaaaccaggtacggtccttaacaaatacgaccaacccaactacggacccctgtacgggaacaccaagacccaacacttatttactgtncaacactctaagtaggacgcaccgtggtaatctagacctaaaacgtcggttaccgacccccgtcgggggacccccgggaaaacccgtcggtacccgtaacccggtccttacccgtaccgaaccggtccccttaaccccgaaccccgaaaaccgggggccccctaaacggttcccggggttacccctttcccccccgttacccgggg

SEQ ID NO: 326081 - DNA, 723 bp, Homo sapiens
  misc_feature: GZ8MTXP02GL5WA.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggtccgtcacgccccaggaaggccctggaatgggtgctacttattagtggatgacggttaccgctacagtccatctctggaggaggagactcaccatcccaaccgaaacggaaccaaaccccccaaaaacgacggtacggttcccttaacaaatacgacccaaccagtaccggacccctgtacggaaccacacgacccaactattactttcgtggttacacctaacctacttacctaaagttacgggaacgtccctaaacccggtttgggtaaccgttacgtaccggtaacccgtaaaacggtttccggggtttacccggacccccgggttacggggggaccccccgggtaaacccgttcgggtaccccgtaacccggttccttaccccgtaccgaaccggtccccctaacccgaaccccggaaaccgggggtccccctaacggtttccccgggttcccctttccccccggcccggg

SEQ ID NO: 326082 - DNA, 590 bp, Homo sapiens
  misc_feature: GZ8MTXP02JIXO3.22.38.D05.1.454.CMB.2.raw
  modified_base (399)..(399): a, c, t, g, unknown or other
  misc_feature (399)..(399): n is a, c, g, or t
  modified_base (429)..(429): a, c, t, g, unknown or other
  misc_feature (429)..(429): n is a, c, g, or t
  modified_base (449)..(449): a, c, t, g, unknown or other
  misc_feature (449)..(449): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgccccaggaaaggccctggaatgggtgcacttattagtggatgacggttaccgctacagtccatctctgaggaggagactcacatcccaaccaacggaccaaacccccaaaacacggtacggtccttacaatacgaccacancgaccctgtcgacacacgcacattacttcngtgcacactctaagtagganccaccgtggtacgttcacgacctaaacgttcggttacccgaccccgggtccgggggtacccccgggtaaccgtcggggtaccctacccggtctaccccgtcacgcccctaacaccgacggccacgtcgtccctcccgtcgg

SEQ ID NO: 326083 - DNA, 651 bp, Homo sapiens
  misc_feature: GZ8MTXP02F1YL6.22.38.D05.1.454.CMB.2.raw
  modified_base (283)..(283): a, c, t, g, unknown or other
  misc_feature (283)..(283): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgccccaggaaagccctggaatgggtnctacttattagtggatgacggttacgctacagtccatctctgaggaggagactcaccatcccaaccaacgaaccaaacccccaaaacgacggtacggtcctaacaaactacgacccaccatcggaccctgtagaccacacgaccaactattactttccgtagttcacctaactacttaccttaagacgggacacctaccgttagggtaacgtcgtacgtacctaaacgttcgggttacccgacccccgggttcgggggacccccggtaaccgtcggtaccctacccggttcctcccgtaccgaccgccccgtaacccgaaacccgaacgggaccccctacggtcccggttccccttcccccggtcggg

SEQ ID NO: 326084 - DNA, 582 bp, Homo sapiens
  misc_feature: GZ8MTXP02GA5KS.22.38.D05.1.454.CMB.2.raw
  modified_base (428)..(428): a, c, t, g, unknown or other
  misc_feature (428)..(428): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggtgcacttattatgggatgacggttacgctacagtccatctctgaggaggagactcaccatcccaccaacgaccaaacccccaaaacaggtacgtccttacaatcgaccaccatcgaccctgtcgacacagccaacatacttctgtncacactctataggagcaccgtgtagtctagaccaaacttcgggttaccgaccccgtcgggggaccccggtaacccgtcgggtacccaccggtcctcccgtacaccgccctaacccgaccgaacgggtccccagttccggccctttcccccgcgg

SEQ ID NO: 326085 - DNA, 667 bp, Homo sapiens
  misc_feature: GZ8MTXP02GU4Z2.22.38.D05.1.454.CMB.2.raw
  modified_base (485)..(485): a, c, t, g, unknown or other
  misc_feature (485)..(485): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgcccccgaggaaacggccctggaagtgggttgctacttatttagtgggatggacggttaccgctacagtccatctctggaggaggagactcaccatcccaaccgaaacggaacccaaaccccccaaaaacgacgggttacggttacccttaaacaaacgtaccgaacccaacccaacgtacgggacccctagtacggaaccacgacggacccaatacttaacttttcngttacaccaactaccttactaagtagggacgccgtaccgttaggtacgtccgtacgacccgtaaacgttcgggttacccgacccccgggtcgggggaccccggtaacccgtcggtaccctaccgttcctcccgtcaccgtcccaacccgaacgacggccctagtcccggtcctccccgtcgg

SEQ ID NO: 326086 - DNA, 782 bp, Homo sapiens
  misc_feature: GZ8MTXP02GPQKA.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggtccgtcacgccccaggaaggccctggaatgggtgcacttattattgggatgacggttaccgctacagtccatctctgaggaggagactcaccatacccaaccaacggaacccaaacccccaaaaaccgacggttacgggttacccttaaacaaactacgaacccaaccgtaacgtacgggacccctggtacggaaccaaccgaacggcccaaactattaacttttctaggttcaccaactaaccttacctaaagttaacgggacgtacccgtaacccgttagggttaacgttaccgttacggtaacccgtaaaaccgtttccggggtttaaccccgggaccccccgggtttacccgggggggaacccccccgggggtaaaacccccggtttccggggttaccccgtaaccccgggttccccgttacccctacccgtaaccggttaccccctaaccccgaaaccccggaaacccggggtacccccgtaacgtttcccccggggtttacccccgtttcccccccggttccccgggg

SEQ ID NO: 326087 - DNA, 756 bp, Homo sapiens
  misc_feature: GZ8MTXP02HOUE8.22.38.D05.1.454.CMB.2.raw
tcagacatacgcgtcacgaccggtgctcgatttagtatctgatagttgggtttgggggaggaactgctcagttaggacccagagggaaccatggaagccccagctcagcttctcttcctcctgctactctggctcccagataccaccggagaaattgtgttgacacagtctccagccaccctgtctttgtctccggggaaagagccaccctctcctgcagggccagtcagaatgttagtagttacttagctggtaccagcaaagcctggccaggctcccagactcctcatctctagatacatacccaaacgacgggcccaacgtcggacactccccgagccccgtaggtttcccaaggtcggacgtaggttcggggtcgtacggggactaacggtacctttccaacttcctacctaacccaacttacccgaacggccccgtaaacccgttaaacgggaaccgtacccgttaaggtaaaagttaacgttttttacggacccgttttaaaggtttttaacttttaacgttcgggttacaaacggtccgtaaagggtcccgttaaagtcttaaacgttccgttaccggggtccccctttacccggttaacccttaacccggtttcggggaccccggtaaagggggtacccctaaaggccgttaggggaacggtaaacttaaccggaaaacggtaaacttcgggaacgggtctacggaacctaccgtaacttcttggttaccctttactaactttccccg

SEQ ID NO: 326088 - DNA, 555 bp, Homo sapiens
  misc_feature: GZ8MTXP02FJ1OQ.22.38.D05.1.454.CMB.2.raw
  modified_base (282)..(282): a, c, t, g, unknown or other
  misc_feature (282)..(282): n is a, c, g, or t
  modified_base (376)..(376): a, c, t, g, unknown or other
  misc_feature (376)..(376): n is a, c, g, or t
  modified_base (510)..(510): a, c, t, g, unknown or other
  misc_feature (510)..(510): n is a, c, g, or t
  modified_base (516)..(516): a, c, t, g, unknown or other
  misc_feature (516)..(516): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcatgctgacctgcaccttctctgggttctcactcaactctagtggagtgggtgtgggctggttccgtcacgccccaggaaggcctggaatgggtncacttatttattggatgacggttaccgctacagtccatctctgaggagagactcacactcaccaagaccaacccccaaaaccaggtcgtcctanaactcgaaccacatcggaccctgcggacacagccacattattctgtgcacactctagtaggacacaccgtggtagtctgaccaacgtggtcccgaccccgtcggggaccccggacctcggtccaccgtctcccncgaccncctacccgaaccgacggcccacgtccggtcctcccccgg

SEQ ID NO: 326089 - DNA, 525 bp, Homo sapiens
  misc_feature: GZ8MTXP02IZW1R.22.38.D05.1.454.CMB.2.raw
  modified_base (477)..(477): a, c, t, g, unknown or other
  misc_feature (477)..(477): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagccccccaggaaaggccctggaatgggtgcacttattattggatgacggttaccgctacagtccatctctgaggaggagactcaccatccaccaacggacacccccaaaacacggtcgtccttacaatcgaccaccatcggaccctgtgacacagccacattattctgtgcacactctatagagcacctgtagctgcaaatgtcgaccctgggccggaccngtcacgtctcctcacgcctcaccgacggcccatcggtcttcccctcgg

SEQ ID NO: 326090 - DNA, 703 bp, Homo sapiens
  misc_feature: GZ8MTXP02GCJAW.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgccccaggaacgccctggaatgggtgcacttattatggatgacgtaccgctacagtcatctctgaggagagactcaccatacccaaccaaacgaacccaaaacccccaaaaacgacggtacggtacccttaacaaactacgaacccaccagtacgaccctagtacggaaccaacaacgcccaaactaacttaactttctaggtacgacctaacctaaccttacgtaaagttaacgggacgacccgtaaaccgttggtaaacgttcgtacgtaaccctaaaacggttcggtaccccggtacccccggtaccgggggacccccggtaaacccgtcgggtaccctaacccggttcccttccccgtaccgacccgtaccccgtaacccgaacccgaaaccgggggtccccctaacggttccccggttaccccgtttccccccgtcccggg

SEQ ID NO: 326091 - DNA, 640 bp, Homo sapiens
  misc_feature: GZ8MTXP02H146R.22.38.D05.1.454.CMB.2.raw
  modified_base (281)..(281): a, c, t, g, unknown or other
  misc_feature (281)..(281): n is a, c, g, or t
  modified_base (342)..(342): a, c, t, g, unknown or other
  misc_feature (342)..(342): n is a, c, g, or t
  modified_base (406)..(406): a, c, t, g, unknown or other
  misc_feature (406)..(406): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagccccaggaagccctggaatgggtncacttatttattgggatggacggttaccgctacagtccatctctgaggagagactcacacnccaccaaacgaccaacccccaaaacaggtacgtccttaacaatacgaccaccatacgaccctgngacacacgccatattatttctgtacgccactaacttctaacgtaggacgaccgtacggttgggtaactccgtacgaacccgtaaacgttcggggttaccccgacccccgggtcgggggacccccggtaaacccgttcgggtaccctacccgttccgtccctacgaccgaccccttaacccgaacccggaacggggtcccccacggttccccggttcccctttacccccggccgg

SEQ ID NO: 326092 - DNA, 571 bp, Homo sapiens
  misc_feature: GZ8MTXP02IKYYX.22.38.D05.1.454.CMB.2.raw
  modified_base (271)..(271): a, c, t, g, unknown or other
  misc_feature (271)..(271): n is a, c, g, or t
  modified_base (362)..(362): a, c, t, g, unknown or other
  misc_feature (362)..(362): n is a, c, g, or t
  modified_base (398)..(398): a, c, t, g, unknown or other
  misc_feature (398)..(398): n is a, c, g, or t
  modified_base (433)..(433): a, c, t, g, unknown or other
  misc_feature (433)..(433): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagccccaggaagcccnggaatgggtgaacttattattggatgacggttaccgctacagtccatctctgaggaggagactcacatcacccaagaccaaccccaaaacnggtacgtaccttacaatgaccaccatcggaccctgngacacagcacatattctatgcacactctataggancaacctggtacgtctcgaccaaacgttcggttacccgaccccgttcgggggacccccggtacccgtcgggtccacccggtctccctcaccgccctaccaacccgaacggccctacgcgtcccttcccccgtggccccg

SEQ ID NO: 326093 - DNA, 619 bp, Homo sapiens
  misc_feature: GZ8MTXP02HP6BT.22.38.D05.1.454.CMB.2.raw
  modified_base (429)..(429): a, c, t, g, unknown or other
  misc_feature (429)..(429): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaggccctggaatgggtgcacttattattggatgacggttaccgctacagtccatctctgaggaggagactcaccatcccaaccaacggaccaacccccaaaacagtcggtccttacaatgaccaccatcgaccctgtaggacacagccacattactttctgtnacacacttactagttacggagcctaccgtagggtactcgttacgaccctaaaacgttcggtttacccgacccccggttcgggggacccccgggtaacccgttcgggacccgtaccggttccctccctcgaccgtcccctaacccgacccgaaacggggtcccccagttcccggtccctttcccccgccgg

SEQ ID NO: 326094 - DNA, 649 bp, Homo sapiens
  misc_feature: GZ8MTXP02FMCUY.22.38.D05.1.454.CMB.2.raw
  modified_base (592)..(592): a, c, t, g, unknown or other
  misc_feature (592)..(592): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgccccaggaaaggccctggaatgggtgcacttatttattggatgacggttaccgctacagtcatctcgtgaggaggagactcaccataccccaccgaacgaacccaaacccccaaaaaccgacggttacggtcccttaacaaactacgaacccaaccaacgtcgggaacccctggtacggaaccacgacgacccaactacttaacttttctgtgaccacctactactagtaggacgacctaccgtgtacgtcctagaccctaaacgttcgggttacccgtaccccggtcgggggacccccggaacccgtcggtacccgacccgtctcccgtaccncgtccccgtaacccgaccgaaacgggccccaacgtcccggtccctttcccccgccgg

SEQ ID NO: 326095 - DNA, 522 bp, Homo sapiens
  misc_feature: GZ8MTXP02FU7YY.22.38.D05.1.454.CMB.2.raw
tcagacatacgcgtcacgaccggtgctcgatttagtatctgatagttgggtttgggggaggaactgctcagttaggacccagagggaaccatggaagccccagctcagcttctcttcctcctgctactctggctcccagataccaccggagaaattgtgttgacacagtctccagccaccctgtctttgtctccggggaaagagccaccctctcctgcagggccagtcagaatgttagtagttacttagcctggtaccagcaaaagcctggccaggctcccagactcctcatctctgatacatccaacaggccactggcatcccagccaggttcagtggcaggtcgggtctggggacagtacttcactctcacatcagcgacctagacgctgaagtatttgctagtttattactgtcagcagcgtagctatctcggcctccgtactccgtttcggaccgtaggggaccaaggctaggagatacgaaacgaactgtacgctgcaccgatctgtctcattcccg

SEQ ID NO: 326096 - DNA, 622 bp, Homo sapiens
  misc_feature: GZ8MTXP02IXRWX.22.38.D05.1.454.CMB.2.raw
  modified_base (432)..(432): a, c, t, g, unknown or other
  misc_feature (432)..(432): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtagaaacccacacagaccctcacgctgacctgcaccttctctggttctcactcaactctagtggagtgggtgtggctggttccgtcacgccccaggaacgccctggaatgggtgctacttattagtggatgacgttaccgctacagtccatctctagaggaggagactcaccatcccaaccgaacgaccaaacccccaaaacgaggtcgtaccttacaatcgaccaccagtacgacctgacgacacacgaccaactattacttngtcacactaactctaagtaacggacgtacctacgttagggtactctacggtaaccctaaaacggttcgggtttaccccgacccccgggtcgggggtacccccggtaaacccgttcgggtccctaacccggttcctccgtaccaccgtcccaaccgaccgaacggccctacgtcccgtcccttcccgccgg

SEQ ID NO: 326097 - DNA, 600 bp, Homo sapiens
  misc_feature: GZ8MTXP02IS0II.22.38.D05.1.454.CMB.2.raw
  modified_base (437)..(437): a, c, t, g, unknown or other
  misc_feature (437)..(437): n is a, c, g, or t
  modified_base (447)..(447): a, c, t, g, unknown or other
  misc_feature (447)..(447): n is a, c, g, or t
  modified_base (451)..(451): a, c, t, g, unknown or other
  misc_feature (451)..(451): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgccccaggaacggccctggaatgggtgctacttattagtgggatgacggtaccgctacagtccatctctgaagaggagactcaccatccaaccacggaacccaaacccccaaaaacgacggtacgtcctaacaactacgacccaccatcggacctgtgacacagccacattattctgtcncacactctanaggncactggtactctagacctaaacgtcggttaccgaccccgtacgggggcccccgggtaaccgtcgggtacccgtacccgtctccctaccgaccggtccctaacccgaacccgaacgggcccctacgtcccggttccctcccccgtccggg

SEQ ID NO: 326098 - DNA, 647 bp, Homo sapiens
  misc_feature: GZ8MTXP02JB0EP.22.38.D05.1.454.CMB.2.raw
  modified_base (455)..(455): a, c, t, g, unknown or other
  misc_feature (455)..(455): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagccccaggaaacggccctggaatgggtgcacttatttattgggatgtacggttaccgctacagtccatctctgaggaggagactcaccagtacccaaccgaaggaacccaaacccccaaaaaccgaggtacggtaccgttaacaactcgaacccacacgtcggaccctgtacgaccacagcccaactattacttctgtnacactactcctaagtaggacacaccgttaggtacgtcgtacgaccctaaaacgttccgggtttacccgaacccccggtcgggggtacccccggaacccgttggggtcccctacccggttcctaccctcgaaccggtccctaacccgaccggtaacggccccaggttccccggttcccttcccccgtaccggg

SEQ ID NO: 326099 - DNA, 622 bp, Homo sapiens
  misc_feature: GZ8MTXP02ISKJF.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtagaaacccacacagaccctcacgctgacctgcaccttctctgggttctcactcaactctagtggagtgggtgtgggctggttccgtcagccccaggaaaggccctggaatgggtgctacttatttatgggatgacggtaccgctacagtccatctctgaggaggagactcaccataccaccaagaaccaacccccaaaaacacggtacggtccttaacaactacgaacccaccgaatcggaccctgtacggaacacacgaccaactattactttctgtagacacacttctaagtaggagcactggtacgtctagactaaacgtcggttaccgacccgtacgggggaccccggtaaccgtcgggtcctaacccggttcctcccgtacacccggtaccctaacccgaacccgaacggggtacccctacgttcccgggttcccttcccccggtcgg

SEQ ID NO: 326100 - DNA, 649 bp, Homo sapiens
  misc_feature: GZ8MTXP02J1370.22.38.D05.1.454.CMB.2.raw
  modified_base (463)..(463): a, c, t, g, unknown or other
  misc_feature (463)..(463): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggttgcacttatttattgggatgacggttaccgctacagtccatctctggaggaggagactcaccatcccaaccaacggaccaacccccaaaaaccacggtacggtccttaacaactcgaccaccatcggaccctgtcggacacacgacccacattatttctgtgcacactctaagtaggganctaccgtggtactcgtacgacctaaacgtcgggttacccgacccccggtcgggggacccccgggtaaccctgggtacccctacccggttcctcccgttaccgaaccggtccccctaaccccgaaaccccggaaaccgggggtccccctaacggtttccccgggttcccctttcccccggtcccggg

SEQ ID NO: 326101 - DNA, 648 bp, Homo sapiens
  misc_feature: GZ8MTXP02IAYKK.22.38.D05.1.454.CMB.2.raw
  modified_base (255)..(255): a, c, t, g, unknown or other
  misc_feature (255)..(255): n is a, c, g, or t
  modified_base (421)..(421): a, c, t, g, unknown or other
  misc_feature (421)..(421): n is a, c, g, or t
  modified_base (431)..(431): a, c, t, g, unknown or other
  misc_feature (431)..(431): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggtccgtcncgccccaggaaagccctggaatgggtgcactattatggatgacgttacgctacagtcatctctgaggaggagactcaccataccaccaaacgaccaaacccccaaaaacacggtcgtaccttaacaaatcaccaaccagtcgaaccctgtggaacacacgcccaanatatttctgngcaacacttcctaatagggacactacccgtaggtagttactacgaccaaaacgttcggttccggaaacccccgttcgggggtacccccgggaaaaccccttggggttaacccaaccccgggttccttaacccccgtccgtaacccgtacccgtaaccccgtaacccgaaccggtaccccgtacccgtacccggttaccccgtttacccccgtcccgg

SEQ ID NO: 326102 - DNA, 654 bp, Homo sapiens
  misc_feature: GZ8MTXP02HT3QM.22.38.D05.1.454.CMB.2.raw
  modified_base (451)..(451): a, c, t, g, unknown or other
  misc_feature (451)..(451): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggtccgtcacgccccaggaaaggccctggaatgggtgctacttatttagttggatgacggttaccgctacagtcatctcgtgaggaggagactcaccatcccaaccaaacggaccaacccccaaaaaccgaggtacggttcctaacaaactcgacccaccactacggaccctgtacggaccacacgacccaacgtacttatttcngtcgcaacactctaataggacgcctacgttggtacgtcgtacgacccgtaaacgttcgggttacccggaccccggttacgggggacccccgggtaaacccgtttccggggaccctacccgggttcctcccgttccgaaccgtcccgtaaccccgaccgaaacggggtcccccagtttccccgggtccctttcccccggcccgg

SEQ ID NO: 326103 - DNA, 661 bp, Homo sapiens
  misc_feature: GZ8MTXP02JU9QQ.22.38.D05.1.454.CMB.2.raw
  modified_base (618)..(618): a, c, t, g, unknown or other
  misc_feature (618)..(618): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggttgcacttattatgggatgacggttacgctacagtccatctctgaggaggagactcaccatccaccaacggaacccaacccccaaaaaaccgacgggtacggttacccttaaacaaatacgaacccaaccaacgtcgggaaccccctgtacgggaaccaacacgacccaactattaactttcctgttcgaccactaacctctaagtaggacgcaccgttgggttaactcgtacgacccgtaaaacgttcgggttacccggaaacccccgggtcggggggtacccccgggtaacccgttcgggtacccgtacccgttccgtccctccgacgtccccncccgaaccgtaacgggcccacgtcccggttcctcccccgtcgg

SEQ ID NO: 326104 - DNA, 598 bp, Homo sapiens
  misc_feature: GZ8MTXP02FP3OS.22.38.D05.1.454.CMB.2.raw
  modified_base (426)..(426): a, c, t, g, unknown or other
  misc_feature (426)..(426): n is a, c, g, or t
  modified_base (429)..(429): a, c, t, g, unknown or other
  misc_feature (429)..(429): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggtgcacttattatgggatgacggttaccgctacagtccatctctgaggaggagactcaccatccaaccaagaccaacccccaaaaacacggtcggtcctacaatcgaccaccatcggaccctgtcgacacacgccacatatttcngtnacacactctagtacggacgcaccgtggtacgtctacgacctaaacgtcggtaccgacccccgttgggggacccccggtaacccgtcggggtaccctaccggtcctcccgtacgacgtaccctcccgaaccgaaacgggtccccacgtccggtcccttcccccgtccggg

SEQ ID NO: 326105 - DNA, 654 bp, Homo sapiens
  misc_feature: GZ8MTXP02I28FQ.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcacctgaaggagtctggtcctacgctggtacgaaacccacacagaccctcacgctgacctgccaccttctcgtggttctcactcaactctagtggagtgggtgtgggctggttccgtcacggacccccgaaggaaacggccctgggaagtgggttgctacttatttagtggatgtacggttaccgctacagtccatctcgtggaggagagactcacatacccaaccaaacggaacccaaacccccaaaacgacggtacgtacctaacaactacgaccacacgtacgaccctagtacgaacacacgaccaactatttactttctgtacgacctaactactacgtaagtaacgggactaccgtaaccggttggttaacgtctacgtaccgtaaacggttccgggtaccggaccccgggtacgggggtaccccggtaaccgttcgtaccgtaccgtcctcccgacgtaccgccctaacccgacgaacggtccctacgtcccgttccgttccccgccgg

SEQ ID NO: 326106 - DNA, 604 bp, Homo sapiens
  misc_feature: GZ8MTXP02G7NAW.22.38.D05.1.454.CMB.2.raw
  modified_base (463)..(463): a, c, t, g, unknown or other
  misc_feature (463)..(463): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgccccaggaacggccctggaagtgggtgctacttattatggatgacggttacgctacagtccatctctgaggagacgactcacatacccaccaacgaacccaacccccaaaacgacggtacgtccttaacaatacgacccacagtcgaccctgtacgacacagccaactattattactgtcaccactaccttctaaagtacggacnctaccgtaggtacgtcgtacgacctaacgtcggttaccgaccccggtcgggggaccccgaccgtcggtacccaccgtcctaccgcaccgccccgtaaccgaaccgaaccgggccctacgtcccggtacccttccccgccgg

SEQ ID NO: 326107 - DNA, 620 bp, Homo sapiens
  misc_feature: GZ8MTXP02H3GME.22.38.D05.1.454.CMB.2.raw
  modified_base (430)..(430): a, c, t, g, unknown or other
  misc_feature (430)..(430): n is a, c, g, or t
  modified_base (441)..(441): a, c, t, g, unknown or other
  misc_feature (441)..(441): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggtccgtcagcccccaggaaaggccctggaatgggtgcacttattatgggatgacgttacgctacagtccatctctgaggagagactcaccatccaccaaagaccaaacccccaaaaacacggttcgtcctaacaatgaccacatggaccctgtacggacacagcccaactattatttctggtncacactctaanaggtagcacctggtaagtctacgaccaaaacgtcgggtttaccgacccccgttcggggggacccccggtaaacccgttcggggtaccctaacccggtccttacccctccgaccgccccgtaacccaaccccgaaacgggccccctaaagttcccccgggttcctttccccccccggcgg

SEQ ID NO: 326108 - DNA, 652 bp, Homo sapiens
  misc_feature: GZ8MTXP02JORVG.22.38.D05.1.454.CMB.2.raw
  modified_base (439)..(439): a, c, t, g, unknown or other
  misc_feature (439)..(439): n is a, c, g, or t
  modified_base (451)..(451): a, c, t, g, unknown or other
  misc_feature (451)..(451): n is a, c, g, or t
  modified_base (457)..(457): a, c, t, g, unknown or other
  misc_feature (457)..(457): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagccccaggaaaggccctggaatgggtgcacttattatgggatgacggttaccgctacagtccatctctgaggaggagactcaccatacccaccaacggaccaacccccaaaaaccgacggtacgggtccttaacaatacgaccaccatcgaccctgtcggaacacagccaacatattctagtnacacactctaanaggacnctaccgtaggtatctacgacctaaacgttcgggttacccgaccccgttacggggggacccccgggtaaacccgttcgggtaccccgtacccgggttccttccccgttaccgacccgtcccgttaaccccgaacccggaaaaccgggggtccccctaacggttccccgggttcccctttcccccggttccccgggg

SEQ ID NO: 326109 - DNA, 603 bp, Homo sapiens
  misc_feature: GZ8MTXP02I4LYF.22.38.D05.1.454.CMB.2.raw
  modified_base (372)..(372): a, c, t, g, unknown or other
  misc_feature (372)..(372): n is a, c, g, or t
  modified_base (420)..(420): a, c, t, g, unknown or other
  misc_feature (420)..(420): n is a, c, g, or t
  modified_base (433)..(433): a, c, t, g, unknown or other
  misc_feature (433)..(433): n is a, c, g, or t
  modified_base (441)..(441): a, c, t, g, unknown or other
  misc_feature (441)..(441): n is a, c, g, or t
  modified_base (451)..(451): a, c, t, g, unknown or other
  misc_feature (451)..(451): n is a, c, g, or t
  modified_base (466)..(466): a, c, t, g, unknown or other
  misc_feature (466)..(466): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgcccccaggaaacggccctggaatgggtgctacttatttatgggatggtacgttacgctacagtccatctctggaggaggagactcaccatccaccaacgacaacccccaaaacnggtcgtcctacaatacgaccacatcggaccctgtaggacacacgccanatactttctagtnacacactntaataggacnccaccgtggtactcngtaccctaaacgttcggtacccgacccggtcgggggacccccggtaaccgttcgggacctacccggttctcccgtcgtaccgtccctaacccgaaccgaacggggtcccacgttcccggttccccttccccgtccgg

SEQ ID NO: 326110 - DNA, 655 bp, Homo sapiens
  misc_feature: GZ8MTXP02IUL4N.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggtctggttccgtcacgccccaggaacggccctggaagtgggtgctactttattagttggatgtacggtaccgctacagtccatctctgaggaggagactcaccactacccaaccaacgaaccaaacccccaaaaccgacggttacgtcctacaactacgaccaccatcgaccctgtacggacacgacgacccaagtattactttactggtacaccactaacctctaagtaacgggtacaccgtaccgtggttacgtccgtacgaaccctaaacggttccgggttaccccgacccccgggtcggggacccccggtaaccgttcggtacccacccggttccctcccgtaccgcccgtcccctaacccgacccgtaaccggcccctacgtccccggttccccttcccccgccggg

SEQ ID NO: 326111 - DNA, 734 bp, Homo sapiens
  misc_feature: GZ8MTXP02HDNGJ.22.38.D05.1.454.CMB.2.raw
  modified_base (279)..(279): a, c, t, g, unknown or other
  misc_feature (279)..(279): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggtcgtcagccccaggaaagcctggaatgggtnctacttatttagtggatggtacggttaccgctacagtccatctcgtgaggaggagactcaccatcccaaccgaacggaaccaacccccgaaaacacggtacgtcccttaacaactacgaaccaacacgtacgggaccctaggtacggaaccaacgacggacccaactacttactttcgtacggttcaccctaactaccgttcctaaagttacggggaactaccgtaacccggttaggttacgtccgttacggtaaccccgtaaaacggtttccggggtttacccccggaaacccccggggttcccggggggtaaccccccggggtaaaacccccgtccggggttaccctaacccccggttcccttccccgtaccgaccggtacccccttaacccgaaacccggtaacgggggtccccctaacggtccccgggttccccgttacccccggtccggg

SEQ ID NO: 326112 - DNA, 694 bp, Homo sapiens
  misc_feature: GZ8MTXP02G8SEA.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaacggccctggaagtgggtgctacttatttatgggatgacgttaccgctacagtccatctctgaggaggagactcaccatacccaccaaacggaacccaaacccccaaaacgacggttacggtaccttaacaaactacgaacccaccgactcgggaacccttggacgaacacacgaccaacctattaactttcgagtcgacctaacgtactccttaaagacgggacgtaccgtaccgtgggttacctacgttacggaaccccttaaaaggtcccgggtttacccgacccccggtaccgggggtaccccgggtaaaccccgttcgggtacccctaacccgtccggttccctacccgaccgtacccctaaccccgaacggaacccggtccctaaccggtttccccggttccccttacccccggtcccggg

SEQ ID NO: 326113 - DNA, 571 bp, Homo sapiens
  misc_feature: GZ8MTXP02GOF1H.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagccccaggaaaggccctggaatgggttgctacttatttattgggatgacggttaccgctacagtccatctctgaggaggagactcaccatcccaccaacgaccaacccccaaaaccacggtacggtccttaacaactcgacccaccactcggaccctgtggacacagccacatattctagtcacacactctaataggacgcacgtgtacgtctagacctaaacgtggttacccgaccccggtcggggaccccggacccgtggtccaccgtctccctcacgcctccaccgacggcccagtccggtcctcccgtcgg

SEQ ID NO: 326114 - DNA, 643 bp, Homo sapiens
  misc_feature: GZ8MTXP02FZM6E.22.38.D05.1.454.CMB.2.raw
  modified_base (466)..(466): a, c, t, g, unknown or other
  misc_feature (466)..(466): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgccccaggaaggccctggaatgggtgcacttattatggatgacgtaccgctacagtccatctctgaggaggagactcaccatcccaccaacgaccaaacccccaaaaccgacgtacggtcctacaactacgaacccaccactcggaccctgtacggaacacacgccaatattatttacgtgtcgaccactacttcctaagtaacggganccgtaccgttaggtaaccgttcgtcgaacccgtaaaacgttccgggttaccgacccccggtccgggggacccccggtaaacccgttcggtacctacccggtcctcccgtaccgaccgtccccaacccgaacccggtaacggtcccctaccgttccggtcccccgtttccccgcccgg

SEQ ID NO: 326115 - DNA, 800 bp, Homo sapiens
  misc_feature: GZ8MTXP02J22G8.22.38.D05.1.454.CMB.2.raw
  modified_base (289)..(289): a, c, t, g, unknown or other
  misc_feature (289)..(289): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtcgaaacccacacacgaccctcacgctgacctgcaccttctctgggttctcactcaactctagtggagtgggtgtgggctggttccgtcacgcccccgaggaacggccctggaagtgggtncgacttatttagtgggatggacggttaccgctacagtccatctcgtagacggaggacgactcaccataccccaaccgaaacggaacccaaacccccgaaaaaccgtcggtacggtaccctaacaaactcgaacctaccgacgtacggaccctaggtacgacaacgacgacccaactatttactttacctaggttcgaccaaccgtaactttaccttaaaggaacggggacctaccgtaaccccggtttagggggttaaccttaccgtttaaccggaccccgttaaaaaccgggtttcccgggggtttacccccgaaaaccccccccgggggttcggggggtaaccccccccggggtaaaaccccgtttccggggaccccgttaaacccccgggttccctccccgttaccggtaaccccggcccccttaaccccgaaaacccccgggaaaccggggtccccccgtaaaggttttccccccggtacccccgttttcccccccgggtcccgggg

SEQ ID NO: 326116 - DNA, 647 bp, Homo sapiens
  misc_feature: GZ8MTXP02JEDZF.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggtcgtcacgccccaggaacggccctggaatgggtgcacttattagttggatgacggttacgctacagtcatctctgaggaggagactcacatacccaccgaacggaacccaaacccccaaaaaccgacggtacgtcctaacaaactacgaaccaaccactacgaccctgtacggacacgacgaccataattactttctgtcgaccaactacctacgtaagtacggacgtacctacccgttggtacgtactacggaaccctaaacgtccggttacccgaccccggtccgggggaccccgggtaacccgtcggttacccgacccggttcctcccgtaccgaccgcccctaacccgaacccggaaccggccccttacgtcccggttccccttccccggtccgg

SEQ ID NO: 326117 - DNA, 576 bp, Homo sapiens
  misc_feature: GZ8MTXP02G4V9S.22.38.D05.1.454.CMB.2.raw
  modified_base (335)..(335): a, c, t, g, unknown or other
  misc_feature (335)..(335): n is a, c, g, or t
  modified_base (360)..(360): a, c, t, g, unknown or other
  misc_feature (360)..(360): n is a, c, g, or t
  modified_base (435)..(435): a, c, t, g, unknown or other
  misc_feature (435)..(435): n is a, c, g, or t
  modified_base (533)..(533): a, c, t, g, unknown or other
  misc_feature (533)..(533): n is a, c, g, or t
  modified_base (535)..(535): a, c, t, g, unknown or other
  misc_feature (535)..(535): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgccccaggaacgccctggatgggtgcacttattatggatgacgtacgctacagtccatctctgaggagagactcacanccaaccaagaccaaccccaaaaacncggtacgtccttaacaaatacgaccaccagacgaccctagtacgacaacacgaccaactattactttcgtagtcncaactactactagtaggacgactaccgtgtacgtctacgaccaaacgtcggttaccgacccgtcgggggaccccggaccgtcggtaccaccgttcccncncgccaccaaccgacgaccgtcctacgtccgtcccgtccgcg

SEQ ID NO: 326118 - DNA, 687 bp, Homo sapiens
  misc_feature: GZ8MTXP02F4NT9.22.38.D05.1.454.CMB.2.raw
  modified_base (285)..(285): a, c, t, g, unknown or other
  misc_feature (285)..(285): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtagaaacccacacagaccctcacgctgacctgcaccttctctggttctcactcaactctagtggagtgggtgtgggctggttccgtcacgccccgaggaaacgccctggaatgggtnctacttatttagtggatggacggttaccgctacagtccatctctgaggaggagactcaaccactacccaaccgaacggaaccaaacccccaaaacgacggtacggtacctaacaactcgaaccaaccacgtacggaccctgtacggacaacacgacccaactaattactttcgtaggttcacctacgtaaaccttacgttaaagtaacggggaatcccgtaacccggttagggtaaacgttccgtaacggtacccgttaaaacggttccggtttaccccgggaaccccgggttcccgggggaaccccgggtaacccgttcgggtaccctaccgttcctccgtaccgaccgtcccaacccgaaccgaaccgggccctaccgtccggtcccttcccccgtccgg

SEQ ID NO: 326119 - DNA, 646 bp, Homo sapiens
  misc_feature: GZ8MTXP02H8U6M.22.38.D05.1.454.CMB.2.raw
  modified_base (295)..(295): a, c, t, g, unknown or other
  misc_feature (295)..(295): n is a, c, g, or t
  modified_base (321)..(321): a, c, t, g, unknown or other
  misc_feature (321)..(321): n is a, c, g, or t
tcagacatacgcgtcacgaccggtgctcgatttagtatctgatagttgggtttgggggaggaactgctcagttaggacccagagggaaccatggaagccccagctcagcttctcttcctcctgctactctggctccagataccacggagaaattgtgttgacacagtctccagccaccctgtctttgtcgtaccgggggaaagacgccaccctctcctgcacgggccagtcagaatgttagtattacttagctggtacagacaaagcctggccaggctcccagactcctcatctntagatacactaccaacgacgggaccncgtaggccactccccagtccgtaggtcgaggtacggcgaggtcggggtcgtaggggactacggtacttcgacgttcctaccaactactcgaacgtaccgaaactacgaacgtcctaaggtaattacgttttaggaacctttagttttaactacgttacgtacgtacgacgacggtcgtacgtctacgtcgtccggtacccgttaccgtaccgtaccggttacggaccggtaacgggacgtacggtacgtacggaacgtacgaaacgtaaacgtacgtacggtcgacgtacgaaccgtacgtacttctacgttactcgttactccg

SEQ ID NO: 326120 - DNA, 582 bp, Homo sapiens
  misc_feature: GZ8MTXP02FH0LX.22.38.D05.1.454.CMB.2.raw
  modified_base (456)..(456): a, c, t, g, unknown or other
  misc_feature (456)..(456): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggttgcacttatttattgggatgacggttaccgctacagtccatctctgaggaggagactcaccatcccaccaaacggaccaaccccccaaaaaccacggtacgggtccttaacaaatcgaccaccatggaccctgtggacacagccacatatttctagtgcacactcatagggancaacctgtacgtctgaccaaacgtggttccgaccccgtgggggccccggaaccctggtccaccggtcctccctcacgccctccgaacccgaaacgggccccaagtcccggtccttcccccgtcggg

SEQ ID NO: 326121 - DNA, 625 bp, Homo sapiens
  misc_feature: GZ8MTXP02H2329.22.38.D05.1.454.CMB.2.raw
  modified_base (437)..(437): a, c, t, g, unknown or other
  misc_feature (437)..(437): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggtccgtcagccccaggaaggcctggaatgggttgcacttatttagttgggatggacggttaccgctacagtccatctctgaggaggagactcaccatccaccaacgaccaacccccaaaacacggtacgtccttaacaatcgaccaccactacggaccctgtacggacacgacgcccaactattatttcngtcgcacactctaagtaggagctaccgtggtacgtcctagaccaaacgttccggttaccgaccccggttcgggggaccccggtaacccgttcgggtacccacccggttcctcccgtaccgaccggtccctaacccgacccgaaacggggcccctaacggttccccggttccctttccccccggtcggg

SEQ ID NO: 326122 - DNA, 613 bp, Homo sapiens
  misc_feature: GZ8MTXP02GNJ3R.22.38.D05.1.454.CMB.2.raw
  modified_base (340)..(340): a, c, t, g, unknown or other
  misc_feature (340)..(340): n is a, c, g, or t
  modified_base (428)..(428): a, c, t, g, unknown or other
  misc_feature (428)..(428): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaacccacacagaccctcacgctgacctgcaccttctctggttctcactcaactctagtggagtgggtgtgggctggttccgtcacgcccccgaggaaacggccctggaactgggttgctacttatttattgggatgacggttaccgctacagtccatctctgaggagganactcaccatacccaccaaggacccaaacccccaaaacgtcggtacgtccttaacaatcgaccacagtcgaccctgcgacacagaccanattacttctgtacgcaacacttactagtacggacgacctacgttaggtaacgtcgttacgacccgtaaacgttcggttacccgaccccggtcgggggtaccccggacccgtcggtaccctaccggtcctccctcgaccgccctaaccgaccgaacggccctacgtccgtcccgtttcccgcccgg

SEQ ID NO: 326123 - DNA, 670 bp, Homo sapiens
  misc_feature: GZ8MTXP02GVO23.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagccccaggaaaggccctggaatgggtgcacttatttatgggatgacggttaccgctacagtccatctctgagaggagactcaccataccaccaacgaccaacccccaaaaaccaggtacgtacccttaacaaatacgaaccaccacgtcggacccctgtaggaaccacgacgacccaacctattaactttctagtgacaccactactaatacggagcctaccgtagtacgtacgtacgtacctaaaacgttcgggttacccgaacccccgttccggggggacccccgggtaaacccgttccggggtaaccctacccgggttccctacccctccgtaaccgccccttaacccgaaccccggaaaaccgggccccctaacgtccccggttcccccgtttaccccccgttcccgggg

SEQ ID NO: 326124 - DNA, 731 bp, Homo sapiens
  misc_feature: GZ8MTXP02HWWTL.22.38.D05.1.454.CMB.2.raw
  modified_base (385)..(385): a, c, t, g, unknown or other
  misc_feature (385)..(385): n is a, c, g, or t
  modified_base (475)..(475): a, c, t, g, unknown or other
  misc_feature (475)..(475): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggtcctcacgccccaaggaacggccctggaatgggttgctacttatttagtgggatgacggttaccgctaacgacgtcatctcgtgacggaggagactcaccataccccaaccgaaacggaccaaacccccaaaaacgnggttacggtcccttaagaaactacgaacccaactactacgggaccctagtacggaacacgacgtccaaactacttaactttcgtagtacncctaactacttaccgttaaagtaacgggaactaccgtacccggttagggtacttaccgacgtaaccccgtaaaacggttccggggtttaccccggaaacccccggggttccgggggaacccccgggtaaacccgttccgggggtaaaccctaccccgggttcccttaccgacccgaaccggtaccccctaacccgaaacccggtaaaccgggccccctaacggttcccccgggttaccctttaccccccggccggg

SEQ ID NO: 326125 - DNA, 629 bp, Homo sapiens
  misc_feature: GZ8MTXP02HFMZC.22.38.D05.1.454.CMB.2.raw
  modified_base (265)..(265): a, c, t, g, unknown or other
  misc_feature (265)..(265): n is a, c, g, or t
  modified_base (273)..(274): a, c, t, g, unknown or other
  misc_feature (273)..(274): n is a, c, g, or t
  modified_base (302)..(302): a, c, t, g, unknown or other
  misc_feature (302)..(302): n is a, c, g, or t
  modified_base (574)..(574): a, c, t, g, unknown or other
  misc_feature (574)..(574): n is a, c, g, or t
  modified_base (588)..(588): a, c, t, g, unknown or other
  misc_feature (588)..(588): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctggttctcactcaactctagtggagtgggtgtggctggtcgcagccccaggaagccnggatggtnnattattagtggatgacggttacgctacngtccatctctgaggagacgactcaccatacccaaccgaacggaacccaaaccccccaaaaacgtacgggtacggttacccttaaacaaacgtccgaacccaaccgtactaccgggacccttagtacggaaacccaacggaacacccaacctaatttacttccgtaggtcaccactaacttctaaagtacgggacacctaccgtggtaactctacgacctaacgtcggttacccgacccggtcggggacccggtaccgtcggccaccgttccncctacaccgtcccncccgaacgaaccggtccacgttcccgtcccgtcccgtccgg

SEQ ID NO: 326126 - DNA, 657 bp, Homo sapiens
  misc_feature: GZ8MTXP02JBHB5.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgcccccaggaaacggccctggaagtgggtgctacttattagtgggatggacggttaccgctacagtccatctctggaggaggacgactcaaccataccccaaccgaaacggaacccaaacccccaaaacgaggtcgtccttaacaatacgaacccaccagtaccggaccctggtacggaaccaacgacgacccaaactatttactttctgtacgactacctactactaagtacggacgtcctaaccgtaggttacgtcgttacgacccgtaaacgttccggttacccgacccccgggtgggggacccccggtaaaccgttcggtaccctaccgtcccgtcccgtaccgaccgtcccaaccgaccgtacgggccctagtccccggttcctcccccggtcgg

SEQ ID NO: 326127 - DNA, 645 bp, Homo sapiens
  misc_feature: GZ8MTXP02J0APJ.22.38.D05.1.454.CMB.2.raw
  modified_base (373)..(373): a, c, t, g, unknown or other
  misc_feature (373)..(373): n is a, c, g, or t
  modified_base (435)..(435): a, c, t, g, unknown or other
  misc_feature (435)..(435): n is a, c, g, or t
  modified_base (442)..(442): a, c, t, g, unknown or other
  misc_feature (442)..(442): n is a, c, g, or t
  modified_base (448)..(448): a, c, t, g, unknown or other
  misc_feature (448)..(448): n is a, c, g, or t
  modified_base (455)..(455): a, c, t, g, unknown or other
  misc_feature (455)..(455): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgcccccgaggaaacggccctggaatgggttgctacttatttagttgggatgacggttaccgctacagtcatctctgaggagagactcaccatccaccaagaccaacccccaaaacnggtcgtcctacaatcgaccaccagtcggaccctgtacggacacgacgcccactatactttcngtgcacnctctanagggacncaccgttggtactcgttacgaccgtaaaccgttcgggttaccccgacccccggtacgggggtaccccccggggtaaaccctcgggggtaccctacccggttccttacccgtccgaccgtccccgtaaccccgaaacccggtaacggggccccctacggtttccccggttccccgtttccccccgtccggg

SEQ ID NO: 326128 - DNA, 626 bp, Homo sapiens
  misc_feature: GZ8MTXP02F5G0R.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtagaaacccacacacgaccctcacgctgacctgcaccttctctgggttctcactcaactctagtggagtgggtgtggctggttccgtcacgccccgaggaaacggccctggaagtgggtgctacttatttagttgggatggtacggttaccgctacagtccatctctgaggaggagactcaccatcccaaccaacgaaccaacccccaaaacgacggtcgtcctaacaatacaccaccagtacggccctggtacgaccacacgcaactattactttctgtgacactactactaagtaggcgacctaccgttggtacgtctacgaccgtaaacgtcgggttaccccgacccggtcgggggacccccggtaaccgtcgggtaccctccgttcctacctccgaccgtccctaacccgaacccgacgggcccctacgttcccggtcccttcccccgtccggg

SEQ ID NO: 326129 - DNA, 596 bp, Homo sapiens
  misc_feature: GZ8MTXP02JYA0U.22.38.D05.1.454.CMB.2.raw
  modified_base (282)..(282): a, c, t, g, unknown or other
  misc_feature (282)..(282): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggtcctcagcccccaggaaggccctggaatgggttncacttatttattggatgacggttacgctacagtccatctctgaggaggagactcaccatccaccaaggaccaaacccccaaaacgacggtcggtccttacaaactgaccaccatacggaccctgtcggacacacgccactactatttctgtcgctacactctataggagcaccgttggatctgacctaaactcggtacccgacccgtcgggggacccccggaaccgtcggtaccacccggttctcccgtcctaccggaccctaacccgacccggaacggcccctacgttcccggttcccgttcccccgtccggg

SEQ ID NO: 326130 - DNA, 615 bp, Homo sapiens
  misc_feature: GZ8MTXP02I0TTX.22.38.D05.1.454.CMB.2.raw
  modified_base (437)..(437): a, c, t, g, unknown or other
  misc_feature (437)..(437): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgcccccaggaaacggccctggaagtgggtgctacttattatgggatggacggttaccgctacagtccatctcgtgaggaggacgactcacatccaccaacggaccaacccccaaaacacggtacgtccttacaatcgaccacactcgaccctgtgacacacgaccatatactttctggtnacacactactagtacggactctaaccgtggtactccgtacgaccgtaaaacgtcggttacccgaccccggttcgggggacccccgggtaaccttcgggtcctacccggtcctacctaccgaccgtccctaaccgaacccgaacgggccccacggttcccggtccctttccccgtccgg

SEQ ID NO: 326131 - DNA, 582 bp, Homo sapiens
  misc_feature: GZ8MTXP02FZTM4.22.38.D05.1.454.CMB.2.raw
  modified_base (433)..(433): a, c, t, g, unknown or other
  misc_feature (433)..(433): n is a, c, g, or t
  modified_base (451)..(451): a, c, t, g, unknown or other
  misc_feature (451)..(451): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggtgcacttattattgggatgacggttaccgctacagtccatctctgaggaggagactcaccatccaaccaacggaaccaacccccaaaaacaggtacggtcccttaacaactgacccaccatcggaccctgtgacacagccactatatttcngtgacacactcataggancacctgtacgtctgacctaaagtcggttaccgaccccgtcgggggaccccggtaacccgtcggtaccgaccgtcctaccctcacgccctaaccgaccgaacgggccccagtcccggtccttcccccgtcgg

SEQ ID NO: 326132 - DNA, 594 bp, Homo sapiens
  misc_feature: GZ8MTXP02IEPS4.22.38.D05.1.454.CMB.2.raw
  modified_base (451)..(451): a, c, t, g, unknown or other
  misc_feature (451)..(451): n is a, c, g, or t
  modified_base (464)..(464): a, c, t, g, unknown or other
  misc_feature (464)..(464): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgcccccaggaaaggccctggaatgggttgcacttatttagttgggatgtacggttaccgctacagtccatctctggaggaggagactcacatccaccaaggaccaacccccaaaacacggtggtccttacaatacgaccaccatcggaccctgtagacacgagcccaatatatttctgtgacacactcataggnctactaggtatcngaccaaacgtcgggttaccgaccccgtcgggggaccccggtaacccgtggtcctaccggtctacccgtacgaccgtccctcccgaacccgaacggggccccacggttcccggttcccttcccccgtcggg

SEQ ID NO: 326133 - DNA, 553 bp, Homo sapiens
  misc_feature: GZ8MTXP02G74S9.22.38.D05.1.454.CMB.2.raw
  modified_base (416)..(416): a, c, t, g, unknown or other
  misc_feature (416)..(416): n is a, c, g, or t
  modified_base (419)..(419): a, c, t, g, unknown or other
  misc_feature (419)..(419): n is a, c, g, or t
  modified_base (433)..(433): a, c, t, g, unknown or other
  misc_feature (433)..(433): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggtgcacttattattgggatgacggttacgctacagtccatctctgaggaggagactcacatccacaagacaaccccaaaacaggtacgtcctacaactgaaccacatcgaccctgtcgacacagcacatatttcngtncacactcataggancactgactctgacaaactggttaccgacccgttcgggggacccgtaacccgtggtaccgaccggtctcccgtacacgccctccgacctaacgggcccacgttccggccctttcccgccgg

SEQ ID NO: 326134 - DNA, 687 bp, Homo sapiens
  misc_feature: GZ8MTXP02HLOXE.22.38.D05.1.454.CMB.2.raw
  modified_base (322)..(322): a, c, t, g, unknown or other
  misc_feature (322)..(322): n is a, c, g, or t
  modified_base (604)..(604): a, c, t, g, unknown or other
  misc_feature (604)..(604): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggaggtgggtgtggcgtcggttccgtcacgccccgaggaacggccctggaagtgggtgctacttattagttggagtgtacggtaccgctacngtccatctctggaggaggagactcacatcccaaccaacgaaccaaacccccaaaaccgacggtacgtactaacaactacgaccaccagcgaccctgtacgacacgagaccaatattactttcgtgtacgacctacctacttacgtaagtacgggtacgaccgtaccggttggttaacgttcccgtacgacccgtaaacggttccgggttaccccggacccccgggtacccgggggaccccggtaaaccccgttcgggtacccctaacccggtcccttacccncgtaacccgtcccgtaaccccgaacccggtaaaccgggtcccccgtacgtttcccccgggtccccgtttcccccggtcccggg

SEQ ID NO: 326135 - DNA, 629 bp, Homo sapiens
  misc_feature: GZ8MTXP02G9W46.22.38.D05.1.454.CMB.2.raw
tcagacatacgcgtcacgaccggtgctcgatttagtatctgatagttgggtttggggagtgactcctgtgcccgaccatggacacactttgctccacgctcctgctgctgaccatcccttcatgggtcttgtcccagatcaccctgaaggagtctggtcctacgctggtagaaacccacacagaccctcacgctgacctgcaccttctctgggttctcactcaactctagtggagtgggtgtggctggtcgtcacgccccaggaacgcccgtggaagtgggtgctacttattagtggatggacgtaccgctacagtccatctcgtgaggagacgactcacataccaaccgaacgaacccaaacccccaaaacgacggtacgtcctaacaaactaccgaccaaccgagtaccggacccttagacggaaccacgacgacacctattacttctagtcacactacttactaagtacggatacctaggtgtacgtctacgaaccctaaaggttccggttaccgaaccccgggtcggggaacccggtaacccgttcggaccctccggtcctacccgtacaccggtcccaaccgaccgaacgggtcccctacggtcccgtccccgtttccccggcg

SEQ ID NO: 326136 - DNA, 643 bp, Homo sapiens
  misc_feature: GZ8MTXP02GHTSE.22.38.D05.1.454.CMB.2.raw
  modified_base (448)..(448): a, c, t, g, unknown or other
  misc_feature (448)..(448): n is a, c, g, or t
tcagacatacgcgtcacgaccggtgctcgatttagtatctgatagttgggtttggggagtgactcctgtgccccaccatggacacactttgctccatgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgccccaggaaacggccctaggaatggtgcacttatttatggatgacggttaccgctacagtccatctcgtgaggagagactcacactacaccaacgaaccaacccccaaaaaccgaggtcggtaccttaacaaatacgacctaccaatcgggaaccctgtacggacacacgacccaacattattctaggtnaccaactactactaagtagggacactaccgtaggttacgtactacgtaccctaaaacgttcgggttacccgacccccggttacgggggacccccgggtaaaccctcggggtacctacccggtaccgtccctacgaccgtcccgtaccccaaccggtaaccgggacccctacgtccccggttccctttccccccgg

SEQ ID NO: 326137 - DNA, 576 bp, Homo sapiens
  misc_feature: GZ8MTXP02GU3FV.22.38.D05.1.454.CMB.2.raw
  modified_base (310)..(310): a, c, t, g, unknown or other
  misc_feature (310)..(310): n is a, c, g, or t
  modified_base (357)..(357): a, c, t, g, unknown or other
  misc_feature (357)..(357): n is a, c, g, or t
  modified_base (447)..(447): a, c, t, g, unknown or other
  misc_feature (447)..(447): n is a, c, g, or t
  modified_base (542)..(542): a, c, t, g, unknown or other
  misc_feature (542)..(542): n is a, c, g, or t
  modified_base (561)..(561): a, c, t, g, unknown or other
  misc_feature (561)..(561): n is a, c, g, or t
tcagacatacgcgtcacgaccggtgctcgatttagtatctgatagttgggtttgggggaggaactgctcagttaggacccagagggaaccatggaagccccagctcagcttctcttcctcctgctactctggctcccagataccaccggagaaattgtgttgacacagtctccagccaccctgtctttgtcgtccgggggaaagagccaccctctcctgcagggccagtcagaatgttagtagttacttagcctggtaccagcaaagcctggccaggctcccagactcctcatctctgatacatccaacngggccactggcactcccagcctaggttccagtggctaggtcggggtntgggacagtaccttcactctcacatcagcgacctagacgcctagaactagtttgcttagtttacttacgtagtctagacgtagtccgtanacgtactcggcggtaccccttaccgacttaccggttcggaccggtaacggggaccaggtccgtagaagacgtaaacgaacgtaacgtcgtacggntacgaacgactactacgtntcctactacttcccc

SEQ ID NO: 326138 - DNA, 581 bp, Homo sapiens
  misc_feature: GZ8MTXP02JP9E0.22.38.D05.1.454.CMB.2.raw
  modified_base (289)..(289): a, c, t, g, unknown or other
  misc_feature (289)..(289): n is a, c, g, or t
tcagacatacgcgtcacgaccggtgctcgatttagtatctgatagttgggtttgggggaggaactgctcagttaggacccagagggaaccatggaagccccagctcagcttctcttcctcctgctactctggctcccagataccaccggagaaattgtgttgacacagtctccagccaccctgtctttgtctccgggggaaagagccaccctctcctgcagggccagtcagaatgttagtagttacttagcctggtaccagacaaagcctggccaggctccagactccnatctctgatacatccaaacgacgggccacgtggccatcccagccaggttccagtggcaggtcggggtctggggacagtacttcactctacacatcagccgacctagacgcctagtaagtatttcgattagtttacttacgttgtacagcagacgtagctatcgtcggcctccgtacgtaccgtttcggccgtacggggacagccgtaggacgaacgtaacgaaacggtaacgttcggtacggtctacggaaccgtacctacgttcgttacgttccttacctacgtttccccg

SEQ ID NO: 326139 - DNA, 649 bp, Homo sapiens
  misc_feature: GZ8MTXP02ILHGJ.22.38.D05.1.454.CMB.2.raw
  modified_base (279)..(279): a, c, t, g, unknown or other
  misc_feature (279)..(279): n is a, c, g, or t
  modified_base (308)..(308): a, c, t, g, unknown or other
  misc_feature (308)..(308): n is a, c, g, or t
  modified_base (313)..(313): a, c, t, g, unknown or other
  misc_feature (313)..(313): n is a, c, g, or t
  modified_base (319)..(319): a, c, t, g, unknown or other
  misc_feature (319)..(319): n is a, c, g, or t
  modified_base (448)..(448): a, c, t, g, unknown or other
  misc_feature (448)..(448): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggcgtcgtcgcgaccgccgaggacgcgagtagtggtnctattattaggtgtagtacggtacgtccnctacncgtacntctcgtagaggagacgactacactacacccaacgaaccgaaccccaaaaccccgaaacgtacggtacgttacctaactaactaccacccactacgtaccgtacgtgacgacacgcaccatacttcttcngtacacactactactaggtagactacctacggtgtactccgacgtaaccctaacggtccggtaccccgtcccggggacccgggggtaccccgtacccgtcgaccccgtcccgtccctcccgtaccgacccgtccccgaacccgaaccgggtaacccgtccccgtaccggtttcccccgtttacccccgttccccggcccgg

SEQ ID NO: 326140 - DNA, 716 bp, Homo sapiens
  misc_feature: GZ8MTXP02G93GQ.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgccccaggaaaggccctggaatgggtgctacttattatgggatgacggttacgctacagtccatctcgtgaggaggagactacaccataccccaaccgaaacggaacccaaaccccccaaaaaccgaacggttacggtacccttaacaaactacgaacccaaccacgtacggtaccccgtagtacggaaaccacacgaccaactaatttactttccgtagtacgaccaactaaccttaccttaaagtacgggacgtaccctaaccggttaggtaacgttcctacgtaaccccgtaaaacgttccggggttaccccggacccccgggttaccgggggacccccgggtaaacccgttcgggtaccctacccggttccctccctaccgtaaccggccccttaacccgaacccggaaaccggggtcccccaagtttccccggtacccgttccccccgtccggg

SEQ ID NO: 326141 - DNA, 627 bp, Homo sapiens
  misc_feature: GZ8MTXP02H3NUZ.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtacgaaacccacacagaccctcacgctgacctgccaccttctctgggttctcactcaactctagtggagtgggtgtgggctggtcgcacgccccaggaagccctggaatgggtgctacttattagttggatgacggttaccgctacagtccatctctgaggaggagactcaccatacccaaccgaaacggaacccaaacccccaaaaaccgaggttacgtccttaaacaaatacgaccaacatacggaccctagcggacaacacgaccaactattactttccgtgtacgacaactacctataagtagggacacctaaccgtggtaagtccttacgaaccgtaaacgttcggttacccgaccccgggttcggggacccccggaacctcgggtacccacccggttcctaccgtcaccgtcccaaccgaccgaacggcccacgttcccgtccttccccgcgg

SEQ ID NO: 326142 - DNA, 797 bp, Homo sapiens
  misc_feature: GZ8MTXP02H8R03.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggtctggttccgtcgacgcccccgaggaaggccctaggaagtgggttgcacttatttagtgggatgacggttaccgctacagtccatctctggaggagagactacaccatcccgaacaaacggaacccaaacccccgaaaaacgacgggtaccggtccctaccgaaacaaactacgaacccacccgaatccggaccctaggtacggaccaaccgaacggccctaactaacttacttttaccgtgttacgacctaacctaccttacgtaagttaacgggacgtaccgtaaacccgttggggtaaattcccgttaccgtaacccgtaaaaccggtttcccgggtttaccccggggaaaccccccgggttccggggggaacccccccgggggttaaccccggttacccgggttccccgtaaacccccgggttccccgttaccccgttcccgaaacccggtcccccgtttaaccccccgaaaaccccgggtaaacccgggggtacccccccttaacccggtttccccggggtttacccccccgtttcccccccccgggg

SEQ ID NO: 326143 - DNA, 558 bp, Homo sapiens
  misc_feature: GZ8MTXP02JF1GC.22.38.D05.1.454.CMB.2.raw
  modified_base (398)..(398): a, c, t, g, unknown or other
  misc_feature (398)..(398): n is a, c, g, or t
tcagacatacgcgtcacgaccggtgctcgatttagtatctgatagttgggtttgggggaggaactgctcagttaggacccagagggaaccatggaagccccagctcagcttctcttcctcctgctactctggctcccagataccaccggagaaattgtgttgacacagtctccagccaccctgtctttgtctccggggaaagagccaccctctcctgcagggccagtcagaatgttagtagttacttagctggtaccagacaaagcctggccaggctcccagacctcctcatctctgatacatccaacgacgggccacgtcggcactcccagcctaggttcagtggctaggtcgggtcgtagggacagtctcactctacacactcagacgactagacncctagaactatttgacttagtttactactgtacacgcagtcgtagctatcgtcggccctacgtactaccgttggaccgacgggacctaagcgtagagataaccaaagacttggacggactacgaacgacctaattcgtgttaccttaccactttcccccg

SEQ ID NO: 326144 - DNA, 564 bp, Homo sapiens
  misc_feature: GZ8MTXP02F2WPE.22.38.D05.1.454.CMB.2.raw
  modified_base (203)..(203): a, c, t, g, unknown or other
  misc_feature (203)..(203): n is a, c, g, or t
  modified_base (297)..(297): a, c, t, g, unknown or other
  misc_feature (297)..(297): n is a, c, g, or t
  modified_base (508)..(508): a, c, t, g, unknown or other
  misc_feature (508)..(508): n is a, c, g, or t
  modified_base (550)..(550): a, c, t, g, unknown or other
  misc_feature (550)..(550): n is a, c, g, or t
tcagacatacgcgtcacgaccggtgctcgatttagtatctgatagttgggtttgggggaggaactgctcagttaggacccagagggaaccatggaagccccagctcagcttctcttcctcctgctactctggctcccagataccaccggagaaattgtgttgacacagtctccagccaccctgtctttgtctccggggaaagngccaccctctcctgcagggccagtcagaatgttagtagttacttagcctggtaccagacaaaagcctggccaggctcccagactcctcatctcngactacatccaaacgacgggccagtggaccactccccgagcccaagggtttccaaggtggctaggtcgggtctggggacagacttcactctacacatcagccgaacctagacgcctagaatattttgacttagtttattactgtcagcagcgtagcatctcggcctaccgtactaccgtttggaccgacggggacctaaggccgtaggganactacgaaaacgtacgtgtacggctacgaacgtaccattctntcttcactttcccg

SEQ ID NO: 326145 - DNA, 844 bp, Homo sapiens
  misc_feature: GZ8MTXP02IBQGO.22.38.D05.1.454.CMB.2.raw
tcagacatacgcgtcacgaccggtgctcgatttagtatctgatagttgggtttgggggaggaactgctcagttaggacccagagggaaccatggaagccccagctcagcttctcttcctcctgctactctggctcccagataccaccggagaaattgtgttgacacagtctccagccaccctgtctttgtcgtccgggggaaagagccaccctctcctgcagggccagtcagaatgttagtagttacttagcctggtaccagacaaagctggccaggctcccagactcctcatctctgatacataccaaacgacgggcccacgtcggccactccccgacgcccgtaagggttccaaggtcgggacgtacggggtcggggtaccgtaggggaacaacggtaccgtttaccaccttcctaccaaccctaacttaccgaacgtacccggtaaacccgttaaacggaaccggtacccgttaaaggtaaaacggtttaacgtttttaccgggtaaccgtttaaaggttttttaaactttaacccggtttacgggttaaccctaaacggggtacccgttaaacggggtaacccggttaaacgggtaccttaaacggtttccccgggttaccggggttaccccccgtttaaccccgggttaaacccggttaacccccgggtttttacccgggggaaccccggggttaaaccggggggaaaacccccgtaaaacgggggtcccggttaaagggggaaacgtaaccgttaaaaccgaaaaaccggtaacgttacgggtacggtacgtacggaaccaactacgttcgtacgttcctttactaccgtttcccccg

SEQ ID NO: 326146 - DNA, 609 bp, Homo sapiens
  misc_feature: GZ8MTXP02IIWOF.22.38.D05.1.454.CMB.2.raw
  modified_base (437)..(437): a, c, t, g, unknown or other
  misc_feature (437)..(437): n is a, c, g, or t
  modified_base (451)..(451): a, c, t, g, unknown or other
  misc_feature (451)..(451): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagccccaggaaaggccctggaatgggttgcacttattagtggatgacgttaccgctacagtcatctctgaggagagactcacatccaaccaacgaccaacccccaaaaccacggtcggtccttacgaatcgaacccaccagtcgaccctgtgacacacgccaactattactttctgtcgacncactctaatagganctaccgtggtactctcggacctaaacgttggttacccgaccccggttcgggggacccccgggtaacccgtcggtcccgtaacccgtccgtccctacgaccgcccctaaccgacccgaaacgggcccctaaccgttcccggttcccttcccccgtccgg

SEQ ID NO: 326147 - DNA, 713 bp, Homo sapiens
  misc_feature: GZ8MTXP02HFKPK.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgccccaggaaacggccctggaatgggttgctacttatttagttggatggacgttaccgctacagtccatctcgtgaggagagactcacatacccaaccaacgaaccaaacccccaaaaacgacggtacgtcctaacaatacgaaccaaccacgtacggaccctgtacggaaccaacgacgaccaactattacttacgttgtacgtaccactaacctcttaaagtagggtaactaccgtaacccgttagggttacgttacctacggtaacccctaaacgtttaccgggttaccccggtaacccccggtccgggggtacccccggtaaacccggttaccgggtccgtaaccccggtcccttaccccgtccgacccggttacccctaaccccgtaaaccccgaaccggggacccccgtaaccggtccccggtttaccccgtttacccccgtcccccggg

SEQ ID NO: 326148 - DNA, 649 bp, Homo sapiens
  misc_feature: GZ8MTXP02IRCD8.22.38.D05.1.454.CMB.2.raw
  modified_base (454)..(454): a, c, t, g, unknown or other
  misc_feature (454)..(454): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtagaaacccacacagaccctcacgctgacctgcaccttctctgggttctcactcaactctagtggagtgggtgtgggctggttccgtcacgccccgaggaaacgcccgtggaagtgggtgctacttattagtggatgacggtacgctacagtccatctctgaggagacgactcacatacccaaccgaacggaacccaaaccccaaaacgacggttacggtcctaacaactacgacccaccagtcggaccctgtacgacacgacgacctaacattactttctcgtanacactactacctaagtacgggactccgaccgttaggtactcgtacgaccgtaaaacgttcgggtacccgtaccccggtccgggggaccccggtacccgtggtacccgtacccggtcccttcccgtaccgaccgccccgtaacccgacccgaacgggtaccccctacggtcccgtttcccgtacccccgtcccggg

SEQ ID NO: 326149 - DNA, 673 bp, Homo sapiens
  misc_feature: GZ8MTXP02IRHAC.22.38.D05.1.454.CMB.2.raw
  modified_base (286)..(286): a, c, t, g, unknown or other
  misc_feature (286)..(286): n is a, c, g, or t
  modified_base (318)..(318): a, c, t, g, unknown or other
  misc_feature (318)..(318): n is a, c, g, or t
  modified_base (326)..(326): a, c, t, g, unknown or other
  misc_feature (326)..(326): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtggcgtggttccgtcagcccccaggaaacggccctggaagtgggtnctactttattatgggatgacggttacgctacngtccatcnctgaggagagactcaccatcccaaccgaacgaaccaaacccccaaaaacgacggttacgtccttaacaaactcgacccaccactcggaccctggtacgaaccacacgaccactaattactttctgtacgaccaacctacttacgtacgtaaggacgacctaccgttagggtactcgtacgaccctaaaacggttccggttaccccggtaccccggttaccgggggacccccggtaaacccgttcgggtaccctacccggtcccttcccgtacgaacccgtccccgtaacccgaccggaaacccgggtcccctacggttccccgttccccgtttcccccgtcccgggg

SEQ ID NO: 326150 - DNA, 737 bp, Homo sapiens
  misc_feature: GZ8MTXP02I1QYU.22.38.D05.1.454.CMB.2.raw
  modified_base (274)..(274): a, c, t, g, unknown or other
  misc_feature (274)..(274): n is a, c, g, or t
  modified_base (399)..(399): a, c, t, g, unknown or other
  misc_feature (399)..(399): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgccccaggaaaggcccnggaatgggtgcacttattagtgggatgacggttaccgctacagtccatctctgaggaggagactcaccatcccaccaacggaaccaacccccaaaacacggttcgtcctacaatacgaccaccancggaaccctgtacggacacgacgacccaactagttactttacgtcgttacgaccaaccgtaccttaccgttaaagttaacggggaacgtacccgtaacccggtttaggggtaacgttaccgttacggtaaccccgtaaaacggttcggggtttaccccggaccccccgggttacggggggtacccccccggggtaaaaccccggtttccgggtaccccgtaaccccggttcccgttccccgttaccgtaccggtacccccttaacccggaaaccccgaaaccgggggtccccctaaccggttcccggggtttaccccctttccccccggttcccgggg

SEQ ID NO: 326151 - DNA, 706 bp, Homo sapiens
  misc_feature: GZ8MTXP02JQKIM.22.38.D05.1.454.CMB.2.raw
  modified_base (280)..(280): a, c, t, g, unknown or other
  misc_feature (280)..(280): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtagaaacccacacagaccctcacgctgacctgcaccttctctggttctcactcaactctagtggagtgggtgtggctggtccgcacgccccaggaacggcctggaatgggtnctacttattagtggatgacgtcgctacagtccatctcgtgaggaggagactcacactacccaccaacggaccaaacccccaaaacgacggttacgtaccttaacaaactcgaacccactacgtacggaccctgtacgaaccacgacgacccaactattacgtttactgttacgaccaactaacttactaagtaacgggacgaccctaacgtaggttacgttcgtacgaacccgtaaacgttcgggttaccccggaacccccgggttcccggggggacccccgggtaaaccccggttcgggtaccccgtaaccccgttccgtaccccgttaccgaacccgtacccccgttccccgaaaccccggaaaccgggggtacccccaaccggtttcccccggtttacccccggttcccccgtcccccggggg

SEQ ID NO: 326152 - DNA, 621 bp, Homo sapiens
  misc_feature: GZ8MTXP02F77XV.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggtgcacttatttatgggatgacggttaccgctacagtccatctctggaggaggagactcaccatcccaaccaacgaccaacccccaaaaaccaggtacggtccttaacaactcgacccacactcgggaccctgtacggacacacgaccactatactttctagtcgacacactctataggagcaccgtagggtactcgtgacccgtaaaacgttcggttacccgacccccgttcgggggacccccggtaacccgtgggtacccacccggttcctcccgtaccacgtacccctcccgaacccgaacggggcccctagttcccggtccctttcccccgtcggg

SEQ ID NO: 326153 - DNA, 641 bp, Homo sapiens
  misc_feature: GZ8MTXP02JUKB4.22.38.D05.1.454.CMB.2.raw
  modified_base (375)..(375): a, c, t, g, unknown or other
  misc_feature (375)..(375): n is a, c, g, or t
  modified_base (570)..(570): a, c, t, g, unknown or other
  misc_feature (570)..(570): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggtccgtcacgccccaggaacggccctggaagtgggtgctacttattagtgggatggacggttaccgctacagtccatctctggaggaggagactcaccatacccaccaacgaccaacccccaaaacgnggtacgtcctacaatcgaccacagcgaccctgtacggacacgacgaccactattacttctagtcgacctactactcgttaagtacggacgcctaccgttggtacgtctacgaccgtaaacgttccgggttacccgaccccgggtacgggggtacccccggtaacccgtccggtacccgtacccggttcctacccnccgtacccgtcccctaacccgaacccggaaccgggtccccacgttccccggttaccccgtcccccgtcggg

SEQ ID NO: 326154 - DNA, 664 bp, Homo sapiens
  misc_feature: GZ8MTXP02J45GC.22.38.D05.1.454.CMB.2.raw
  modified_base (461)..(461): a, c, t, g, unknown or other
  misc_feature (461)..(461): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaacccacacagaccctcacgctgacctgcaccttctctgggttctcactcaactctagtggagtgggtgtgggctggttccgtcagccccccaggaaaggcccctggaatggggttgcacttattattgggtagtgacggttaccgctacagtccatactctgaggaggtagactccaccactacccaccaaccgcaaaacccccgacaaaccccgacgtcggtaaccttacgactacacacgaccacctcgtacgtactacgaccgacacacacttactattcttagtcnctactaccgatacgtacgacgtagaccgtacgtccgtactacggttacgtaacccgttcggtaccccgggtaaccccgttcccggggtacccgtcccggtaccggggtaacccgttcccgtacccgggttcccccgtacccttaacccgtacccgtacccgtacccgtacccgtacccgtacccggttacccccggtacccgg

SEQ ID NO: 326155 - DNA, 538 bp, Homo sapiens
  misc_feature: GZ8MTXP02GYLHB.22.38.D05.1.454.CMB.2.raw
  modified_base (378)..(378): a, c, t, g, unknown or other
  misc_feature (378)..(378): n is a, c, g, or t
  modified_base (385)..(385): a, c, t, g, unknown or other
  misc_feature (385)..(385): n is a, c, g, or t
  modified_base (391)..(391): a, c, t, g, unknown or other
  misc_feature (391)..(391): n is a, c, g, or t
  modified_base (395)..(395): a, c, t, g, unknown or other
  misc_feature (395)..(395): n is a, c, g, or t
  modified_base (422)..(422): a, c, t, g, unknown or other
  misc_feature (422)..(422): n is a, c, g, or t
  modified_base (503)..(503): a, c, t, g, unknown or other
  misc_feature (503)..(503): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaacccacacagaccctcacgctgacctgcaccttctctgggttctcactcaactctagtggagtgggtgtgggctggttccgtcagccccaggaaagccctggaatgggtgcacttattatggatgacgttacgctacagtcatctctgaggagagactcacatccacaagacaacccccaaaacagtacgtcctacaatgaccacangacctgngacacngcanatattcagtcacacactctatacggancacctgtacgtctgaccaaacgttggttaccgacccgtcggggacccggaaccctggtccaccgtctaccgtcacgtcccnccgacaacgggcccagtccggtccttcccccgcgg

SEQ ID NO: 326156 - DNA, 606 bp, Homo sapiens
  misc_feature: GZ8MTXP02HR2YR.22.38.D05.1.454.CMB.2.raw
  modified_base (435)..(435): a, c, t, g, unknown or other
  misc_feature (435)..(435): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggtccgtcacgccccaggaaacgccctggaatgggtgcacttatttatgggatgacggttaccgctacagtccatctctgaggaggagactcacatccaccaacgaccaaccccaaaacacggtacgtccttacaatacgaccaccatcgaccctgtacggaacacagacccaactatactttcagtcncaactactctaagtaggagccaaccgtggtacgtctacgaccctaaaacgtcggttacccggacccccgtcgggggacccccggtaaccgtcggtacccaccggtccttcccgcaacgccctaacccgaaccgaaccgggtccccacgtcccggtccctttcccccgcggg

SEQ ID NO: 326157 - DNA, 616 bp, Homo sapiens
  misc_feature: GZ8MTXP02G6S6Y.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggttgcacttatttatgggatgacggttaccgctacagtccatctctgaggagagactcaccatccaccaagacaacccccaaaacaggtggtccttacaatcgaccaccatcggaccctgtggacacacgccacatattctgtgcacactctaataggagccaccgttggtaacgtctagaccctaaaacgtcgggttacccgacccccgtcgggggacccccgggtaaaccccgtcggggtaccctacccggttcctcccgttccacggtcccctaacccgacccgaaaccgggggtccccctacgttcccggtcccctttccccccgtccggg

SEQ ID NO: 326158 - DNA, 641 bp, Homo sapiens
  misc_feature: GZ8MTXP02JMZAK.22.38.D05.1.454.CMB.2.raw
  modified_base (459)..(459): a, c, t, g, unknown or other
  misc_feature (459)..(459): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtagaaacccacacagaccctcacgctgacctgcaccttctctgggttctcactcaactctagtggagtgggtgtgggctggtccgtcacgccccaggaacggccctggaagtgggtgctacttattagtggatggtacgttacgctacagtccatctcgtggaggaggagactacaccatacccaaccgaacggaccaaacccccaaaacgacggtacgtcctaacaatacgaccacacgtacgaccctgtacgaccacgacgacccaactattacttctgtcacactacnctagtaggacactaccgtgtacgtcacgtacctaacgtcggttacccggaccccgtcgggggacccccgtaaccgtcggtacccgtacccgtccgtaccctacgacccgccccgtaacccgaaaccccggaccggggtaccccaccggtttccccggttacccccgttcccccggtcccggg

SEQ ID NO: 326159 - DNA, 587 bp, Homo sapiens
  misc_feature: GZ8MTXP02HL7Y6.22.38.D05.1.454.CMB.2.raw
  modified_base (407)..(407): a, c, t, g, unknown or other
  misc_feature (407)..(407): n is a, c, g, or t
  modified_base (425)..(425): a, c, t, g, unknown or other
  misc_feature (425)..(425): n is a, c, g, or t
  modified_base (441)..(441): a, c, t, g, unknown or other
  misc_feature (441)..(441): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgccccaggaaacggccctggaatgggtgcacttattatggatgacggttaccgctacagtccatctctgaggaggagactcacatccaccaagaccaacccccaaaacaggtcgtcctacaatcgaccaccatcgaccctgtaggacacncgaccatattattctgtncacactctaataggancaccgtgtacgctacgacctaaacgtcggttacccgacccgtcgggggaccccggtaacccgtcgggcctaccggtcctccctaccgaaccgccctaacccgaccgaaccgggcccctacgtcccggttccctttcccccgccggg

SEQ ID NO: 326160 - DNA, 661 bp, Homo sapiens
  misc_feature: GZ8MTXP02ITSGI.22.38.D05.1.454.CMB.2.raw
  modified_base (373)..(373): a, c, t, g, unknown or other
  misc_feature (373)..(373): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtagaaacccacacagaccctcacgctgacctgcaccttctctgggttctcactcaactctagtggagtgggtgtgggctggttccgtcacgccccaggaaacggccctggaatgggttgctactttattagtgggatggtacggttaccgctacagtccatctctgaggaggagactcacatccaccaagaccaaccccaaaacngtcgtctacatcgaccacactcggaccctgtgacacgacgcccaatacttatttctgtcgacactacttacttaagtacggacgccacgtcggtacgtcgtacgacctaaacgttccggttacccggaccccggttccgggggtacccccgggtaacccgttcggggtacccgtaacccggttcccttccccgtaccgtaccggtacccccgtaacccgtaaccccggaaaccgggggtccccctaacggtccccgggtttaccccgtttaccccccgtttcccgggg

SEQ ID NO: 326161 - DNA, 712 bp, Homo sapiens
  misc_feature: GZ8MTXP02H952J.22.38.D05.1.454.CMB.2.raw
  modified_base (371)..(371): a, c, t, g, unknown or other
  misc_feature (371)..(371): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtacgaaacccacacacgaccctcacgctgacctgccaccttctcgtcgggttctcactacaacttctaggtggtaggtgggtggtgggtcttcggttccgtcgacggccccgagggaaacggcccgtaggtaagtgggttagctactttagtttagttggagttaggaccggttaccgctacagtccatctcgtggaggaganactcaccatacccaccgaacgacccaaaccccaaaaacgtacggtacgtacctaacaaataccgaaccaacctacgtacgaccccgtagacggaaccaacgacgaccaacgttattaaactttcgagtacgacctaccacgttacctaagttacgggaacgtccgtaaccgtggtacgttcgacggtaacccgtaaacgttccggttaccccggacccccgggtacgggggtacccccgggtaacccgttcggtacccctacccggtccttacccgtacgacccgtcccgaacccgaaccgaaccggtccccaccgtcccgtcccccgttcccccggcccg

SEQ ID NO: 326162 - DNA, 731 bp, Homo sapiens
  misc_feature: GZ8MTXP02JEMK7.22.38.D05.1.454.CMB.2.raw
  modified_base (285)..(285): a, c, t, g, unknown or other
  misc_feature (285)..(285): n is a, c, g, or t
  modified_base (308)..(308): a, c, t, g, unknown or other
  misc_feature (308)..(308): n is a, c, g, or t
  modified_base (314)..(314): a, c, t, g, unknown or other
  misc_feature (314)..(314): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtacgaaacccacacagaccctcacgctgacctgcctaccttctcgtggttctcactcaactcgtagtggagtgggtgtggctggttcgcacgccccgaggaacgcctggagtgggtnctattattagtggatgacgtacnctacgntccatctcgtagaggagacgactccaacgtactacccaaaccgaaaccggaacccaaaaccccccgaaaaacgtacgggttacgtacccttaaacaaacgtaccgaaccctaaccgtacgtaccggtacccgtaggtaacgacccaacgaacgaccctaaactactttacgtttctacggttcgacctaacctacttacgttaaacgacgggactaccgtaaccgttggtaactccgtacgtaacccgtaaacgttccgggtaccccgtaccccgggtccgggggacccccgggtaacccgttcggtacccgtacccggtacctacccgtaccgtacccgccccgttaacccgaaaccccggtaaaccgggtcccccgtacgtttcccggtttaaccccccgtccccggtccccggg

SEQ ID NO: 326163 - DNA, 612 bp, Homo sapiens
  misc_feature: GZ8MTXP02I8CFL.22.38.D05.1.454.CMB.2.raw
  modified_base (422)..(422): a, c, t, g, unknown or other
  misc_feature (422)..(422): n is a, c, g, or t
  modified_base (453)..(453): a, c, t, g, unknown or other
  misc_feature (453)..(453): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggtccgtcacgccccaggaagccctggatgggtgctacttattagtggatgacggttaccgctacagtccatctctgaggagagactcaccatcccaaccaacggaccaaacccccaaaacacggtacggtccttacaatacgaccaccagtcgaccctgacgaccacacgcccanattacttctgtcacactactctagtaggacnctacgtgtacgtctcgacctaaacgttcgggtacccgaccccggtcgggggacccccggtaaccgtccgggtaccacccggttctcccgtaccgtaccgcccctaacccgaacccgaaccgggtcccctacgttcccggttccctttcccccggtccgg

SEQ ID NO: 326164 - DNA, 605 bp, Homo sapiens
  misc_feature: GZ8MTXP02HKW57.22.38.D05.1.454.CMB.2.raw
  modified_base (463)..(463): a, c, t, g, unknown or other
  misc_feature (463)..(463): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgccccaggaacgccctggaagtgggtgctacttatttagtggatgacggttaccgctacgagtccatctcgtgaggaggagactcaccatcccaccaacggaccaaacccccaaaaccgacggtacggtccttacaaactcgaccaccagcgaccctgtcgacacacgccaatattacttctgtcgcactactactaagtacgganaccgaccgtggtacgtcgtagacctaacgttccggttaccgaccccgggtcgggggaccccggtaacccgtgggtaccctacccggtcctccgtcaccgccctaaccgaccgaccggcccacgtcccgtccttccccgtcgg

SEQ ID NO: 326165 - DNA, 648 bp, Homo sapiens
  misc_feature: GZ8MTXP02JTOYF.22.38.D05.1.454.CMB.2.raw
  modified_base (428)..(428): a, c, t, g, unknown or other
  misc_feature (428)..(428): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgccccgaggaacggccctaggaatgggttgctactttatttagttggtatgtacggttaccgtctacagtccatctctggaggaggagactcacataccaccaacgaccaacccccaaaacgacggtacgtcctacaatcgaccacatcgaccctgtacgacacagcccanacttacttcgtagtcgacctaactactacctagtacggagacctaccgtggtaacgtctacgtacccaaacgttcgggttacccgacccccggtccgggggtaccccggaacccgttcgggtaccctacccggtccttcccgtaccgaccgccccgtaaccgaaccccggaaccggggtacccctacgttccccgggttaccctttccccccggtccggg

SEQ ID NO: 326166 - DNA, 637 bp, Homo sapiens
  misc_feature: GZ8MTXP02JHI8E.22.38.D05.1.454.CMB.2.raw
  modified_base (449)..(449): a, c, t, g, unknown or other
  misc_feature (449)..(449): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtacgaaacccacacagaccctcacgctgacctgcaccttctcgtgggttctcactcaactctagtggagtgggtgtggctggtccgtcacgccccgaggaacgccgtggaagtgggtgctacttattagtggatgtacggttaccgctacacgtccatctcgtgaggagagactcacactacccaccaacgacccaaaccccaaaacgacggttacgtacctaacacgtacgaccaccgacgtacgaccctgtacggacaacgcaccaactattacttcgngtacacactactacgttaagacggactacgtaccgtgtaacgtctacgtaaccgtaacgttccgggttaaccgccccgggtacggggccccggtaaccgtcggacccgtaccgttcctcccgtacgacctcccgtaaccgaacccgaaccggtccctacggttacccgttccccgttacccgcccggg

SEQ ID NO: 326167 - DNA, 671 bp, Homo sapiens
  misc_feature: GZ8MTXP02JB7TM.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaacggccctggaatgggtgcacttatttattggatgtacggttaccgctacgagtccatctctgaggaggagactcgacactcccaccaacggaccaaaccccccaaaaacgacggtacgggtccttaacaattaccgaccaacctagtcggaccctgtcggaacacgacgaccactattaactttccgtagtcgaccactaacttaccgtaagtacggggacgtcccgtaccgtaggtacgtacctacggaccctaaaacgttcgggttacccgaacccccggttccgggggacccccggtaacccgtccggtacccgtacccgtccgtcccgtccgacctaccccgtcccgaacccgaaacggggtccccctacggtccccggttcccttcccccgtcccggg

SEQ ID NO: 326168 - DNA, 872 bp, Homo sapiens
  misc_feature: GZ8MTXP02JCGWM.22.38.D05.1.454.CMB.2.raw
tcagacatacgcgtcacgaccggtgctcgatttagtatctgatagttgggtttgggggaggaactgctcagttaggacccagagggaaccatggaagccccagctcagcttctcttcctcctgctactctggctcccagataccaccggagaaattgtgttgacacagtctccagccaccctgtctttgtcgtccgggggaaagagccaccctctcctgcagggccagtcagatgttagtagttacttagcctggtaccagacaaagcctggccaggcctcccagactcctcatctctgatacactaccaacgagggccacgtcggacactcccacgccgtaggtttccaggtcggcgtaggttcggggtcgtacggggactaacggtacctttccaccttcctaccctaaacctacgttaccgacggtaccggtaaacccgttaagggaccgtacccgttaaggtaaacggtttacgttttttcggtaacccgtttaaggtttttaacttttaaaccgtttcggtttaaccgtaagggaccgtaagggtaccggtttaaaccggaccgttaaacgtttacccggggttcccgggttaccccgtttaacccccgggtttaaacccgtttacccccggggttttaaccgggggtaaacccccggggtaaaaccggggggaaaccccgtaaaccgggggttaccggaaaacgggggtaaaacggttaaaacccggtaaacccggttaaaaaaccggtacggtttaaccggggttaaccgggtcccggtttaacccggaaccccgttaaaccggttaacctttcccggtttacgtttaaccccgtttacctttaaccccggtttttacccccccg

SEQ ID NO: 326169 - DNA, 622 bp, Homo sapiens
  misc_feature: GZ8MTXP02H9M1P.22.38.D05.1.454.CMB.2.raw
  modified_base (255)..(255): a, c, t, g, unknown or other
  misc_feature (255)..(255): n is a, c, g, or t
  modified_base (273)..(273): a, c, t, g, unknown or other
  misc_feature (273)..(273): n is a, c, g, or t
  modified_base (343)..(343): a, c, t, g, unknown or other
  misc_feature (343)..(343): n is a, c, g, or t
  modified_base (392)..(392): a, c, t, g, unknown or other
  misc_feature (392)..(392): n is a, c, g, or t
  modified_base (441)..(441): a, c, t, g, unknown or other
  misc_feature (441)..(441): n is a, c, g, or t
  modified_base (447)..(447): a, c, t, g, unknown or other
  misc_feature (447)..(447): n is a, c, g, or t
  modified_base (485)..(485): a, c, t, g, unknown or other
  misc_feature (485)..(485): n is a, c, g, or t
tcagacatacgcgtcacgaccggtgctcgatttagtatctgatagttgggtttggggagtgactcctgtgccccaccatggacacactttgctccacgctcctgctgctgaccatccccttcatgggtcttgtcccagatcaccctgaaggagtctggtcctacgctggtgaaacccacacagacctcacgctgacctgcaccttctcttgggttctcactcaactctagtggagtgggtgtgggctggtcgtcncgccccaggaaacgcccnggaatcgggtgcacttattattggatgacgtttacgctacagtcatctctgaggaggagactcacctacncccaacaaacggaccaaaccccaaaaacacggtacgtacctttaacaanacgacccaacacgtcgaaccctgacggacactagacccatattacttcnggtacncaacacttactatagggacaccacgttagtacgttctnaaccgtaaacgtcgttacccgaacccgtcggggccccggtaaaaccttcgggacctacccggtctttaccccgctaaacccacccgtaacccgaaccggaaccgtccctacggttaccccgtcccgtttccccgcgg

SEQ ID NO: 326170 - DNA, 596 bp, Homo sapiens
  misc_feature: GZ8MTXP02F3V9G.22.38.D05.1.454.CMB.2.raw
  modified_base (244)..(244): a, c, t, g, unknown or other
  misc_feature (244)..(244): n is a, c, g, or t
  modified_base (399)..(399): a, c, t, g, unknown or other
  misc_feature (399)..(399): n is a, c, g, or t
  modified_base (434)..(434): a, c, t, g, unknown or other
  misc_feature (434)..(434): n is a, c, g, or t
  modified_base (459)..(459): a, c, t, g, unknown or other
  misc_feature (459)..(459): n is a, c, g, or t
  modified_base (474)..(474): a, c, t, g, unknown or other
  misc_feature (474)..(474): n is a, c, g, or t
tcagacatacgcgtcacgaccggtgctcgatttagtatctgatagttgggtttggggagtgactcctgtgcccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggntggttcgtcagccccaggaacgccctggatgggtgctacttatttatgggatgacggttaccgctacagtccatctctggaggaggagactcacactaccaccaacggaccaacccccaaaacgacggttacggtcctacaactacgaccaccancggtacctgtggacacgacgccaactatactttcngtcgacacacgttctaatagggacncgtaccgtaggtacncgttagacctaaacgtcggtacccgaccccggtcggggaccccggtacctcggtccacccggtcctccgtcaccgtccctccgacccgaacgggtcccacgtcccgttccgtccccgtccgg

SEQ ID NO: 326171 - DNA, 646 bp, Homo sapiens
  misc_feature: GZ8MTXP02HWQTR.22.38.D05.1.454.CMB.2.raw
  modified_base (417)..(417): a, c, t, g, unknown or other
  misc_feature (417)..(417): n is a, c, g, or t
  modified_base (435)..(435): a, c, t, g, unknown or other
  misc_feature (435)..(435): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagccccaggaacgccctggaatgggtgcacttattatgggatgacggttaccgctacagtccatctctgaggagagactcacatccaaccaacgaccaaacccccaaaaacgacggtcgtccttaacaaactcgaacccaccacgtcgacccctgtcgaacncacgccaactatatttcngtcgcactactctatacggagctaaccgtggtactcgtacgtacccaaacgttcgggttcccgaacccccggttcgggggaccccccgggaaacccgttcgggggtaccctacccgggttacctcccgtaccgaacccgtcccgttaacccccgaaccgtaaaccggggccccctaacggttcccccgggttccctttccccccggccggg

SEQ ID NO: 326172 - DNA, 640 bp, Homo sapiens
  misc_feature: GZ8MTXP02IHT6U.22.38.D05.1.454.CMB.2.raw
  modified_base (593)..(593): a, c, t, g, unknown or other
  misc_feature (593)..(593): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggtctggttccgtcacgccccgaaggaaacggccctggaagtgggttgctacttattagtggatgtacggttaccgctacagtccatctctgaggaggagactcacatacccaaccaacgaccaacccccaaaacaggtacgtactaacaatcgtaaccaccacgtacgaccctagtacggacaacgacgacccaactaattactttactgttacgacaacacttacgtaagtaggtacgtaccgtacgttaggtacgtctacgacccgttaaaacgttccggtttacccgaccccggttcgggggacccccggtacgtccgggtcctaacccggtcctaccctccgaccnccgtaacccgaaccgacggtcccacgtcccgtcccttccccgtccgg

SEQ ID NO: 326173 - DNA, 705 bp, Homo sapiens
  misc_feature: GZ8MTXP02JGS05.22.38.D05.1.454.CMB.2.raw
  modified_base (274)..(274): a, c, t, g, unknown or other
  misc_feature (274)..(274): n is a, c, g, or t
  modified_base (325)..(325): a, c, t, g, unknown or other
  misc_feature (325)..(325): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcactctagtggagtgggtgtgggctggttccgtcacgccccaggaaacggcccnggaatgggtgcacttatttagtggatgacggttaccgctacagtccatctntgaggaggagactcaccatcccaaccaacggaccaaaccccccaaaaccgaggtacggtccttaacaatacgaccaccatcggaccctgtacggaaccacgacgccaactaatactttacgtgttcgacctaactaactacctaaagtacgggacgacccgtaacccgttagggtaaccgttccgtacgtaacccgtaaaacgttccggggtttaccccgacccccggtacggggggtaccccccggggtaaaacccgttcggggtacccctaccccggttccgttccccgtaccgaccgtacccccgtaacccgaaacccggaaaacccgggggccccctaaccggttccccgggtttccccttcccccccggtccggg

SEQ ID NO: 326174 - DNA, 607 bp, Homo sapiens
  misc_feature: GZ8MTXP02JEB8V.22.38.D05.1.454.CMB.2.raw
  modified_base (402)..(402): a, c, t, g, unknown or other
  misc_feature (402)..(402): n is a, c, g, or t
  modified_base (423)..(423): a, c, t, g, unknown or other
  misc_feature (423)..(423): n is a, c, g, or t
  modified_base (432)..(432): a, c, t, g, unknown or other
  misc_feature (432)..(432): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgcccccaggaaaggccctggaatgggtgctacttatttattgggatggacggttaccgctacagtccatctctgaggagagactcacatcccaccaaggaccaaacccccaaaacacggtacgtccttacaaatcgaccaccacngaccctgcgacacagcccaanatactttcngtgacactaactctaagtaggagacctaccgttggtacgtctacgaccctaaacgttcggttcccgaaccccgttcgggggacccccggtaaaccgtcggtacccacccggtcctccgtacgaccgtcctaacccgaccgaaccgggcccacgtccggtcccttcccccgtcggg

SEQ ID NO: 326175 - DNA, 675 bp, Homo sapiens
  misc_feature: GZ8MTXP02JR0WP.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtagaaacccacacagaccctcacgctgacctgcaccttctctgggttctcactcaactctagtggagtgggtgtggctggtccgtcacgccccgaggaacggcccgtggaagtgggtgctacttattagtggatgtacgtaccgctacagtcatctcgtggaggtaggagactacaccactaccccaaccaacggaaacccaaaccccccgaaaaaccgtacggttaccggtacctaaacaaacgtacgaacccaaccgaacgtaccgggtaccctagtacggaaccacgaacgccctaataacgttactttcgtagtcacctaactacctataagtacggacaccgtacgtagtacgtaccgacgtaaccgtaaacgttcgggtacccccggacccgggtcccgggggtaccccgggaacccgtcggtaaccctccggtcctacccgtcgaccgtcccaacccgaccgtaaccgggccctacggtcccgtccgtcccccgtccggg

SEQ ID NO: 326176 - DNA, 654 bp, Homo sapiens
  misc_feature: GZ8MTXP02JQ77X.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgccccaggaaacggccctggaagtgggtgctacttattatgggatggacggttaccgctacagtccatctctagaggaggacgactcaccataccccgaaccgaaacggaacccaaacccccaaaaacgacggtacggtccttaacaaatacgacccaaccacgtacggaccctgtacggaccacgacgacccaactattactttctggtcaccactacctcgttaaagtacgggacactaccgtagggtactcgtcgaccctaaacgttcggttacccgaccccggtcgggggaccccggtaaccgtcgggtacccacccggttcctcccgtaccgccgtacccctaaccgaacccggaacgggcccctacggtcccggttcccctccccgtccgg

SEQ ID NO: 326177 - DNA, 569 bp, Homo sapiens
  misc_feature: GZ8MTXP02HYD5G.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgccccaggaagccctggaatgggtgcacttattattggatgacggttaccgctacagtccatctctgaggagagactcacatccacaacgaccaaccccaaaacacggtcgtccttacaatcgaccaccactacgaccctgacgacacacgccaacattattctagtcgcacactctaagaggagcacctaggtactcacgaccaaacgttcggttcccgacccgtcgggggacccggaaccgtcggaccacccgtctccctacacgccctaaccgaaccgtaacggcccacgtccgtcccttccccgccgg

SEQ ID NO: 326178 - DNA, 657 bp, Homo sapiens
  misc_feature: GZ8MTXP02HT1BJ.22.38.D05.1.454.CMB.2.raw
  modified_base (283)..(283): a, c, t, g, unknown or other
  misc_feature (283)..(283): n is a, c, g, or t
  modified_base (366)..(366): a, c, t, g, unknown or other
  misc_feature (366)..(366): n is a, c, g, or t
  modified_base (379)..(379): a, c, t, g, unknown or other
  misc_feature (379)..(379): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgccccaggaacgccctggaatgggtncacttattagtggatgacgttaccgctacagtccatctcgtgaggagagactcacatcccaacaacgaccaaaccccaaaacnggtcgtccttaanaactacgacccacagtcgaccctagtcgacacacgacccaatacttatttctagtcacaaccactactaatacggagtccaccgtgtaacgtctacggtaacctaaacggttccggttaccggacccccggtacgggggtacccccggggtaaacccgtttccggggtaccctaaccggttccctaccccgtaccgtacccggacccgttaaccccgaaacccggaaaccggggtcccctaacgttccccggttacccgttttaccccccgtccgggg

SEQ ID NO: 326179 - DNA, 714 bp, Homo sapiens
  misc_feature: GZ8MTXP02JQXIL.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtggtgtgggctggttccgtcagccccaggaacggccctggaatgggtgcacttattatggatgacgttaccgctacagtccatctcgtgggaggtagacgtacaccacgtactaccccaaccgaaccgaacccccaaaaacccgaaacggtacggtacgtacctaaactaacgtaccaccactacgaccgtaccgtaggaccgacgacgaccgactactatttacttgtcgtacaccactactagtacgtacggactaccgtacggttacgtacgttacgtaccgtaaaccgttaacggttacccggtaaccccggtacccgggggtaccccggggtaacccccggtaccgggtaccggtaacccccgttcccggtcccttacccgacccggttaccccgtacccccgtaaccccgtaaaacccgggccccggtacccgttacccggttccccggttttccccccgcccgggtcccccgg

SEQ ID NO: 326180 - DNA, 645 bp, Homo sapiens
  misc_feature: GZ8MTXP02GKNHN.22.38.D05.1.454.CMB.2.raw
  modified_base (308)..(308): a, c, t, g, unknown or other
  misc_feature (308)..(308): n is a, c, g, or t
  modified_base (442)..(442): a, c, t, g, unknown or other
  misc_feature (442)..(442): n is a, c, g, or t
  modified_base (466)..(466): a, c, t, g, unknown or other
  misc_feature (466)..(466): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggtccgtcagccccaggaagccctggatgggtgcacttattagtggatgacgttacgctacngtccatctctgaggagagactcacatacccaaccaacgaccaaacccccaaaaacgacggtacgtccttaacaatacgaccaccacgtacggaccctgtacggaaccacgacgacccaatacttactttctgtnaccactactacctaagttacggancctaccgtggtacgtcgtacgacctaaacgttcggtacccgaccccggtcgggggaccccggtaacccgttcgggtaccctaccgggtcctcccgtaccgtaccggtacccctaacccgaacccggaaaccggggtccccctaacggtttccccggttcccctttcccccggtcccggg

SEQ ID NO: 326181 - DNA, 673 bp, Homo sapiens
  misc_feature: GZ8MTXP02JGI4G.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacacgaccctcacgctgacctgcaccttctctgggttctcactcaactctagtggagtgggtgtggctggttccgtcacgccccgaggaaacggccctggaagttgggttcgctactttatttagttgggatggtacggttaccgctacagtcctatctcgtaggaggaggtagacctcaccactacccaacccgaaacggaaccccaaacccccaaaaacgacgggttacggtaccttaacaaacgtacgaacccaaccgacgtacggaccctggtacggaaccaacgacgacccaactacttactttctgtcgaccactacttctaacgtacggagaccgtacgttaggtacgtccgtacgtaccctaaacgttcggttacccggaaccccggttcgggggacccccggtaacccgtcgggtaccctacccggtcctcccgtacgaccgccctaaccgaccgaaccggcctacgtccggtcccttcccgtcgg

SEQ ID NO: 326182 - DNA, 640 bp, Homo sapiens
  misc_feature: GZ8MTXP02JUM8W.22.38.D05.1.454.CMB.2.raw
  modified_base (441)..(441): a, c, t, g, unknown or other
  misc_feature (441)..(441): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggtccgtcagccccaggaagcctggatgggtgcacttattatggatgacggttacgctacagtccatctctgaggaggagactcacatacccaccaacgaaccaaccccaaaacacggtacgtccgttaacaatacgaccaccagtcgaccctggtggaaaccacgacgtaccaactattaatttccgtagtacnccaaactagtacctatacggagccgtaccgtagtacgtctacgtaccctaaacgttcgggttacccgaccccgggtaccgggggaccccggtaacccgttcggacccgtacccgttacctccgtccggacgtacccctaaccgaacccggtaaaaccgggcccctaacgtttcccgggttcccctttccccgtacccgg

SEQ ID NO: 326183 - DNA, 693 bp, Homo sapiens
  misc_feature: GZ8MTXP02G369L.22.38.D05.1.454.CMB.2.raw
  modified_base (354)..(354): a, c, t, g, unknown or other
  misc_feature (354)..(354): n is a, c, g, or t
  modified_base (470)..(470): a, c, t, g, unknown or other
  misc_feature (470)..(470): n is a, c, g, or t
tcagacatacgcgtcacgaccggtgctcgatttagtatctgatagttggggtttggggagtgactcctgtgccccaccatggacacactttgctccacgctcctgctgctgaccatcccttcatgggtcttgtcccagatcaccctgaaggagtctggtcctacgctggtacgaaacccacacagaccctcacgctgacctgctaccttctctgggttctcactcaactctagtggagtgggtgtgggtctcggtccgtcacgaccccgaaggaaacggcccgtaggaagtgggtcactacgttagtttagtggatggaccggttacgctacgcgtccatctagtggaggaganactacacactaccaacgaacgaaccaaaccccgaaaacgtacggtacgttacctaacaaataccgaaccaccgacgtacgtaccctgacgaaccagacaacactaattcttaccgngtacgacacttactctaaagagggtacaccgtacgttaggtaactcgtaaccggtaaccgtaaacgttccgggtaacccggtacccccggtttccggggggaacccccggttaacccgttacggggtcccctaacccgttaccgttccccgtaaccgcccgtaccctaaccggacccgtaaacccggtccctacgttcccggtttccccctaccccggtccgg

SEQ ID NO: 326184 - DNA, 708 bp, Homo sapiens
  misc_feature: GZ8MTXP02F96FQ.22.38.D05.1.454.CMB.2.raw
  modified_base (475)..(475): a, c, t, g, unknown or other
  misc_feature (475)..(475): n is a, c, g, or t
tcagacatacgcgtcacgaccggtgctcgatttagtatctgatagttgggtttggggagtgactcctgtgcccaccatggacacactttgctccacgctcctgctgctgaccatcccttcatgggtcttgtcccagatcaccctgaaggagtctggtcctacgctggtagaaacccacacagaccctcacgctgacctgcaccttctctggtctcactcaactctagtggagtgggtgtgggctggttccgtcacgccccaggaaacggccctggaatgggtgcacttattatggatgacggttaccgctacagtccatctctgaggaggagactcaccactaccaaccgaacggaaccaaacccccaaaaacgacggtacggtccttaacaaactacgaacccaccatcggaccctgtaggaaccacgacgaccactaatactttctagtcgacactactcctaagtacggtanacctaccgttggtacgtctacgtaacccgtaaaacgttccggggttacccgacccccgggttcgggggtaaccccccgggtaaaccccggtttcggggtacccctaaaccccgggtttccgttccccttaaccgacccgtacccccttaacccccggaaaacccggtaaacccgggggaccccccttaaacggttccccggtttacccccgtttaccccccgttccccggggg

SEQ ID NO: 326185 - DNA, 681 bp, Homo sapiens
  misc_feature: GZ8MTXP02JWGH4.22.38.D05.1.454.CMB.2.raw
  modified_base (330)..(330): a, c, t, g, unknown or other
  misc_feature (330)..(330): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtggctggttccgtcacgccccgaggaaggccctggaagtgggtgctacttatttagtgggtatggtacggttaccgctacagtccatctntgaggaggagactcaccatacccaccaacgaccaacccccaaacgaggtcgtcctacaatcgaccacactacggacctgtacggaccacacgccaatattacttctgtacgaccactactcgtaatagggacgtcctacggtcgtaacgtccgtacgacccgtaaaacggttcggttaccccggacccccggggtcgggggtaccccccggggtaaacccgttccggggttaccccgtaacccgggttccctcccgttacccgacccgtacccccgtaaccccggtaaaccccgaaaccgggggtccccctaacggttcccccggtttacccgttccccccccggtccggg

SEQ ID NO: 326186 - DNA, 603 bp, Homo sapiens
  misc_feature: GZ8MTXP02GUNZU.22.38.D05.1.454.CMB.2.raw
  modified_base (434)..(434): a, c, t, g, unknown or other
  misc_feature (434)..(434): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtggggtgtgggctggttccgtcagcccccaggaaaggccctggaatgggtgcacttattatggatgacgttacgctacagtccatctctgaggaggagactcacatccaccaaggaccaacccccaaaaacacggtaggtccttaacaatcgaccaaccatacggaccctgtacggacacagccacaattactttctgtnccaacacgttctaataggaagcctaaccgtggtaactctgaccaaaacgttcggttaccgaaccccggtcgggggacccccggtaaccctgggtcccacccggttcctcccgtaccgcgccctccaacccgaacgggtcccacgttccgggtccctttcccccggtcgg

SEQ ID NO: 326187 - DNA, 624 bp, Homo sapiens
  misc_feature: GZ8MTXP02HXKP9.22.38.D05.1.454.CMB.2.raw
  modified_base (489)..(489): a, c, t, g, unknown or other
  misc_feature (489)..(489): n is a, c, g, or t
tcagacatacgcgtcacgaccggtgctcgatttagtatctgatagttgggtttgggggaggaactgctcagttaggacccagagggaaccatggaagccccagctcagcttctcttcctcctgctactctggctcccagataccaccggagaaattgtgttgacacagtctccagccaccctgtctttgtctccggggaaagagccaccctctcctgcagggccagtcagaatgttagtagttacttagcctggtaccagacaaagcctggccaggcctcccagactcctcatctctgatacatacccaaacgacggggccacgtcggcaacgtccccgagccgtaggttcaggtcggcgtagggtcgggtcgtacgggacacgtacttccaactcctaccaacctatccgacgccgaacctaggacgtccgtaggtaagttatttcggatttaagttttacttacgtagtacagccgagtccggttanctacgtccgtccgtcccgttaccgtaccgtaccgtacggaccggtacgggaccgtacgtacgtacggacgaacgtaaaccgaaacgtacgtcggtcgcgacgaaccacgtactctcgttaccttactacctcccg

SEQ ID NO: 326188 - DNA, 628 bp, Homo sapiens
  misc_feature: GZ8MTXP02FXP2X.22.38.D05.1.454.CMB.2.raw
  modified_base (438)..(438): a, c, t, g, unknown or other
  misc_feature (438)..(438): n is a, c, g, or t
  modified_base (466)..(466): a, c, t, g, unknown or other
  misc_feature (466)..(466): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgcccccaggaaacggccctggaatgggtgctacttattatggatgacggtccgctacagtccatctctgaggaggacgactcaccatacccaaccaaacggaaccaaacccccaaaaaccgacggtacggtccttaacaaactacgaccaaccagtcgaccctgtacgacacacgaccaanagttactttcgtgtcgacacactactanagggtacactaccgttggtactctacgaccctaaacgttcggttacccggaccccggttcggggaccccgggtaacccgtggtccctaacccggtctacccgtacgaccgtccctaaccgaacccgaacggggtccccagtcccgtacccgtccccgtccgg

SEQ ID NO: 326189 - DNA, 597 bp, Homo sapiens
  misc_feature: GZ8MTXP02IITWP.22.38.D05.1.454.CMB.2.raw
  modified_base (282)..(282): a, c, t, g, unknown or other
  misc_feature (282)..(282): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaagccctggaatgggtncacttattattgggatgacggttaccgctacagtccatctctgaggaggagactcaccataccaccaagaccaacccccaaaaacaggtcgtcctaacaatacgaccaccatcggaccctgtgacacacgccacattatttctagtgaccactactcttataggacgcctaccgtggtacgttcgtacgaccctaaaacgtcggttacccgaccccggtccgggggaccccgggtaaacccgtcggtccacccggtcctccgtccacgccctcccgaaccgaacggcccacgtcccggttccttcccccgtccgg

SEQ ID NO: 326190 - DNA, 649 bp, Homo sapiens
  misc_feature: GZ8MTXP02GOLFZ.22.38.D05.1.454.CMB.2.raw
  modified_base (427)..(427): a, c, t, g, unknown or other
  misc_feature (427)..(427): n is a, c, g, or t
  modified_base (446)..(446): a, c, t, g, unknown or other
  misc_feature (446)..(446): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggtgcacttattattggatgacggttaccgctacagtccatctctgaggaggagactcacatccaacaacgaccaacccccaaaacaggtacgtcctacaatcgaccaccatacgaccctgtcggacacagccactatacttctgtnacactactctaagtagganacctaccgtggtaacgtcgtcgacctaaaacgttcggttacccgtacccccggtcgggggtacccccgggtaaacccgtcgggtacccgtaaccccggttaccctcccgttacccgaccggtacccctaacccgaaaccccggtaaacgggggtaccccttacgttccccggggttacccctttaccccccggttcccggggg

SEQ ID NO: 326191 - DNA, 682 bp, Homo sapiens
  misc_feature: GZ8MTXP02FK1LF.22.38.D05.1.454.CMB.2.raw
  modified_base (464)..(464): a, c, t, g, unknown or other
  misc_feature (464)..(464): n is a, c, g, or t
  modified_base (490)..(490): a, c, t, g, unknown or other
  misc_feature (490)..(490): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgccccgaggaaacggccctaggaatgggtgctacttatttatgggatgacggttaccgctacagtccatctctggaggaggagactcaccatcccaaccaaacggaaccaaacccccaaaaaccgacggttacggtcccttaacaaatcgaacccaccacgtcggacccctgtacggaaccacgaacgcccaactattacttttcgnggtcacaccacttactaagtaggacnctaaccgttggtacgtctcgaccgtaaaccgtcgggttacccggaccccggtacgggggacccccgggaaacccgttcggggtacccctacccggttccctacccgttaccgacccgtaccccgtaaccccgaacccgtaaaccgggggccccctacggttccccgggttcccctttccccccggtccgggg

SEQ ID NO: 326192 - DNA, 602 bp, Homo sapiens
  misc_feature: GZ8MTXP02JFWXZ.22.38.D05.1.454.CMB.2.raw
  modified_base (256)..(256): a, c, t, g, unknown or other
  misc_feature (256)..(256): n is a, c, g, or t
  modified_base (423)..(423): a, c, t, g, unknown or other
  misc_feature (423)..(423): n is a, c, g, or t
  modified_base (439)..(439): a, c, t, g, unknown or other
  misc_feature (439)..(439): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcngccccaggaaaggccctggaatgggtgctacttatttagttgggatggacggttaccgctacagtccatctctgaggagagactcaccatccaccaacggaccaacccccaaaaacacggtcgtccttacaaatcgaccaccatcgaccctgtggacacagcccaanatatttctagtcgacncactctaatacggagcaccgttggtagtctacgaccaaaacgttcggttaccgaccccgtcgggggtaccccgaacggaaccccgttcggtaccaccggttcctaccctcaccgcccgtacccgacccgaacggggccccacgttccggtccctttcccccgg

SEQ ID NO: 326193 - DNA, 582 bp, Homo sapiens
  misc_feature: GZ8MTXP02I73XV.22.38.D05.1.454.CMB.2.raw
tcagacatacgcgtcacgaccggtgctcgatttagtatctgatagttgggtttgggggagtgactcctatgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggttgcacttattattgggatgacggttacgctacagtccatctctgaggaggagactcaccatccaccaagacacccccaaaacagtgtccttacaatgaccaccatcggaccctgtggacacacgccactatacgtttctagtcgacacacgtctataggagcaccgtggtacgtctcgaccaaaacgttcggttaccgaccccgttcgggggaccccgggaacccgtcggtcccgaccgtccgtcctcacggccctccgacccgtaacgggccccacgtccggtccttccccgtccgg

SEQ ID NO: 326194 - DNA, 585 bp, Homo sapiens
  misc_feature: GZ8MTXP02H1MMZ.22.38.D05.1.454.CMB.2.raw
  modified_base (426)..(426): a, c, t, g, unknown or other
  misc_feature (426)..(426): n is a, c, g, or t
  modified_base (447)..(447): a, c, t, g, unknown or other
  misc_feature (447)..(447): n is a, c, g, or t
  modified_base (536)..(536): a, c, t, g, unknown or other
  misc_feature (536)..(536): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggtgcacttattattgggatgacggttacgctacagtccatctctgaggaggagactcaccatcccaccaaggacaacccccaaaacaggtgtccttaacaatcgaccaccatcgaccctgtaggacacagcccaacattatttcngtcgcacactctaatagggancaccgtgtacgtcgtagaccaaagttcggttacaccccggttcggggaccccgggaaccttcgggtccacccggttctaccgttacccnccgcctaacccgaccgaccggaccgtaccgtccgttccgttcccgtccg

SEQ ID NO: 326195 - DNA, 706 bp, Homo sapiens
  misc_feature: GZ8MTXP02IDCCR.22.38.D05.1.454.CMB.2.raw
  modified_base (268)..(268): a, c, t, g, unknown or other
  misc_feature (268)..(268): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggtcgtcacgcccaggaagccnggatggtgcattattagtggatgtacggttaccgctacacgtcatctcgtgaggagagactcacatacccaaccaacgacccaacccccaaaacacggtacgtccttaacaatacgaccaaccgactacggaccctgtacgaacaccacgacctaactattactttcgtagtactactaacctaccttacgtaacgtaaggtacgtacccgtaccggttgggtaaccgttaccgtacggtaaccctaaacggtttccgggtaccccggtacccccggggttacccgggggtacccccggggtaacccggttccgggttacccctaccccggttccttacccccgtcgtaacccggtcccctaaccccggaaccccggaacccggggtacccctaccgggtttcccccggtttaccccgtttaccccccggccccgggg

SEQ ID NO: 326196 - DNA, 731 bp, Homo sapiens
  misc_feature: GZ8MTXP02IL9DG.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgctaccttctctgggttctcactcaactctagtggagtgggtgtgggctggtccgtcacgccccaggaaacggcctggaagtgggtgctactttattagtgggatggtacggtaccgctacagtccatctctgaggaggagactcaccatacccaaccgaacggaacccaaaccccccaaaaaccgacgggttaccggtaccttaacaaacttacgaacccaccgtagtacggacccgtagtacggacaacgcgaccaactattactttctggtcactacacttaccgtaagttacgggacgtccctaaccgtcgggttaacgttccgtacggtaacccctaaaacggttcccggggtttaacccggacccccggggttccgggggtacccccgggttaaacccgttcggggtaccccgttaacccggttccttaccccgtacgtacccggttcccctaaccccgaaaccccggtaaaccggggtcccctaaccggtttccccggggtttccccttccccccggttcccgggg

SEQ ID NO: 326197 - DNA, 646 bp, Homo sapiens
  misc_feature: GZ8MTXP02IF35C.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgccccaggaaaggccctggaatgggtgctacttattatggatgacggttacgctacagtccatctctggaggaggagactcacactaccaccaacggaaccaaacccccaaaaccgacggtcgtccttacaatacgacccaccagtcggaccctgtggacacgacgccactattactttctgtcgacactactctaagtaggacgctaccgtggtacgtcgtacgacctaaaacgttcggttacccggaccccggtccgggggtaccccgggtaacccgttcggtacctacccggtccttccctccgtaaccgtccccgttaacccgaacccggtaaaccgggggtccccctaacggttccccgggtttcccttcccccccggtccggg

SEQ ID NO: 326198 - DNA, 678 bp, Homo sapiens
  misc_feature: GZ8MTXP02IVE1V.22.38.D05.1.454.CMB.2.raw
  modified_base (460)..(460): a, c, t, g, unknown or other
  misc_feature (460)..(460): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtggctggttccgtcacgccccaggaacggccctggaatgggtgctacttattagtggatgacggttaccgctacacgtaccatctcgtgaggaggagactacaccactccaaccaacgaaccctaaacccccaaaacgacggttacgtccttaacaatacgaccaccacgtcggaaccctgacggaaccacgacgacctaactactttatttcacggttnaaccacctaacttacgtaaagtaacggtacgaccgtacccggttaggtacggtactacggaaccctaaaacggttcggttacccgtacccccgggtacccgggggacccccgggggtaaaccccgtcggtaccccgtaccggtaccctcccgttccgaacgccctaacccgaccgtaaccggccccgtacgtcccgttccccgttcccccgtcccggg

SEQ ID NO: 326199 - DNA, 672 bp, Homo sapiens
  misc_feature: GZ8MTXP02ICGFO.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctggttctcactcaactctagtggagtgggtgtgggctggttccgtcacgccccagggaaaggccctggaagtgggttgctacttatttagttgggtatgacggttaccgctacagtccatctctgaggagagactcacataccaaccaacgaccaacccccaaaaacgacggtacgtaccttaacaaataccgaacccaaccacgtaccggtaccctgtacggaaccaacacgcccaaactattaacttttctgtcgacaacacttacctaagtacggtacgacctaccgtggtagtcctacggtaccctaaaaccgttcggttacccgtacccccggtcgggggtacccccgggtaacccgtcgggtaccctacccgtcctcccgttacgaacccgtcccgtaaccccgaaccggaaccggtaccccctaacgttcccccggttccctttcccccgtcccggg

SEQ ID NO: 326200 - DNA, 602 bp, Homo sapiens
  misc_feature: GZ8MTXP02HF01Y.22.38.D05.1.454.CMB.2.raw
  modified_base (482)..(482): a, c, t, g, unknown or other
  misc_feature (482)..(482): n is a, c, g, or t
  modified_base (566)..(566): a, c, t, g, unknown or other
  misc_feature (566)..(566): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagccccaggaaacggccctggaatggggttgcacttatttattgggatgacggttaccgctacagtccatctctgaggaggagactcaccatcccaaccaacggaaccaaccccccaaaaaccgacggttacgggtccctttaacaaactcggaacccaaccgatcgggaacccctggtacggaaccacgagcccaaccattacttctgtgcacactctaataggancaccgtggtagtctacgaccaaactcgggtttaccgaccccgtcgggggaccccggaaccgtcggtccaccggtcctccgtacncgcctccgacacggcccatcccggtctccccgtcgg

SEQ ID NO: 326201 - DNA, 583 bp, Homo sapiens
  misc_feature: GZ8MTXP02JCY7P.22.38.D05.1.454.CMB.2.raw
  modified_base (202)..(202): a, c, t, g, unknown or other
  misc_feature (202)..(202): n is a, c, g, or t
  modified_base (287)..(287): a, c, t, g, unknown or other
  misc_feature (287)..(287): n is a, c, g, or t
tcagacatacgcgtcacgaccggtgctcgatttagtatctgatagttgggtttgggggaggaactgctcagttaggacccagagggaaccatggaagccccagctcagcttctcttcctcctgctactctggctcccagataccaccggagaaattgtgttgacacagtctccagccaccctgtctttgtctccggggaaanagccaccctctcctgcagggccagtcagaatgttagtagttactagcctggtaccagcaaagcctggccaggctcccagactccncatctctgatacatccaacacggccactggcatccccagccaggttcagtgcagtggtctgggacagacttcactctcaccatccagcacctagacgcctagaacgtatttgcgtatttagttactgtacacgcagcgtacgctagtccgtcgggtaccctaccggtacctacccgtttcgggacccgtaacgggggaaccccaaggaccgttagggaacgaaactaaccggaaaacgaaaccgtttgacggacttacgaaccgtactaacttcgtgttccttactactttccccg

SEQ ID NO: 326202 - DNA, 638 bp, Homo sapiens
  misc_feature: GZ8MTXP02IYLPJ.22.38.D05.1.454.CMB.2.raw
  modified_base (470)..(470): a, c, t, g, unknown or other
  misc_feature (470)..(470): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgccccaggaaacggccctggaagtgggttgctacttatttagttggatgacggttaccgctacgagtccatctctgaggaggagactcacatcccaccaacgaccaaacccccaaaacgacggtacggtccttaacaatacgacccaccacgtcggtacccctgtacgacaacgacgaccaacattatttctgtcgactacactctatagganctacgtggtacgtctcgacctaaacgttcggttacccgacccgggtacgggggtacccccggtaacccgttcggtaccgtacccggttcctcccgttaccgaccgttccccaacccgaacccgtaacggggacccctacggttcccggttcccttcccccgtccgggg

SEQ ID NO: 326203 - DNA, 663 bp, Homo sapiens
  misc_feature: GZ8MTXP02HHMPK.22.38.D05.1.454.CMB.2.raw
  modified_base (269)..(269): a, c, t, g, unknown or other
  misc_feature (269)..(269): n is a, c, g, or t
  modified_base (471)..(471): a, c, t, g, unknown or other
  misc_feature (471)..(471): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtcgaaacccacacacgaccctcacgctgacctgcaccttctctggttctcactcaactctagtggagtggtgtggctggtccgcacgccccaggaacgccnggagtggtgctacttattagtggatgacggttaccgctacagtccatctcgtggaggaggacgactcgaccatacccaaccgaacgaacccaaaccccaaaacgaggtacgtaccttaacaactacgacccaccgatcggaccctgtcgaaccacacgaccatagttactttcagtcgactacctacttcgtaagtaggacnccgtacgtaggtacgtacgtacgaaccctaacggttccggtaccccggaccccgggtacgggggacccccggtaacccgttcggtacccaccgggtttccctaccgtccctaaccggtacccctaaccccggaacccgtaacccggggtacccctacggtttccccggtcccccgtttacccccggcccggg

SEQ ID NO: 326204 - DNA, 671 bp, Homo sapiens
  misc_feature: GZ8MTXP02HJHHI.22.38.D05.1.454.CMB.2.raw
  modified_base (226)..(226): a, c, t, g, unknown or other
  misc_feature (226)..(226): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtagaaacccacacagaccctcacgctgacctgcaccttctctggttctcactcaactntagtggagtgggtgtggctggtccgtcacgccccgaggaacggccctggaagtgggttgctacttatttagtgggatggacggttaccgctacagtccatctcgtgaggagagactacaccatacccaaccgaacgaaccctaaacccccaaaacgtacggtacgtaccttaacaaactacgaacccaccacgtcggaccctgtacgaaccacgacgacccaatattactttcgtacgtcgaccaactaacttacctaagtaacgggtacgaccgtaaccggttggtaacgtctacgaacccgtaaacgttccgggttacccggacccccgggtcgggggtacccccgggtaacccgttcgggtaccctacccggtcctcccgtaacgccgtacccaacccgaacccgaccgggtccctaccgtccggtcccctttcccgcccgg

SEQ ID NO: 326205 - DNA, 665 bp, Homo sapiens
  misc_feature: GZ8MTXP02JBLVD.22.38.D05.1.454.CMB.2.raw
  modified_base (444)..(444): a, c, t, g, unknown or other
  misc_feature (444)..(444): n is a, c, g, or t
  modified_base (467)..(467): a, c, t, g, unknown or other
  misc_feature (467)..(467): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgccccaggaaacggccctggaatgggtgctacttattagttgggatgacggttacgctacagtccatctctgaggaggagactcacatacccaccaacggaccaacccccaaaaaccgacggtacggtccttaacaatacgaccacagtacggaccctgtaggaaccacacgccaacattactttcngtcgcactactactagacggtanactaccgttggtaacgtctacgtaccctaaaacgttcgggttacccgaccccggttcgggggacccccggtaaacccgttcggggtaccctacccggttaccttcccgtaccgtaccgtacccccgttaacccgaacccggtaaaaccggggtcccccaacggtttccccgggtttccccctttcccccggtcccggg

SEQ ID NO: 326206 - DNA, 641 bp, Homo sapiens
  misc_feature: GZ8MTXP02FUL05.22.38.D05.1.454.CMB.2.raw
  modified_base (322)..(322): a, c, t, g, unknown or other
  misc_feature (322)..(322): n is a, c, g, or t
  modified_base (500)..(500): a, c, t, g, unknown or other
  misc_feature (500)..(500): n is a, c, g, or t
  modified_base (515)..(515): a, c, t, g, unknown or other
  misc_feature (515)..(515): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtacgaaacccacacacgaccctcacgctgacctgcaccttctcgtggttctcactcaactcgtagtggagtggtgtggctggtccgtcacgccccgaggaacgcctgagtgggtgctacttattagtggatgtacgttacgctacagtccatcncgtggaggaggtagacctcaaccatacccaacccgaaacggaaccccaaaacccccgtaaaaacgtaccgggttacgttacccgttaaacaaactaccgaaccccaaccgtacgttaccggggacccttagggcgaaacccacgaacgtacccaactactttattctaggtcacctanacctatagtaacggnacctacggttagacgtactacgaccgtaaacgttccggttaccgacccgggtcgggaccccgtacgtcggtacctccgtctccagccgccaaccgaccggacgccctcgtccgtcccgtccctcgg

SEQ ID NO: 326207 - DNA, 708 bp, Homo sapiens
  misc_feature: GZ8MTXP02HGLVZ.22.38.D05.1.454.CMB.2.raw
  modified_base (220)..(220): a, c, t, g, unknown or other
  misc_feature (220)..(220): n is a, c, g, or t
  modified_base (288)..(288): a, c, t, g, unknown or other
  misc_feature (288)..(288): n is a, c, g, or t
  modified_base (317)..(317): a, c, t, g, unknown or other
  misc_feature (317)..(317): n is a, c, g, or t
  modified_base (352)..(352): a, c, t, g, unknown or other
  misc_feature (352)..(352): n is a, c, g, or t
  modified_base (533)..(533): a, c, t, g, unknown or other
  misc_feature (533)..(533): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtacgaaacccacacacgaccctcacgctgacctgctaccttctcgtggttcncactcaactgtagtggagtgggtcgtgggctggtccgtcacgccccgaggaacggcctaggatgggtnctattattagtggatggacgtacgctacncgtcatctacgtggagggagacacctacaacctanaccccgaacccgaaaccggaaccccaaaaccccccgaaaaacgtacggttacgttacccgttaaacaaacgtaccgaaacccaccgtaacgtaccgggtaccccgtaggtaccggaaacccaacgaccgaaccaacttatttacctttcgttgcaccaactacttcttaaagacgggtacnctaacgttgtacgtctaccgaccgtaaacgtccgggttcccgaccccgggtacgggggtacccccgggtaccgttccggtacccgtacccgtccctaccgtccctaccggaccccctaacccgaaccggaacccgggtcccctacgtttccccggttcccgttaccccgcccggg

SEQ ID NO: 326208 - DNA, 633 bp, Homo sapiens
  misc_feature: GZ8MTXP02HIH7U.22.38.D05.1.454.CMB.2.raw
  modified_base (476)..(476): a, c, t, g, unknown or other
  misc_feature (476)..(476): n is a, c, g, or t
  modified_base (500)..(500): a, c, t, g, unknown or other
  misc_feature (500)..(500): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtacgaaacccacacacgaccctcacgctgacctgctaccttctcttgggttctcactcaactctaggtggtaggtgggtgtgggtcttcggttccgtcacgccccgaagggaacggccgtaggaagtgggtgactattattagtggatgacgtacgctacacgtcatctcgtaggaggaggacgactcaaccacacccaaccgaaacgaacccaaaccccaaaaacgtggtacgtaccttaaacaaactacgaacccaacacgtacgaccctagacgaacacacgtaccaacttattactttcagacncaactacttacgtaagtacggacncgtaccgtagtacgtacaccgaaccgtaaacggttccggtacccggaccccggtccggggaccccgaccgttcggacctacccgtctccaccacgccaaccgacgaacggtcccacgtccgtcccttcccgcg

SEQ ID NO: 326209 - DNA, 662 bp, Homo sapiens
  misc_feature: GZ8MTXP02HUDG8.22.38.D05.1.454.CMB.2.raw
  modified_base (401)..(401): a, c, t, g, unknown or other
  misc_feature (401)..(401): n is a, c, g, or t
  modified_base (408)..(408): a, c, t, g, unknown or other
  misc_feature (408)..(408): n is a, c, g, or t
  modified_base (438)..(438): a, c, t, g, unknown or other
  misc_feature (438)..(438): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctggttctcactcaactctagtggagtgggtgtggctggtccgtcacgccccaggaacgcctggaagtgggtgctacttatttagttggatgacggttaccgctacagtccatctcgtgaggagagactcaccatacccaaccaacgaccaaacccccaaaacgcggtacgtcctaacaatacgacccaccacncgacccngtacggacacgacgaccactattactttcngtcgaccaactactcgtaagtaacggacgtacctaacgttggtagtccgtacgaacccgttaaacgttcgggttaccccgaccccggtcgggggacccccgggtaaaccgttccggggtaccctacccggttccctacccgtcccgtaaccggtcccctaacccgaaacccggaaacccggggtcccctacggtttcccccggtcccctttcccccggcccggg

SEQ ID NO: 326210 - DNA, 664 bp, Homo sapiens
  misc_feature: GZ8MTXP02GD7ZW.22.38.D05.1.454.CMB.2.raw
  modified_base (470)..(470): a, c, t, g, unknown or other
  misc_feature (470)..(470): n is a, c, g, or t
tcagacatacgcgtcacgaccggtgctcgatttagtatctgatagttgggtttgggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgccccaggaaacggccctggaatgggttgctacttattagtgggatgtacggttaccgctacagtccatctctggaggaggacgactcaccatcccaaccgaaacggaaccaaacccccaaaaacgacgggttacggtcccttaaacaacgtacgaacccaaccacgtacggaccctggtagaaccacacgacccaactatacttttcagtnaccaactacttactagtacggacgtacctaccgtggtaacgtcgtcgaaccctaaacgttcggtacccgaccccggtcgggggtaccccgggaaacccgttgggtaccctaccggttcctaccctacgaaccgtccctaacccgaacccgaacggggtccccctaagtccccggttcccgttcccccgtccggg

SEQ ID NO: 326211 - DNA, 706 bp, Homo sapiens
  misc_feature: GZ8MTXP02FGAME.22.38.D05.1.454.CMB.2.raw
  modified_base (287)..(287): a, c, t, g, unknown or other
  misc_feature (287)..(287): n is a, c, g, or t
  modified_base (326)..(326): a, c, t, g, unknown or other
  misc_feature (326)..(326): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtacgaaacccacacacgaccctcacgctgacctgctaccttctcttggttctcacttcaactcgtagtggagtgggtgtggctggttcccgcacgccccgaggaacgcctggatgggtnactacttatttagtgggatcggtaccgttaccgctacgngtccatctcgtaggaggtaggacacctcacccgtacacccccaacccgaaaccggaaacccctaaacccccccgaaaaccgacgggttacggttaccccttaaacgaaactccgaacccaaccgtacgtaccggaccccgttggaacggaacccaacgtaccgaccctaacctattacgtttcgttacggcacctaccgtactacctaagtacgggaacctccgtaccgtaaggggtcctaccgtaggaccccttaaagtcccgggttacccggacccccggttcgggggaacccccgtaccgtcggtaccctaccgtcctcccacgccgacccgaacccgaccgaccggacccgaccgtccgtcccgtccccgtcccgg

SEQ ID NO: 326212 - DNA, 662 bp, Homo sapiens
  misc_feature: GZ8MTXP02G2H1F.22.38.D05.1.454.CMB.2.raw
  modified_base (280)..(280): a, c, t, g, unknown or other
  misc_feature (280)..(280): n is a, c, g, or t
  modified_base (314)..(314): a, c, t, g, unknown or other
  misc_feature (314)..(314): n is a, c, g, or t
  modified_base (345)..(345): a, c, t, g, unknown or other
  misc_feature (345)..(345): n is a, c, g, or t
  modified_base (637)..(637): a, c, t, g, unknown or other
  misc_feature (637)..(637): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtacgaaacccacacacgaccctcacgctgacctgcaccttctctgggttctcactcaactctagtggagtggtgtggctggtcgcacgcccgaggaacgcctaggagtggtnactacttagttagtggtatggacgtaccgctacncgtcatcgtctaggaggagacgactcactanaccccaaccgaacgaacccaaacccccgaaaacgtacggtacgtaccttaacaactaccgaaccaccgtacgtacggacccttagacgacccacgacgaccaactattactttcgagttacaccaacgttacctagtaaacgtacggacgtaccgttacggttagggtaccttccgaaccgtaccttaaacggttccgggttacccgaaccccgggtcgggggtacccccggtaacgtcggtaccgacccgttcacccgtacgccgtaccaacccgaacgacccgggtaccncggttcccgtaccccttccggcccg

SEQ ID NO: 326213 - DNA, 576 bp, Homo sapiens
  misc_feature: GZ8MTXP02JI2G5.22.38.D05.1.454.CMB.2.raw
  modified_base (367)..(367): a, c, t, g, unknown or other
  misc_feature (367)..(367): n is a, c, g, or t
  modified_base (414)..(414): a, c, t, g, unknown or other
  misc_feature (414)..(414): n is a, c, g, or t
  modified_base (437)..(437): a, c, t, g, unknown or other
  misc_feature (437)..(437): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggtgctacttatttatggatgtacgtacgctacagtccatctctgaggaggagactcaccatcccaccaagaccaacccccaaaacncggtcgtccttacaatcgaccaccatcgaccctgtgacacagaccanatattctgtgacactactctaanaggagtcaccgtggtcgtctacgacctaaacgtggttacccgacccgcgggggacccggtaaccctggacccaccggtcctccctaccgacgccctaaccgacccgaacgggtccccagtcccggttcctccccgtcgg

SEQ ID NO: 326214 - DNA, 636 bp, Homo sapiens
  misc_feature: GZ8MTXP02G9HWU.22.38.D05.1.454.CMB.2.raw
  modified_base (436)..(436): a, c, t, g, unknown or other
  misc_feature (436)..(436): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggtccgtcagccccaggaaaggccctggaatgggtgcacttattagtggatgacggtacgctacacgtccatctctgaggaggagactcaccatacccaccaacggacccaaacccccaaaacacggtacggtcctaacaatcgaccacagtcgacccttgcgacacacgaccatattacttctggttancaacactacttaagaggtacgcctaccgtaggtacgtactcgtacctaaacgttcgggttacccgaaccccgggttccgggggaacccccggtaacccgttcgggcccttaaccgggtcgtccccttacgcccggttaccctaacccgaccgtaaaccggggcccctacggtaccccgtcccgtttccccccgtccgggg

SEQ ID NO: 326215 - DNA, 548 bp, Homo sapiens
  misc_feature: GZ8MTXP02I4T37.22.38.D05.1.454.CMB.2.raw
  modified_base (245)..(245): a, c, t, g, unknown or other
  misc_feature (245)..(245): n is a, c, g, or t
  modified_base (332)..(332): a, c, t, g, unknown or other
  misc_feature (332)..(332): n is a, c, g, or t
  modified_base (392)..(392): a, c, t, g, unknown or other
  misc_feature (392)..(392): n is a, c, g, or t
  modified_base (414)..(414): a, c, t, g, unknown or other
  misc_feature (414)..(414): n is a, c, g, or t
  modified_base (425)..(425): a, c, t, g, unknown or other
  misc_feature (425)..(425): n is a, c, g, or t
  modified_base (443)..(443): a, c, t, g, unknown or other
  misc_feature (443)..(443): n is a, c, g, or t
  modified_base (510)..(510): a, c, t, g, unknown or other
  misc_feature (510)..(510): n is a, c, g, or t
  modified_base (512)..(512): a, c, t, g, unknown or other
  misc_feature (512)..(512): n is a, c, g, or t
  modified_base (518)..(518): a, c, t, g, unknown or other
  misc_feature (518)..(518): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggntggttccgtcacgccccaggaaacgccctggaatgggtgcacttattagttgggatgacggttaccgctacagtccatctctgaggngagactcacactccaccaagaccaacccccaaaacaggtcgtccttacaatcgaccacanacgacctgtcgacacacgccanattattctgtncactactctatagggacncacgtgtacgtctcgacaaacgttcggttccgacccggttcggggacccgacttcggcaccgtctcncngtcccncgacgacggccacgtccgtcctcccgtcgg

SEQ ID NO: 326216 - DNA, 840 bp, Homo sapiens
  misc_feature: GZ8MTXP02F2WK5.22.38.D05.1.454.CMB.2.raw
tcagacatacgcgtcacgaccggtgctcgatttagtatctgatagttgggtttgggggaggaactgctcagttaggacccagagggaaccatggaagccccagctcagcttctcttcctcctgctactctggctcccagataccaccggagaaattgtgttgacacagtctccagccaccctgtctttgtctccgggggaaagagccaccctctcctgcagggccagtcagaatgttagtagttacttagcctggtaccagacaaaagcctggccaggctcccagactcctcatctctgatacataccaaacgacgggcccaacgtggaccaacgttcccccaaggacccctaaggggtttacccaagggttcggggacctaaggggtttccggggtaccgttacgggggaaccaacgggtaaccctttaccgaacctttcccttacccaaaccccctaaagttacccgaacgggacccgtaaaccccgttaaggaaacgtaccccgttaggtaaacggtaactttttaggaccgttaaaggttttaactttaaacgtttcggttaccgtaaggacgtaaacggtacccggttaaaggccgttaacttcccggttaccggggtccccctttacccccggttaacccgtttaaccccggttttcgggggtaaccccgtaaccggggggtaaacccccaaaagggtacccggttaacggggtaaacgggaacctttaaacccgaaaaaaccgggtaaacccgttagggttaaccggggccttacggaacccgtaacccgtaacgtttaccttacggtttacctttcccgtaactttcccccg

SEQ ID NO: 326217 - DNA, 623 bp, Homo sapiens
  misc_feature: GZ8MTXP02HF06Z.22.38.D05.1.454.CMB.2.raw
  modified_base (253)..(253): a, c, t, g, unknown or other
  misc_feature (253)..(253): n is a, c, g, or t
  modified_base (281)..(281): a, c, t, g, unknown or other
  misc_feature (281)..(281): n is a, c, g, or t
  modified_base (311)..(311): a, c, t, g, unknown or other
  misc_feature (311)..(311): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtacgaaacccacacagaccctcacgctgacctgcaccttctctgggttctcactcaactctagtggagtgggtgtggctggtccncacgccccaggaacgcctggaatgggtnctattattagtggatgacggtaccgctacngtccatctctggaggaggagactcaccatacccaaccaacgaaccaaacccccaaaacaggtacgtcctaacaatacgaccaccacgtcgaccctgtagaccacacgaccactattacttctgtcgacaactactctaagtaggacactaccgttaggtactcgttacgaacctaaacgttcggtaccggaccccggtccgggggaccccggtaaccgttcgggtaccctaccggttcctcccgtacgaccgtcccgtaacccgaaccggtaccgggacccctacggtcccggttccccttcccccgtcggg

SEQ ID NO: 326218 - DNA, 623 bp, Homo sapiens
  misc_feature: GZ8MTXP02GBIIB.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgccccaggaaaggccctggaatgggtgctacttattatgggatgacggttacgctacagtccatctctgaggaggagactcaccatcccaaccaaacggaccaacccccaaaacacggtacggtcctaacaatcgaccaccactcgggaccctgtacgacacacgacccaactattactttctagtcacacactactagtaagggagaccaacccgttggtaacgttctacgacccgtaaaacgttcgggttacccgaacccccggttcgggggaccccgggtaacccgtgggtaccctaccgtccgtccctaccgacggccctccgaaccgaacgggccccacgtcccggtcccttccccgccgg

SEQ ID NO: 326219 - DNA, 711 bp, Homo sapiens
  misc_feature: GZ8MTXP02IJ6SV.22.38.D05.1.454.CMB.2.raw
  modified_base (248)..(248): a, c, t, g, unknown or other
  misc_feature (248)..(248): n is a, c, g, or t
  modified_base (265)..(265): a, c, t, g, unknown or other
  misc_feature (265)..(265): n is a, c, g, or t
  modified_base (273)..(273): a, c, t, g, unknown or other
  misc_feature (273)..(273): n is a, c, g, or t
  modified_base (371)..(371): a, c, t, g, unknown or other
  misc_feature (371)..(371): n is a, c, g, or t
  modified_base (384)..(384): a, c, t, g, unknown or other
  misc_feature (384)..(384): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctggttctcactcaactctagtggagtggtgtggctggtcncacgcccaggaacgccnggatggtnctacttattatggatgacggtacgctacagtcatctcgtgaggagagactcaccatacccaccgaacgaccaaacccccaaacgacggtcgtcctaanaactcgaccacanacgaccctgacgacacagacccaagtattacttcagtcaccaacgtaccttacgtaagtaacgggtacgacccttaaccggttagggttaacgtacccgtaacggtaaaccccgttaaaaccgggtttcccggttacccccgggtaaacccccggggttccggggggtaccccccggtaaaacccgggtttccggggtaaccccctaaccccggttcccgttacccgttacccggaacccgttcccccgaaaccccgtaaacccgggtaacccggggtaccccctaacggtttccccccggttaccccgtttcccccggtccccggg

SEQ ID NO: 326220 - DNA, 591 bp, Homo sapiens
  misc_feature: GZ8MTXP02GT1E5.22.38.D05.1.454.CMB.2.raw
tcagacatacgcgtcacgaccggtgctcgatttagtatctgatagttgggtttgggggaggaactgctcagttaggacccagagggaaccatggaagccccagctcagcttctcttcctcctgctactctggctcccagataccaccggagaaattgtgttgacacagtctccagccaccctgtctttgtcgtccgggggaaagagccaccctctcctgcagggccagtcagaatgttagtagttacttagctggtacagcaaagcctggccaggctcccagactcctcatctctgactacatccaaacgacgggccactggcactcccagccaggttccaggtcggcgtaggtcggggtcgtcggggacacggtaccttcaactcctcaccatcagccgactagacgcctagaagtatttgacttagtttattactgtactagcagcgtagctacgtcgtcgggaccctccgtactaccgtttcggaccggtacggggaccaaggccgttagggaacgtacgtaaccgaaaacggtaccgtgtacggtctacgaaccgtacctacgttctcgttctttacactttccccg

SEQ ID NO: 326221 - DNA, 620 bp, Homo sapiens
  misc_feature: GZ8MTXP02J2GXW.22.38.D05.1.454.CMB.2.raw
  modified_base (443)..(443): a, c, t, g, unknown or other
  misc_feature (443)..(443): n is a, c, g, or t
  modified_base (455)..(455): a, c, t, g, unknown or other
  misc_feature (455)..(455): n is a, c, g, or t
  modified_base (567)..(567): a, c, t, g, unknown or other
  misc_feature (567)..(567): n is a, c, g, or t
  modified_base (576)..(576): a, c, t, g, unknown or other
  misc_feature (576)..(576): n is a, c, g, or t
tcagacatacgcgtcacgaccggtgctcgatttagtatctgatagttgggtttggggagtgactcctgtgcccaccatggacacactttgctccacgctcctgctgctgaccatcccttcatgggtcttgtcccagatcaccctgaaggagtctggtcctacgctggtacgaaacccacacagaccctcacgctgacctgccaccttctctgggttctcactcaactctagtggagtgggtgtgggctggttccgtcacgccccgaggaacggccgtaggaagtgggtgcgtactttatttagtggtatgacggttacgctacagtcatctcgtaggaggaggacgactaccaccactacccaaccgaacgaacccaaacccccaaaacgacggttcggtaccttaacgaactacgaccaccacgtacggaccctgacgaacncaacgccaactnttactttcgtgtcacctacactactaagacggagtacaccggttggtactcgtacgacctaacgttccgggttccgaaccccgggttcgggggacccggaccgtcggtaccnccgtctccncaccgtccgaaccaccggacgccctacgtcccgtcccgtcgccg

SEQ ID NO: 326222 - DNA, 777 bp, Homo sapiens
  misc_feature: GZ8MTXP02G3R2T.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtagaaacccacacacgaccctcacgctgacctgcaccttctctggttctcactcaactcgtagtggtaggtgggtgtgggtcgtggttccgtcacgccccgaggaacggccgtggtagtgggtcgctacttattagtggatgtacggtacgctacacgtcatctcgtaggaggagacgtactacaccactaccccgaaccgaacgaaccccaaaccccgaaaacgaggttacgtacctaacataccgaccacagtacggaccctgtacgaaccacgacgaaccctataactttacttaccgtgtaccaccgtaactaaccttacgtaaagttaacgggaaccgaccgttaccgggttaagggttaaccgttcccgtaaccggttaaaccccgtaaaaccggggtttccccggggttaacccccgggtaacccccgggggtttacccccgggggggaaacccccggttaaaacccccgggtttccgggtacccccgttaaacccgtccccggtttcccaaccccggtaccggaccccctaaccccggaaacccgaacccgggggtccccctacggttccccgtttccccccgtaccccggttccccgggg

SEQ ID NO: 326223 - DNA, 638 bp, Homo sapiens
  misc_feature: GZ8MTXP02GYIPN.22.38.D05.1.454.CMB.2.raw
  modified_base (279)..(279): a, c, t, g, unknown or other
  misc_feature (279)..(279): n is a, c, g, or t
  modified_base (448)..(448): a, c, t, g, unknown or other
  misc_feature (448)..(448): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgcagccccaggaaagcctggatgggtncattattatggatgacgttaccgctacagtccatctcgtgaggaggtagactacacataccaaccaacggaccaaacccccaaaaacgtacggtacgggtaccttaacaaatcgaaccaccaactcggaccctagaggacaacgacaccaacattaactttcgtaggtnacaactaactactaaataggggactaccgaaccgtagggttaacgtcctacggtaaccctaaaacgttcgggtttaaccccggaccccggttaccggggggaccccggaaaccgttcgggtacctaccggtacctcctacgactcccaacaaccgaaacggccctacgtcccggttaccttccccgacgg

SEQ ID NO: 326224 - DNA, 622 bp, Homo sapiens
  misc_feature: GZ8MTXP02FL5EE.22.38.D05.1.454.CMB.2.raw
  modified_base (378)..(378): a, c, t, g, unknown or other
  misc_feature (378)..(378): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgcccccaggaaacggccctggaatgggttgctactttatttagtgggatggtacggttaccgctacgagtccatctctgaggagagactcaccatccaccgaacgaccaacccccaaaacnggtacgtcctacaatacgaccacagcgaccctgtcgacacacgccaactattacttctgtcacacactctaagtaggacgcctaccgtggtacgtctacgaccgtaaacgtccggtaccgacccccggtcgggggaccccggaacccgttcggtcccacccggttcctcccgttacgaccggtccctaacccgaacccggaaccgggcccctacggttcccggtccccgtttcccccgcccggg

SEQ ID NO: 326225 - DNA, 709 bp, Homo sapiens
  misc_feature: GZ8MTXP02IWKTC.22.38.D05.1.454.CMB.2.raw
  modified_base (475)..(475): a, c, t, g, unknown or other
  misc_feature (475)..(475): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagccccaggaaacggccctggaatgggtgctacttattattgggatgacggttaccgctacagtccatctctgaggagagactcacactccaaccaacgaccaacccccaaaacgacggtcgtccttaacaatacgaccaccatacggaccctggtacggaccacgacgacccaatattagtttctgtacgccaactacttccttaaagtacggggaacncccgtaaccgtttgggtaacgttccgttacgacccgtaaaacgttccggggtttacccgacccccgggttcggggggtaccccccgggtaaaaccccgtttgggggtacccctaaccccgggttccttacccgtaccgtaacccgtcccccgtaacccgaaacccccggtaaaacgggggtcccccctaaacggtttcccccgggtttacccgtttcccccccggtcccggggg

SEQ ID NO: 326226 - DNA, 638 bp, Homo sapiens
  misc_feature: GZ8MTXP02G5Y7F.22.38.D05.1.454.CMB.2.raw
  modified_base (252)..(252): a, c, t, g, unknown or other
  misc_feature (252)..(252): n is a, c, g, or t
  modified_base (269)..(269): a, c, t, g, unknown or other
  misc_feature (269)..(269): n is a, c, g, or t
  modified_base (444)..(444): a, c, t, g, unknown or other
  misc_feature (444)..(444): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtagaaacccacacagaccctcacgctgacctgctaccttctctgggttctcactcaactctagtggagtgggtgtggctggtcncacgcccaggaacgccnggagtggtgctacttattagtggtatgtacggtaccgctacacgtcatctcgtggaggagagactcacatacccaacgaacgaacccaaaccccaaaacgacggtacgtacctaacaactacgaccacgacgtcggacccttgacggaaccacgacgaccaacttattactttcncgtacaccactactacgtaagtacggacgacctaccggttaggtacgtcgtacgaccctaaaggttccgggttacccgaccccgggtcgggggtaaccccggacccgttcggtacccgtaccgttcctcccgaccaccggaccctaacccggaacgtaaccgggcctaccggttccgttcccgtcccggtccgg

SEQ ID NO: 326227 - DNA, 649 bp, Homo sapiens
  misc_feature: GZ8MTXP02JG9SH.22.38.D05.1.454.CMB.2.raw
  modified_base (442)..(442): a, c, t, g, unknown or other
  misc_feature (442)..(442): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtggctggttcgtcagccccaggaacggccctggaatgggtgctacttattatggatgacgttacgctacagtccatctctgaggagagactcaccatacccaccaacgaccaaacccccaaaaccagtacggtcctaacaatacgaccaccacgtacggtaccctagtcggaaccacaacgacccaacattacttctggtanaccacacttactaatacgggactactacccgtagggtaactcgtacgtacccgtaaacgttcggttcccgaacccccggtcgggggtaacccccgtaacccgtcgggtaccctaaccccggttcctccccgttaccgaccgtaccccgtcccgaaacccgaacccggggacccctaacggtccccggttcccctttcccccgccggg

SEQ ID NO: 326228 - DNA, 721 bp, Homo sapiens
  misc_feature: GZ8MTXP02JR07D.22.38.D05.1.454.CMB.2.raw
  modified_base (309)..(309): a, c, t, g, unknown or other
  misc_feature (309)..(309): n is a, c, g, or t
  modified_base (448)..(448): a, c, t, g, unknown or other
  misc_feature (448)..(448): n is a, c, g, or t
tcagacatacgcgtcacgaccggtgctcgatttagtatctgatagttgggtttggggagtgactcctgtgcccaccatggacacactttgctccacgctcctgctgctgaccatcccttcatgggtcttgtcccagatcaccctgaaggagtctggtcctacgctggtcgaaacccacacacgaccctcacgctgacctgcaccttctctgggttctcactcaactctagtggagtgggtgtgggctggtccgtcacgccccgaggaacggcctggaagtggtgctacttattagtggatgacggtacnctacagtcatctctggaggagagactacacataccccaaccgaacgaacccaaacccccgaaaacgacggttacgtaccttaacaactacgaccacactacggaccctagacggacacgacacctaatattactttcgngttacgacctactaacttactaacggtacggacgaccgtaccggttagggtaacttccgttaaccggaaccccggttaaaacggttccccgggggtttaaccccggacccccgggggttacccggggggtaacccccgggtaaacccggtttccggggtaccccgtacccggttcccgtacccgtacccgacccggttaccccgtaacccgaaccccgggaaacccgggtcccgtaccggtttccccggtttccccgtcccccggtaccgggg

SEQ ID NO: 326229 - DNA, 607 bp, Homo sapiens
  misc_feature: GZ8MTXP02FSL79.22.38.D05.1.454.CMB.2.raw
  modified_base (369)..(369): a, c, t, g, unknown or other
  misc_feature (369)..(369): n is a, c, g, or t
  modified_base (438)..(438): a, c, t, g, unknown or other
  misc_feature (438)..(438): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctggttctcactcaactctagtggagtgggtgtgggctggttccgtcagccccaggaaaggccctggaatgggtgctacttattattgggatgacggttacgctacagtccatctctgaggaggagactcacatcccaccgaacgaaccaacccccaaaacncggtacggtccttacaactcgacccaccagtcggaccctgacgacgacaacgccactatactttcagtnacactactctaagtaggacgaccacgttggtaacgtcgtacgaccctaaacgtccggttaccgacccccggttcgggggaccccggtacccgtggtcccgtaccgtctcccgtcgactccccgtaaccgaccgaaccggccctacgtcccgtcccgtttcccccgccgg

SEQ ID NO: 326230 - DNA, 691 bp, Homo sapiens
  misc_feature: GZ8MTXP02JNIAS.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtggcgtggttccgtcacgccccgaggaaacggccctggaagtgggtgctacttattagtgggatggtacggttaccgctacagtccatctctgaggaggagactcacatacccaaccgaacgaaccaaacccccaaaacgacggtacggtcctaacaactacgaccaccacgtcgaccctgtcgaacacacgaccaactattacttcctgtacactaacctactaccgttaagtaacgggacgtacccgtaaccgttgggttaaacgttccgtaaccgtaacccgtaaaacggttccgggttaccccggacccccggggtccgggggtaacccccgggtaacccgttcggggtaccctacccgggtcctcccgtacccgaccgtccccgtaacccgaacccggaaccggggtcccctaacgttccccggttccccgtcccccggtaccggg

SEQ ID NO: 326231 - DNA, 637 bp, Homo sapiens
  misc_feature: GZ8MTXP02FMHOT.22.38.D05.1.454.CMB.2.raw
  modified_base (315)..(315): a, c, t, g, unknown or other
  misc_feature (315)..(315): n is a, c, g, or t
  modified_base (446)..(446): a, c, t, g, unknown or other
  misc_feature (446)..(446): n is a, c, g, or t
  modified_base (471)..(471): a, c, t, g, unknown or other
  misc_feature (471)..(471): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggtgcacttatttattgggatgacgttacgctacngtccatctctgaggaggagactcaccatcccaccaaaggaccaaacccccaaaaaccacggtacggtccttacaaatcgacccaccatacggaccctgtaggaccacagcccaactatactttactggtanaccaacacttctaaagttacggganacctaccgttaggtacgttcctacgaccctaaaacggtcggttacccggacccccgtacgggggacccccgggtaccgtcgggtacccacccggtctcccgtaccaccggtccctaacccgaacccggaacgggccctaagtcccggtacccttcccccgtccggg

SEQ ID NO: 326232 - DNA, 691 bp, Homo sapiens
  misc_feature: GZ8MTXP02GYFH1.22.38.D05.1.454.CMB.2.raw
  modified_base (281)..(281): a, c, t, g, unknown or other
  misc_feature (281)..(281): n is a, c, g, or t
  modified_base (310)..(310): a, c, t, g, unknown or other
  misc_feature (310)..(310): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctggttctcactcaactctagtggagtgggtgtggctggtccgtcacgccccaggaacgcccgtaggatgggtnactacttagttagtggatgtacgtaccgntacagtccatctcgtgaggagacgactcaccatacccaaccgaacgaccaaacccccaaaacgacggttacgtccttaacaatacgacccactagtacgacccttgacgaacacgacaccctaacatttaaccgttcgtacgtacgacctaaccttaaccgtcttaaaggacgaaccgtacctaccggtttacggaacgttcctaaccgtaaccgtaaacgttcccggggttaccccggaccccgggtaacccgggggcccccggtaaaaccgtccgggtaccctaccggtccctaccgtacccgacccgttcccgtaacccgaaccgggttaacccgacccctacggtttccccggtcccccgtttacccccgcccgggg

SEQ ID NO: 326233 - DNA, 640 bp, Homo sapiens
  misc_feature: GZ8MTXP02IB87T.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgcccccgaggaaacggccctggaatgggttgctactttatttagttgggatggacggttaccgctacagtccatctctgaggagagactcacatcccaaccgaacggacccaaacccccaaaacgacggttcgtaccttacaatacgacccaccagtcggaccctgtacgacaacacgtccaatattactttctgtcgcacacttactaagtaggacacgtaccgttaggtacttccgtacgtaccctaaaacgtccgggtttacccgaaccccggtccgggggtacccccggaacccgtcgggtaccctacccggtcctccctaccgaccgtacccaaccgacccgaacgggcccctagtcccgttcccgtcccccgtccgg

SEQ ID NO: 326234 - DNA, 782 bp, Homo sapiens
  misc_feature: GZ8MTXP02I5X42.22.38.D05.1.454.CMB.2.raw
  modified_base (151)..(151): a, c, t, g, unknown or other
  misc_feature (151)..(151): n is a, c, g, or t
  modified_base (180)..(180): a, c, t, g, unknown or other
  misc_feature (180)..(180): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggngtctggtcctacgctggtacgaaacccanacagaccctcacgctgacctgctaccttctcgtggttctcactcaactcgtagtggtagtgggtgtgggcttggttccgtcgacgccccgaggaacggccctaggaagtggtgctacttatttagtaggatcggtacgtacgctacgagtccatctcgtaggaggaggactacgtaccaccgtacaccccgaaccgaaaaccggaaccctaaaccccccgaaaaacgtcgggttaacccgtaccggttaaaccaaacgttaacccggaaccctaaaccgttaggaaccccgggtacccgttaacggggtaccgaaacccggaacaacccggttacccaaacctttatttaacggttttcctaaggttccacaaccttaaccgtacgtttaaagacgggttacaccgtacccggttagggtaaccgtctttaccggaacccgttaaacggttcccggttacccgggaaccccggtcccgggggtaccccggtacccgtacggtccctaaccggtcccttccgtaaccggcccttacccgaacccgaaacccggaaccgggtaccccctagttacccccgggtttcccttaccccggtccccgg

SEQ ID NO: 326235 - DNA, 673 bp, Homo sapiens
  misc_feature: GZ8MTXP02FPTBJ.22.38.D05.1.454.CMB.2.raw
tcagacatacgcgtcacgaccggtgctcgatttagtatctgatagttgggtttgggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgccccaggaaaggccctggaatgggtgctacttattattgggagtggtacggttaccgctacacgtccatctcgtgaggaggagactcacataccaccaacggaccaaacccccaaaaacacggtacgttcctaacaactacgaccaaccagtacggaccctaggtcggaccaacgaacggcccaaactaacttaactttcgtaggtcacaacctactactaaagtacggacgacctaaccgttggtaacgtcgtacgaccccgtaaaagtccggggttacccgaccccgggttaccgggggacccccggggtaaaccccgtcgggtaccgtaccccggtcttccccggtacaccggaccctaaccccgaaccgaaccggggaccctaccggttccggtccccttcccgtcccgg

SEQ ID NO: 326236 - DNA, 673 bp, Homo sapiens
  misc_feature: GZ8MTXP02FIV0I.22.38.D05.1.454.CMB.2.raw
tcagacatacgcgtcacgaccggtgctcgatttagtatctgatagttgggtttggggagtgactcctgtgcccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaacggccctggaatgggttgcacttatttattgggatgacggttaccgctacagtccatctctgaggaggagactcaccatcccaccaacggaccaaacccccaaaaaccgacggtacggtccctaacaatacgaccaccagtcggaccctggtgaccacagcccaacatatttctgtcgacacactctaagtaggagaccaccgtaggtacgtctacggacctaaaacgttcgggttacccgacccccggtcggggggaccccccgggtaaacccgttcggggtaccctaacccggttcccgttaccccgttaccgaccggtacccccttaaccccggaaccccgaaaaccgggggtccccctaacggtttccccgggtttacccctttcccccccggtacccgggg

SEQ ID NO: 326237 - DNA, 612 bp, Homo sapiens
  misc_feature: GZ8MTXP02GOY78.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgccccaggaaggccctggaatgggtgcacttattatggatgacggttaccgctacagtccatctctgaggaggagactcaccatccaccaacggaccaaacccccaaaacacggtaggtcccttaacaaactcgacccaccagtcggaccctgtacggaaccacacgccaactattatttctagtgccactactctaatacggagcaccgtggtacgtcgtacgacctaaaacgttcggtacccgaccccggtcgggggaccccgggtaacccgtggtacccgaccggtcctcccgtccaacgtccctaaccgaacccgaacggggtcccacgtccggtccccttccccgtccgg

SEQ ID NO: 326238 - DNA, 822 bp, Homo sapiens
  misc_feature: GZ8MTXP02GEJV0.22.38.D05.1.454.CMB.2.raw
tcagacatacgcgtcacgaccggtgctcgatttagtatctgatagttgggtttggggagtgactcctgtgcccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaacggccctggaatgggttgcacttatttagtgggatgacggttaccgctacagtccatctctgaggaggagactcaaccatccccaacccgaacggaacccaaacccccccgaaaaaacccgacgggttacgggttaccccttaacgaaactacgaaccccgaacccaagttacgggacccccgtttagacgggaacccaaccgtaacggacccctaacctaagtttaactttttccgttaacggttcgtaccaaacctaaccctttacccttaaaagttaacggggaaaccgtccgtaaacccccggttaggggttaaccggttaccttacgggaacccctaaaaacccgggtttccggggttttaccccgggaacccccccggttaccggggggggtaacccccccggggtaaaacccccggtttcgggggtaccccctaccccgggtttaccctcccccgttacgaacccggtcccccttaaccgaacccccggaaaacggggtccccccctaagttccccggggttaccccttttaccccccggccccgggg

SEQ ID NO: 326239 - DNA, 632 bp, Homo sapiens
  misc_feature: GZ8MTXP02G2OTK.22.38.D05.1.454.CMB.2.raw
  modified_base (283)..(283): a, c, t, g, unknown or other
  misc_feature (283)..(283): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtagaaacccacacagaccctcacgctgacctgcaccttctctgggttctcactcaactctagtggagtgggtgtggctggttcctcacgccccaggaaggccctaggaatgggtnctacttattagtggatgacggtacgctacagtccatctcgtgaggagagactcacatcccaaccaagacccaacccccaaaacgaggtacgtccttaacaaactcgaaccaccagacggaccctagcggacacgacgacccaatacttatttctaggtacaccactacgtctaagtaacgggacactaccgtaggtacgtacgtacgacctaaacggttcggttacccggaacccccgggtcgggggtacccccggtaaaccgtccggtacccgtaccgtccctacccgtccacgtacccgtaaccgacccgtaacgggtcctaccgtccgtccccttccccgtcccgg

SEQ ID NO: 326240 - DNA, 699 bp, Homo sapiens
  misc_feature: GZ8MTXP02IUI7Q.22.38.D05.1.454.CMB.2.raw
  modified_base (279)..(279): a, c, t, g, unknown or other
  misc_feature (279)..(279): n is a, c, g, or t
  modified_base (321)..(321): a, c, t, g, unknown or other
  misc_feature (321)..(321): n is a, c, g, or t
  modified_base (347)..(347): a, c, t, g, unknown or other
  misc_feature (347)..(347): n is a, c, g, or t
  modified_base (393)..(393): a, c, t, g, unknown or other
  misc_feature (393)..(393): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtagaaacccacacagaccctcacgctgacctgcctaccttctcgtgggttctcactacaactctagtggagtgggtgtggctggttccgtcgacgccccaaggaacgcccnggaagtgggtagtaacttattagttaggatggtacggtaccncgtacagtccatctcgtgaggagganacgtccaacatacaacccgaacggaaccctaaacccccgaaaaacnggtaccgttaccttacgaacttacgaacccaacacgtacggtacccttcgacggaacaaccacgacccacgtaatatttcctggtacaccctactaccgttaacgtaacgtaacggggactccgtaacccgttggttaaacgtccgttaagaacccgtaaaccgttcggggttacccgaaacccccgggttccggggggacccccgtaaacccggttcggggaccctaaccggtccctaacctccgaaccgtccccgaccctaacgcccgggtaccacggttccggtccccttcccggcgtccccg

SEQ ID NO: 326241 - DNA, 665 bp, Homo sapiens
  misc_feature: GZ8MTXP02FNGW1.22.38.D05.1.454.CMB.2.raw
  modified_base (459)..(459): a, c, t, g, unknown or other
  misc_feature (459)..(459): n is a, c, g, or t
tcagacatacgcgtcacgaccggtgctcgatttagtatctgatagttgggtttggggagtgactcctgtgccccaccatggacacactttgctccacgcacctgctgctgaccatcccttcatgggtcttgtcccagatcaccctgaaggagtctggtcctacgctggtgaaacccacacagaccctcacgctgacctgcaccttctctggttctcactcaactctagtggagtgggtgtgggctggttccgtcacgcccccaggaaacggccctggaatgggttgctactttatttagttgggatgtacggttaccgctacagaccatctctgaggaggagactcaccatacccaaccaacgaccaaacccccaaaaacacggttacgtccttaacaatacgacccaaccagtacggaccctgtcggaacacgacgaccaactattactttctaggtnacactaccttactaatagggacgcctaaccgttgggtaacgtctacgaacccgtaaaacgtccgggtttacccggacccccggttacggggggacccccggtaaacccgtcgggttaccctacccggttccttccccgtacaccggtacccctaaccgaacccgtaacggggcccctacgttcccggtccctttcccccgtccggg

SEQ ID NO: 326242 - DNA, 660 bp, Homo sapiens
  misc_feature: GZ8MTXP02I47Z3.22.38.D05.1.454.CMB.2.raw
  modified_base (437)..(437): a, c, t, g, unknown or other
  misc_feature (437)..(437): n is a, c, g, or t
  modified_base (463)..(463): a, c, t, g, unknown or other
  misc_feature (463)..(463): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgcccccaggaaacggccctggaagtgggtgctacttattagttgggatggacggttaccgctacagtccatctctgaggaggagactcaccatcccaccaacgaccaacccccaaaacgacggtacgtccttaacactcgaccacagtcgaccttgagacacgagccaatattactttcngtcaccactactcgtaatacgggacncctaaccgtgtaacgtcacgtaccctaaacgtcgggttaccccgaccccggtcgggggtaacccccgggacccttcgggggtacccctaacccggttccttaccccgtacccgacccgtaccccgtaaccccgaaccccggtaacccgggtaccccgttacccgttaccccggttcccccgttacccccggtcccgg

SEQ ID NO: 326243 - DNA, 629 bp, Homo sapiens
  misc_feature: GZ8MTXP02G9LCY.22.38.D05.1.454.CMB.2.raw
  modified_base (290)..(290): a, c, t, g, unknown or other
  misc_feature (290)..(290): n is a, c, g, or t
  modified_base (319)..(319): a, c, t, g, unknown or other
  misc_feature (319)..(319): n is a, c, g, or t
  modified_base (361)..(361): a, c, t, g, unknown or other
  misc_feature (361)..(361): n is a, c, g, or t
  modified_base (478)..(478): a, c, t, g, unknown or other
  misc_feature (478)..(478): n is a, c, g, or t
  modified_base (576)..(576): a, c, t, g, unknown or other
  misc_feature (576)..(576): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtacgaaacccacacagaccctcacgctgacctgcaccttctctgggttcctcactcaactctagtggagtgggtgtggctcggttccgtcacgaccccgaggaacgcccgtggaagtgggtnctacttattagtggatggtacggttaccnctacacgtccatctcgtaggaggtaggacgacctacacctanaccccgaaccgaaccggaaccccaaaacccccgaaaacgtcggttacgtaccttaacgaataccgaccaccagtacgaaccctgtacgaccacgacgaccatacttacttactgtanaccaactactactagtacgacgctacggtgtactcgtacgactaaacgtccggttaccgacccggtcggggacccgtacgtcggacctaccgtcctcnccgaccgtcccaaccgacccgaacggcccacgtcccggttccctcccgtccgg

SEQ ID NO: 326244 - DNA, 657 bp, Homo sapiens
  misc_feature: GZ8MTXP02GJHFV.22.38.D05.1.454.CMB.2.raw
  modified_base (503)..(503): a, c, t, g, unknown or other
  misc_feature (503)..(503): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtggctggttccgtcacgcccccaggaaacggcccgtggaagtgggtgctacttattagtggatgacgtaccgctacagtcatctctagaggaggacgactcaccgatacccaaaccgaaacggaacccaaaacccccaaaaacgacggttacggtacccttaacaaacttacgaacccaaccgacgtacggaccccgtagtaccggaaccaacgaacgacccaataacttactttcgtagtcacactaactctaagtacgganacctaccgttggtaacgtctacgtaccgtaaaacgttcggtacccgtaccccggtcgggggaccccgtaacccgtcggtacccgaccggtcctcccaccgaccgtcccgaaccgacccgaacggcccctacgtccggtcccctttcccgcccgg

SEQ ID NO: 326245 - DNA, 704 bp, Homo sapiens
  misc_feature: GZ8MTXP02I7DS4.22.38.D05.1.454.CMB.2.raw
  modified_base (288)..(288): a, c, t, g, unknown or other
  misc_feature (288)..(288): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtcgaaacccacacacgaccctcacgctgacctgcctaccttctctggttctcactcaactctagtggagtgggtgtgggctggttccgtcacgccccaggaaacggccctggaatgggtnctactttattagttggatgtacgttaccgctacagtcctatctcgtggaggagacgactcaccatacccaaccaacgacccaaacccccaaaacgtacggtacgtacctaacaactacgacccacacgtacggaccctgtacggacacgacgacccaagtattactttcgtcggttacacctacctaaccttacgtaaacgttacgggacgaccctaccggttaggttaccgttcgtacggaacccttaaaaccgggttcgggttaccccgtaacccccggggtccgggggtaacccccggtaacccgttccgggtaccctacccggttaccttacccaccgtaccgtacccctaacccgaacccggtaaaccggtcccctaacggttccccggttaccccttacccccggtccgg

SEQ ID NO: 326246 - DNA, 679 bp, Homo sapiens
  misc_feature: GZ8MTXP02JQ7KS.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgccccgaggaaacggccctggaagtgggtgctacttatttagtggatgacggttacgctacagtcatctcgtagaggagagactcacctactacccaaccgaaacggaaccccaaaacccccgaaaaaccgacgggttaccgtaccgttaaaccaaagtaccgaaacccaccgtacgtaccgggaccccttgacggaaccacgacgaccactattacgttctgtcgacctactactacgttaatacgggactaccgtaccgttaggtacgtccgtacgaacccgtaaacggttcggttacccgggaccccgtcgggggtaccccgggtaacctcgggtaccctacccggttcctcccgtacgaccgtcccctaaccgaacccggaaccggccctacgttcccggttaccccttccccgccgg

SEQ ID NO: 326247 - DNA, 582 bp, Homo sapiens
  misc_feature: GZ8MTXP02IMV8T.22.38.D05.1.454.CMB.2.raw
  modified_base (150)..(150): a, c, t, g, unknown or other
  misc_feature (150)..(150): n is a, c, g, or t
  modified_base (169)..(169): a, c, t, g, unknown or other
  misc_feature (169)..(169): n is a, c, g, or t
  modified_base (177)..(177): a, c, t, g, unknown or other
  misc_feature (177)..(177): n is a, c, g, or t
  modified_base (187)..(187): a, c, t, g, unknown or other
  misc_feature (187)..(187): n is a, c, g, or t
  modified_base (241)..(241): a, c, t, g, unknown or other
  misc_feature (241)..(241): n is a, c, g, or t
  modified_base (252)..(252): a, c, t, g, unknown or other
  misc_feature (252)..(252): n is a, c, g, or t
  modified_base (267)..(267): a, c, t, g, unknown or other
  misc_feature (267)..(267): n is a, c, g, or t
  modified_base (275)..(276): a, c, t, g, unknown or other
  misc_feature (275)..(276): n is a, c, g, or t
  modified_base (283)..(283): a, c, t, g, unknown or other
  misc_feature (283)..(283): n is a, c, g, or t
  modified_base (286)..(286): a, c, t, g, unknown or other
  misc_feature (286)..(286): n is a, c, g, or t
  modified_base (293)..(293): a, c, t, g, unknown or other
  misc_feature (293)..(293): n is a, c, g, or t
  modified_base (295)..(295): a, c, t, g, unknown or other
  misc_feature (295)..(295): n is a, c, g, or t
  modified_base (298)..(298): a, c, t, g, unknown or other
  misc_feature (298)..(298): n is a, c, g, or t
  modified_base (300)..(301): a, c, t, g, unknown or other
  misc_feature (300)..(301): n is a, c, g, or t
  modified_base (308)..(308): a, c, t, g, unknown or other
  misc_feature (308)..(308): n is a, c, g, or t
  modified_base (311)..(311): a, c, t, g, unknown or other
  misc_feature (311)..(311): n is a, c, g, or t
  modified_base (316)..(316): a, c, t, g, unknown or other
  misc_feature (316)..(316): n is a, c, g, or t
  modified_base (340)..(340): a, c, t, g, unknown or other
  misc_feature (340)..(340): n is a, c, g, or t
  modified_base (349)..(349): a, c, t, g, unknown or other
  misc_feature (349)..(349): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgcccagatcaccctgaaggngtctggtcctagctggganaaacccanacagaccctnacgctgacctgcaccttctctgggttctcactcaactgtagtggaggtgggtgnggctggttccnagccccaggaagccngatgggtnntatatgngangacgtcnantcntnnagagagnacncacanaccaacgaacgaccaaaccaaagngtctactanaacacaccacagacgtactgacgacacgctacatagttactgtgacacactactactagtagtacgacgtacgtagtacgtacgtacgtaccgtaacgtaccggttacccggtacccgggtacccgggacccggtacccggtaccggtaccgtacccgtaccgtaccgtaccgtaccgtaccgtaacccgaaccgaaccggaccgtaccgtcccgtcccgttccccgtcccgg

SEQ ID NO: 326248 - DNA, 656 bp, Homo sapiens
  misc_feature: GZ8MTXP02I3PD8.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtggctggttccgtcacgccccaggaacggcccgtggaagtgggtgctactttatttagttgggatgtacggttaccgctacagtccatctcgtgaggaggagacctcaccactacccaaccgaacgaacccaacccccaaaaccgtacggtacgtcctaacaactacgacccaccacgtacggtaccctagtacggacacgacgaccaactatttactttctgtacacaactactacgttaagtacgggactcctaccggttggtacgtacgtcgaaccgtaaacggttcggttacccggaccccggtcgggggacccccggaccgttcgggtccacccggttctccctacgccgtccctaacccgaacccggtaacgggcccctacggttcccgtacccgtttcccccggtacgg

SEQ ID NO: 326249 - DNA, 683 bp, Homo sapiens
  misc_feature: GZ8MTXP02GHOVY.22.38.D05.1.454.CMB.2.raw
  modified_base (461)..(461): a, c, t, g, unknown or other
  misc_feature (461)..(461): n is a, c, g, or t
  modified_base (467)..(467): a, c, t, g, unknown or other
  misc_feature (467)..(467): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctcttgggttctcactcaactctagtggagtgggtgtgggctcggttccgtcacgccccgaggaaacggccctggaacgtgggttgctactttagtttagttgggtatggacggttaccgctacacgtccatctctaggaggaggagactcaccatacccaaccaacggacccaaacccccgaaaaacgacggttacggtccttaacaactacgaaccaccacgtcgaccctgtacggacaacagcctaatacttntttacnggttcacacctactctaaagtacgggactccgtaaccgtggttaacgtctacgtaaccctaaacggttcgggttacccgaacccccgggttcgggggaacccccggtaccgttccgggacctacccggtccttccccgtacgccgttacccccaaccgaacccccggtaacggtccccctaacgtttcccgggttccccctcccccggttcccggg

SEQ ID NO: 326250 - DNA, 651 bp, Homo sapiens
  misc_feature: GZ8MTXP02FQ8C7.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcacctgaaggagtctggtcctacgctggtacgaaacccacacacgaccctcacgctgacctgctaccttctcttgggttctcactcaactctagtggagtgggtgtgggctggttcctcacgccccgaggaacgccctggaagtgggtgctactttagttagtggatggtacggttacgctacagtccatcgtctaggaggaggacgactcaaccataccccaaccgaacgaacccaaacccccaaaacgacggttacgtaccttaacaaacgtcgaacccaccgtagtacggacccgtgtacggaccacaacgacccaatattactttcgtagtcacactaacgtactagtaggactccgaccgttggtacgtcgtacgaccgtaaacgtcgggttacccgaccccgggtacggggacccggtaaccgtcggtacccgtacccgttctccctaccggacctacccgaacccgaaccgtaaccggccctacgtccggtcccctccccgtcgg

SEQ ID NO: 326251 - DNA, 608 bp, Homo sapiens
  misc_feature: GZ8MTXP02FHVKQ.22.38.D05.1.454.CMB.2.raw
  modified_base (462)..(462): a, c, t, g, unknown or other
  misc_feature (462)..(462): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggcttgttccgtcacgcccccaggaaaggccctggaatggggttgcacttatttattgggatgacggttaccgctacagtccatctctgaggaggagactcaccatacccaccaacggaccaaccccccaaaaccaggtcggtccttaacaactcgacccaccatcggaccctgtacggacacacgccacatatttctagtgacacactctaatacgganccaaccgttgggtactctacgacctaaacgtggttccgaacccccggtgggggacccccggaaccctcgggtaccacccgttctcccctcgacgtcccctaaccgaccgaacgggccccagtcccggtccccttccccccggcccg

SEQ ID NO: 326252 - DNA, 684 bp, Homo sapiens
  misc_feature: GZ8MTXP02IK1NG.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtacgaaacccacacagaccctcacgctgacctgcaccttctcgtggttctcactcaactctaggtggaggtgggtggtgggtcgtcggttccgtcgacgaccccgaggaaacggccctaggaagtgggtgctacttattagtggtatgtacgtacgctacagtcatctctggaggagagactacaccacacccaaccgaaccgaacccaaaaccccgaaaacgtacggtacgtaccttaacaaacgtaccgaacccaacgtacgtacggtacccgttggacggaaacccaaccgacggaccctaaactacttagtttcctggtacaccaacctaccttacgttaagaacggacgacctacggtagtacgtcgtacgacctaacggttccggtacccgtacccgggaccggggtaccccggaccgtcggtaccctaccggttacctccctcgacccgtaccctaacccgaaccggtaaccgtccctaccggttcccgttccccgttcccccgccggg

SEQ ID NO: 326253 - DNA, 657 bp, Homo sapiens
  misc_feature: GZ8MTXP02G2CQN.22.38.D05.1.454.CMB.2.raw
tcagacatacgcgtcacgaccggtgctcgatttagtatctgatagttgggtttgggggaggaactgctcagttaggacccagagggaaccatggaagccccagctcagcttctcttcctcctgctactctggctcccagataccaccggagaaattgtgttgacacagtctccagccaccctgtctttgtcgtaccggggaaagacgccaccctctcctgcagggccagtcagaatgttagtagttactagcctggtacagacaaagcctggccaggcctcccgagacctcctcactctctagactacactacccgaaacgacgggcccaacgtcggaccacctaccccgagccgtaggttccaaggtcggacgtaggtcggggtcgtagggactacgtacttcactctaccacactcagcgaactagacgctaagaagttatttagacgttaagttttatacgtcgttacgagtaccgtagtacggtatctacgtcgttaccgggtcccttacccggtacgtacccggttacggacccggtaacgggaacctaggaccgtaggacgtaacttaaaccgaaaacggttaccgtaggtacggtaccgtcggaaccctaccgtacttacgttccgttacctttaccgtactttcccccg

SEQ ID NO: 326254 - DNA, 657 bp, Homo sapiens
  misc_feature: GZ8MTXP02GAE4L.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgcccccgaggaaacggccctggaagtgggtgctactttatttagttggatgacggttaccgctacacgtccatctcgtgaggaggacgactcaccataccaaccgaaacgacccaaacccccaaaacacggttcgtccttaacaatcgaacccaccatcgaccctgtacgacacacgaccactatactttacgtgtcgacactacttactaagtacggagactacccgtaggtacgtactcgaccgtaaacgttcgggttacccgaccccggtcgggggtacccccggtaacccgttcgggtcccgtaccgttccgtcccgtaccgaccggtcccctaacccgtaacccggaacggggtcccctaccggttcccggtttccccgtttcccccggtccggg

SEQ ID NO: 326255 - DNA, 654 bp, Homo sapiens
  misc_feature: GZ8MTXP02I4F5Y.22.38.D05.1.454.CMB.2.raw
  modified_base (336)..(336): a, c, t, g, unknown or other
  misc_feature (336)..(336): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtacgaaacccacacagaccctcacgctgacctgcaccttctctgggttctcactcaactctagtggagtgggtgtggctggttccgtcacgccccaggaacggccctggaatgggtgctacttattagtggatggacggttaccgctacagtccatctctgaggaganactcacatccaaccaacgaaccaaaccccaaaacgaggtacgtccttaacaatacgaccaccatcggaccctgtcgaacacgacgaccaactattacttctgtcgaccaactacttacgtaagtaacgggacgtaccgtacgttagggtacgttcgtacgaacccttaaacggttccggttacccggaccccgggtccgggggaccccggtaacccgtcggtacccgtacccggttccctcccgttaccaccgcccctaacccgaacccgtaaccggggcccctaacggttccccggttcccgttcccccgtcccggg

SEQ ID NO: 326256 - DNA, 711 bp, Homo sapiens
  misc_feature: GZ8MTXP02FQXHO.22.38.D05.1.454.CMB.2.raw
tcagacatacgcgtcacgaccggtgctcgatttagtatctgatagttgggtttggggagtgactcctgtgcccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgcccccaggaaacggccctggaatgggttgcacttatttattgggatgacggttaccgctacagtccatctctgaggaggagactcaccataccccacccgaacggacccaacccccaaaaacccgacggttacgggtccttacaaatcgaacccgaccagtacggaccccgtgtacggaaccacgaacgcccaacattaacttttcaggttcacctaaccactccttaataacgggagacctacccggttgggttaactccgttacgacccgtaaaacgttccggggtttacccgaaccccccggttccgggggacccccggggtaacccccgttcggggtaccctaaccccgggttcctcccccgtttacgaccggttccccctaaccccgaaaccccgaaccgggggcccccttaagtccccggggttacccccttttcccccggcccgggg

SEQ ID NO: 326257 - DNA, 686 bp, Homo sapiens
  misc_feature: GZ8MTXP02HVJ9H.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgcccccgaaggaaacggccctgggaatggggttgactactttagtttagttgggatggacggttaccgctaacagtccatctctgaggaggagactacactatccaccaacgaccaacccccaaaacgacggtgtccttaacaactcgacccacagtcggaccctgtgacacacgaccactatatttctagtcgactacacgtctagtacggtagaccgaccgttgggttaacgtccgtacgtaaccctaaaacggttcgggttaccccggtaaccccccgggttcggggggtacccccggggtaaaccccgtttccggggtacccgtacccgttcccgtcccgttccaaccggttcccctaacccgaaccccggaacggggtaccccctacggttacccccgggtttccctttccccccggtcccggg

SEQ ID NO: 326258 - DNA, 634 bp, Homo sapiens
  misc_feature: GZ8MTXP02GMIFM.22.38.D05.1.454.CMB.2.raw
  modified_base (439)..(439): a, c, t, g, unknown or other
  misc_feature (439)..(439): n is a, c, g, or t
  modified_base (447)..(447): a, c, t, g, unknown or other
  misc_feature (447)..(447): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgccccaggaaaggccctggaatgggttgctacttatttattgggatggacggttaccgctacagtccatctctgaagaggagactcaccatccaccaagaccaacccccaaaaccacggtgtcccttacaaatcgaccaccatcgaccctgtggacacagccacatatttctgtgcacactntatagganaccacgtggtaagtcgtagcctaaaacttcgggtaccgacccccggtacgggggacccccggggtaacccgtcgggtaccctaccccggttcctcccctaccgtaccggtccccgttaaccccgaccccggaaaaccggggccccctaacgttacccggggttcccctttaccccccgtcccggggg

SEQ ID NO: 326259 - DNA, 675 bp, Homo sapiens
  misc_feature: GZ8MTXP02H7J26.22.38.D05.1.454.CMB.2.raw
  modified_base (354)..(354): a, c, t, g, unknown or other
  misc_feature (354)..(354): n is a, c, g, or t
  modified_base (444)..(444): a, c, t, g, unknown or other
  misc_feature (444)..(444): n is a, c, g, or t
  modified_base (454)..(454): a, c, t, g, unknown or other
  misc_feature (454)..(454): n is a, c, g, or t
  modified_base (458)..(458): a, c, t, g, unknown or other
  misc_feature (458)..(458): n is a, c, g, or t
  modified_base (465)..(465): a, c, t, g, unknown or other
  misc_feature (465)..(465): n is a, c, g, or t
  modified_base (480)..(480): a, c, t, g, unknown or other
  misc_feature (480)..(480): n is a, c, g, or t
  modified_base (493)..(493): a, c, t, g, unknown or other
  misc_feature (493)..(493): n is a, c, g, or t
tcagacatacgcgtcacgaccggtgctcgatttagtatctgatagttgggtttgggagtgactcctgtgccccaccatggacacactttgctccacgctcctgctgctgaccatcccttcatgggtcttgtcccagatcaccctgaaggagtctggtcctacgctggtacgaaacccacacacgaccctcacgctgacctgcctacctttctcgttgggttctcactcaactcgtaggtggaggtgggtgtgggtcttggtccgtcacgccccgaaggaacggccctagggaatgggtcgctactttagtttagtgggattggtaccggttaccgctacacgtaccattctcgnggaggaggagactcacactcccaaccgaacgaacccaaacccccaaaagacggtcgtacctacaatacgaccacagcgacctgagacacncgacatattnttcngcacaanctacgtagtaggacnccgacttgggtanaccgtcgtaacctaacggttccggtacccggacccccgggtacggggtacccggtaaccccgttgggtaccctacccggttcccttacccgacccgtacccggtaccccctaacccgaaccccggtaaccgggtacccccttacggtttacccccggtttcccgtttaccccccggcccggg

SEQ ID NO: 326260 - DNA, 624 bp, Homo sapiens
  misc_feature: GZ8MTXP02HHPKO.22.38.D05.1.454.CMB.2.raw
  modified_base (226)..(226): a, c, t, g, unknown or other
  misc_feature (226)..(226): n is a, c, g, or t
  modified_base (285)..(285): a, c, t, g, unknown or other
  misc_feature (285)..(285): n is a, c, g, or t
  modified_base (484)..(484): a, c, t, g, unknown or other
  misc_feature (484)..(484): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactntagtggagtgggtgtgggctggtccgtcacgccccaggaaacggccctaggaatgggtnctacttattagtggatgacgttaccgctacacgtccatctctggaggaggagactcaacatcccaaccgaaacggaaccaaaccccccaaaaacgcggttacggtaccttaaacgaatacgaacccacagtcgaccctagacggaacactacgacccaactattactttcgtagtcaccaacacttctaaagacggacnctaaccgttgggtactcgtacgaaccgtaaacgttccggttacccgaaccccggtcggggacccccggtaacgtcggtaccaccgtcctaccaccacgtcccaaccgaccgaacggccctagtcccgtaccttccccgcg

SEQ ID NO: 326261 - DNA, 632 bp, Homo sapiens
  misc_feature: GZ8MTXP02I5HL8.22.38.D05.1.454.CMB.2.raw
  modified_base (308)..(308): a, c, t, g, unknown or other
  misc_feature (308)..(308): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtctgtcccagatcaccctgaaggagtctggtcctacgctggtgaaacccacacagaccctcacgctgacctgcaccttctctgggttctcactcaactctagtggagtgggtgtgggctggttccgtcagccccaggaagccctggatgggtgcacttattatgggatgacggtacgctacngtccatctctgaggaggagactcaccatcccaccaacggaccaacccccaaaaccgacggtacggtccttacaaatcgaccaccatcggaccctgtcgaccacagccaacatactttctaggtgactaacacctactagtacggacgactacccttaggtacgtctacggacctaaaacgttcgggttacccgaccccgtcgggggacccccggtaaacccgtcggggtacccacccgggttacccctccgttaaccgccccgttacctaacccgaaaccggtacccgaccgtaccggttcccgtcccccgtcccggtccccgg

SEQ ID NO: 326262 - DNA, 629 bp, Homo sapiens
  misc_feature: GZ8MTXP02HA0DI.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtagaaacccacacagaccctcacgctgacctgccaccttctctgggttctcactcaactctagtggagtgggtgtggctggttccgtcacgccccgaggaacggccctggaactgggtgctacttatttagtggatggtacggttaccgctacacgtccatctcgtaggaggaggacgactcaccatacccaccgaacgacccaaacccccaaaacgaggtacggtaccttaacaatacgaccaccagtacgaccctgcgacacacgacactattacttcgtgtcacactactactaagtacgacgacctaccggtaggtactcgtacgacctaaacgttcggttacccgacccggtccggggtaccccggtaccgtcgggtaccaccggtcctcccgtacgccgacccgtcccgaacgtacccggaccctacgtcccggttccccgttccccgtcccggg

SEQ ID NO: 326263 - DNA, 647 bp, Homo sapiens
  misc_feature: GZ8MTXP02FXURM.22.38.D05.1.454.CMB.2.raw
  modified_base (594)..(594): a, c, t, g, unknown or other
  misc_feature (594)..(594): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctggttctcactcaactctagtggagtgggtgtgggctggttccgtcacgccccgaggaaacggccctggaatgggtgcacttattagtggatggtacggtaccgctacgacgtcctagtctcgtaggaggagggacactacacctatacccaaccgaacggaacccaaacccccaaaaaccgacggttacggttcctaacaactacgaacccaccacgtacggaccctaggtcgaaacacacgaccaactattactttcgtcgtcgaccaactactactagtacggagtacctaacggttgtaccgtctacgtacctaaacgttggttacccggaccccggttcgggggaccccgtaccgtggtacccgaccggttcctccgtacnccgacccgtaaccgaccgtaaacgggccctacgttcccggtccttccccgcgg

SEQ ID NO: 326264 - DNA, 703 bp, Homo sapiens
  misc_feature: GZ8MTXP02IBQVY.22.38.D05.1.454.CMB.2.raw
  modified_base (273)..(273): a, c, t, g, unknown or other
  misc_feature (273)..(273): n is a, c, g, or t
  modified_base (281)..(281): a, c, t, g, unknown or other
  misc_feature (281)..(281): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtacgaaacccacacacgaccctcacgctgacctgcctaccttctctggttctcactcaactctagtggagtgggtgtggctggtccgtcacgccccaggaagccnggatggtnctattattagtggatgacggttaccgctacacgtccatctacgtggaggtaggacgtacctacaaccactaccccaaaccgaaaaccggaaccccaaaacccccgtaaaacgtacggttacgtaccttaaacaaacgtaccgaacccaactacgacgtacccgtagtacggaaaccacgacaccctataagttcttttcgcgtacaccaactaccttataacggtacgggactacctacgggtagttacgtacgacgtaacccgtaaacgtttcccggtacccggtacccccgggtacgggggtacccccggtaaccgttccgggacccttaaccccggtccttcccgtaccgaacccgtcccaacccccggaaacgtacccggacccgtaccgtttcccggtccccctttcccccggccgg

SEQ ID NO: 326265 - DNA, 798 bp, Homo sapiens
  misc_feature: GZ8MTXP02JHW7L.22.38.D05.1.454.CMB.2.raw
  modified_base (275)..(275): a, c, t, g, unknown or other
  misc_feature (275)..(275): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtagaaacccacacagaccctcacgctgacctgcaccttctctgggttctcactcaactctagtggagtgggtgtggctggtccgtcacgccccgaggaacggcccgnggaagtgggtgactacttatttagtggtatggtacggttaccgctacgagtaccagtctcgtaggagggaggtacgtacctaccaccgtaactaccccgaaacccgaaacggaacccccaaacccccctaaaaacggtacggttaccggtaccttaaccgaaactacggaaacccaacgtacgtacggtaccctagggtacgaccaaccgacgtaccctaactactttaccttttcgtcggttaccgacctacctaaaccgtttaccgtaaggtaacgggtacgacccgttaaccggttagggttaccgtaccggtaccgtaaaccccgttaaaccggttccgggtttaacccccgggacccccgggttacccgggggtaaccccccgggttaacccggttccgggttaacccccgtacccggttcccttacccgtacccggtaaccctaccccgtaaccccgaaacccggtacccggtacccccgtagttcccccgggtttaccccttcccccggtcccggg

SEQ ID NO: 326266 - DNA, 626 bp, Homo sapiens
  misc_feature: GZ8MTXP02GHLOM.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgccccaggaaaggccctggaagtgggtgctacttattagttgggatggacggttaccgctacgagtccagtctcgtgaggagagactcacctatccaaccaacggaaccaaacccccgaaaacgacggtacgtccttaacaatacgaccaccatcggaccctgtacgacacgacgcctaacattactttacgtgttcgactaactaccttactaagttacggacgacctaccgttggtaacgtccgttacgaccgtaaacgtcggttacccgaccccggttcggggaccccggtacccgtggtaccctacccgtctccgtcacgtccctaaccgaccgaccggccacgttcccggtccttccccgtcgg

SEQ ID NO: 326267 - DNA, 675 bp, Homo sapiens
  misc_feature: GZ8MTXP02HFQTS.22.38.D05.1.454.CMB.2.raw
  modified_base (272)..(272): a, c, t, g, unknown or other
  misc_feature (272)..(272): n is a, c, g, or t
tcagacatacgcgtcacgaccggtgctcgatttagtatctgatagttgggtttgggggaggaactgctcagttaggacccagagggaaccatggaagccccagctcagcttctcttcctcctgctactctggctcccagataccaccggagaaattgtgttgacacagtctccagccaccctgtctttgtctccggggaaagagccaccctctcctgcaggccagtcagatgttagtagttacttagctgtacagcaaagctgcagctcccngactctcatctctgatacatccaacacgggccactggcactcccagccaggttcaaggtgcgaggtcgggtcgtacggggacaggtacttcaactcctccaacctactcacgtaccgaccgtacgacgacccttaggaaattgtttttcggagttaacgtttttaaatctttacgggttccaagtcctaaggcccgtttaaggccttaagttcccgttcgggaccccgtttaccccggtaaaccgttcccggtttacggggacccggtaaaccgggggaacccttaaacggccggttaagggacgtaacgttaaccgaaaaacccggtgtaacggtcggtccttacgggaactaacccccggttatttacccgttacgttacctttacccgttacttcccccg

SEQ ID NO: 326268 - DNA, 558 bp, Homo sapiens
  misc_feature: GZ8MTXP02GOOZT.22.38.D05.1.454.CMB.2.raw
  modified_base (203)..(203): a, c, t, g, unknown or other
  misc_feature (203)..(203): n is a, c, g, or t
  modified_base (407)..(407): a, c, t, g, unknown or other
  misc_feature (407)..(407): n is a, c, g, or t
tcagacatacgcgtcacgaccggtgctcgatttagtatctgatagttgggtttgggggaggaactgctcagttaggacccagagggaaccatggaagccccagctcagcttctcttcctcctgctactctggctcccagataccaccggagaaattgtgttgacacagtctccagccaccctgtctttgtctccgggggaaanagccaccctctcctgcagggccagtcagaatgttagtagttacttagctggtaccagcaaagcctggccaggctcccagactcctcatctctgatacataccaaacgacgggccaacgtggcactccccagcctaggtttccaagtggacgtaggtcgggtacgtggggacaggtacttcactctcaccatcagcgactagacnctagaagtattgactagtttattactgtcagcagcgtagctatcgtcggcctccgtactaccgtttcggaccgtagggacctagccgtaggagactacgaaacgactcgtcgcgtagaaccacaacttcgtactccttactactttccccg

SEQ ID NO: 326269 - DNA, 764 bp, Homo sapiens
  misc_feature: GZ8MTXP02IQ9IF.22.38.D05.1.454.CMB.2.raw
  modified_base (374)..(374): a, c, t, g, unknown or other
  misc_feature (374)..(374): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtacgaaacccacacagaccctcacgctgacctgcaccttctctgggttctcactcaactctagtggagtgggtgtggctggtccgtcacgccccaggaaacggccctggaagtgggttagaacttatttagtgggatgacggttaccgctacagtccatctctgagggaggagactcaccatcacccaacgaccaaccccaaaacnggtcgtactacactcgaccaccacgtacggacctggtacgacaccacgacccaactacttaactttcctagtcgtaccaaacctaccttacgttaaagtaacgggacgtaacccgtaacccggttcgggggttaaccttcccgttaccggtaacccccgttaaaacgggttacccgggggtttacccccggtaacccccggggtttacccggggggggaacccccccgggttaaaaccccggttccgggggttacccctaccccggggtttcccttaccccgttccgaaacccggtcccccttaccccgaaacccggttaaacccggggcccccttaacggttccccccggggtttcccccgtttccccccggttccggggtccccccgg

SEQ ID NO: 326270 - DNA, 670 bp, Homo sapiens
  misc_feature: GZ8MTXP02FPZVU.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtagaaacccacacagaccctcacgctgacctgcaccttctctgggttctcactcaactctagtggagtgggtgtgggctggtccgtcacgcccccgaggaaacggccctggaatgggttgctacttattagtgggatgtacgtaccgctacagtccatctcgtgaggaggacgactcaccatacccaaccgaacgaaccaaacccccaaaaacgtacggtacggtccttaacaacgtacgacccaaccgagtaccgggaccctaggtacggaaccacgacgacccaactattacttttcctgtacgaccaactaccttacgtaagtacgggacgtaccctaaccggttagggtactcgttaccgaacccttaaacgtcgggttaccccgaacccccggttcgggggacccccggaacccgtcggtcccgacccgttcctccccgtacgacgtccccgaaccgaaccgaccggaccctcgtcccgttccccttccccgtccgg

SEQ ID NO: 326271 - DNA, 621 bp, Homo sapiens
  misc_feature: GZ8MTXP02FUTEF.22.38.D05.1.454.CMB.2.raw
tcagacatacgcgtcacgaccggtgctcgatttagtatctgatagttgggtttgggggaggaactgctcagttaggacccagagggaaccatggaagccccagctcagcttctcttcctcctgctactctggctcccagataccaccggagaaattgtgttgacacagtctccagccaccctgtctttgtcgtccgggggaaagacgccaccctctcctgcagggccagtcagaatgttagtagttacttagcctggtaccagacaaagcctggccaggcctcccagacctcctcatctctgatacactaccaaacgacgggcccacgtcggccactccccagccctagggttcagtggctaggtcgggtctggggacaggtacttcactctcaccatccagtacactagacgcctagaacgttattttgacttaagtttattacgtgtccagcagcgtagcagttcgtcgtcccgttaccgtaccgtaccggttcggacggtaccggggaaactacggtcggtaaaggacgtacgttaaaccggaaaacgtaaccggttggacggtcctacggaaccgtaccgtacttccggtcgtttaccttaacctcgtttacccccg

SEQ ID NO: 326272 - DNA, 706 bp, Homo sapiens
  misc_feature: GZ8MTXP02JAKLF.22.38.D05.1.454.CMB.2.raw
  modified_base (285)..(285): a, c, t, g, unknown or other
  misc_feature (285)..(285): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctggttctcactcaactctagtggagtgggtgtgggctggtccgtcagcccccgaggaaacggccctggaatgggttnctacttatttatgggatgacggttaccgctacagtccagtctcgtagaggaggacgactcaaccactaccccaacccgaaacggaaccctaaacccccccaaaaacgtacggttacggttcccttaaacaaacgtacgaaccccaacctacgtcgggtaaccccttggtacggaaccaacgacgacccaactatacttttcacggttcactaacctacttacctaaagtacgggacgacctaccgttagggtaaccgttctacggaccctaaaacgttcgggttacccgaccccgggtcgggggacccccgggtaacccgtcggtacccctaccggtccttcccgacgacccgtacccctaaccccgaaacccgtaccgggaccccgtaacgttcccggttacccctttcccccgtccggg

SEQ ID NO: 326273 - DNA, 631 bp, Homo sapiens
  misc_feature: GZ8MTXP02ISG40.22.38.D05.1.454.CMB.2.raw
  modified_base (276)..(276): a, c, t, g, unknown or other
  misc_feature (276)..(276): n is a, c, g, or t
  modified_base (324)..(324): a, c, t, g, unknown or other
  misc_feature (324)..(324): n is a, c, g, or t
  modified_base (435)..(435): a, c, t, g, unknown or other
  misc_feature (435)..(435): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcacctgaaggagtctggtcctacgctggtacgaaacccacacacgaccctcacgctgacctgctaccttctctggttctcactcaactctagtggagtggtgtggctgtcgtcacgcccaggaacgcctggatggtnctacttattagtggatgtacgtacgctacagtcatctctgaggagacnctcacatacccaccgaacgacccaaacccaaaacgtacggtacgtacctacactacgacccaccagtacggaccctgtacgaacctacacgacctaatatttacgtttcgnggtacacctaactactaccgttagaaacggtcacgtacggttacgacgttccgtaacgtaccgtaacgttcggtacccgacccggtccgggggtaaccccgtacgtccggtacctaccggtcctccgttaccacgtaccccgtaaccgaccgacccggtacccgtaccgttcccggttccccgtcccggtacccgg

SEQ ID NO: 326274 - DNA, 648 bp, Homo sapiens
  misc_feature: GZ8MTXP02GGPTK.22.38.D05.1.454.CMB.2.raw
  modified_base (283)..(283): a, c, t, g, unknown or other
  misc_feature (283)..(283): n is a, c, g, or t
  modified_base (444)..(444): a, c, t, g, unknown or other
  misc_feature (444)..(444): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagccccaggaaaggccctggaatgggtncacttattattgggatgacggttaccgctacagtccatctctgaggaggagactcaccatcccaccaacggaccaacccccaaaaccacggtacgtccttacaatcgaccaccatcgaccctgtgacacagccacatattctgtgcacactctatagggancaccgttggtaactcgtacgacctaaacgttcgggttacccgaacccccgttcgggggacccccggggtaaaccccgttcggggtacccctaacccgggttcccttaccccgtaccgtacccggtacccccgtaacccgaaaccccggaaaccgggggtccccctaacgttccccggggtttcccctttccccccggtcccggg

SEQ ID NO: 326275 - DNA, 623 bp, Homo sapiens
  misc_feature: GZ8MTXP02G0JH3.22.38.D05.1.454.CMB.2.raw
  modified_base (338)..(338): a, c, t, g, unknown or other
  misc_feature (338)..(338): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggtccgtcacgccccaggaaacggccctggaactgggtgctacttattagttggatggtacgtaccgctacagtcatctctgaggagagacncacataccaccaacgaccaaccccaaacgacgtacgtccgtacaactcgaccaccacgtcgacctgtagacacacgcaactattacttctagtcgacactactactagtacgagacctaccgtaggtacgtactacgaaccgtaaacgtcgggttaccgaccccggtacggggaccccgggtaacccgttggtacccgtacccgttccttacccgtacgtaccgtcccgaacccgtaaccgaaccgggaccctaccgtcccggtttacccctccccggttcccgg

SEQ ID NO: 326276 - DNA, 723 bp, Homo sapiens
  misc_feature: GZ8MTXP02HI5QI.22.38.D05.1.454.CMB.2.raw
  modified_base (339)..(339): a, c, t, g, unknown or other
  misc_feature (339)..(339): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgccccgaggaaacggccctaggaagtgggttgctacttagtttagtgggtagtggtacggttaccgcttacacgtccatctntggaggagagactcacatcccaaccaacggaacccaaacccccaaaacgacggttacgtaccttacaactccgaccctaccacgtacgggacccctaggtacggaacccacggacgtacccaaactactttaacggtttcccgtagggttacgaccctaacctacggttacttaaacgtacggggtaaccgtccgtaaccggttaggtaccgtacgtaccgtaacccgttaacggtccgggtaccccgggaccccgggtccgggggtacccccggtaccgtccgggtacccgtacccgttccgtacccgtaccgtcccgtaccccctaacccggaaccgtacccgggacccctacggtccccggttacccctttcccccggcgg

SEQ ID NO: 326277 - DNA, 635 bp, Homo sapiens
  misc_feature: GZ8MTXP02JEAHB.22.38.D05.1.454.CMB.2.raw
  modified_base (285)..(285): a, c, t, g, unknown or other
  misc_feature (285)..(285): n is a, c, g, or t
  modified_base (342)..(342): a, c, t, g, unknown or other
  misc_feature (342)..(342): n is a, c, g, or t
  modified_base (440)..(440): a, c, t, g, unknown or other
  misc_feature (440)..(440): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctggttctcactcaactctagtggagtgggtgtgggctggttccgtcacgcccccaggaacggccctggaagtgggtnctacttagtttagtggtagtgtacggtaccgtctacacgtccatctctgaggagganactcacatcccaacacgaccaaccccaaacgagtacgtcctacaatcgaaccaccatacgaccgttgcgaaccgacacgccaactattacttacgtcngtacacactctaagagacgacgtaccgtagtcgtacgtacgacctaaacgttcgggtacccgtacccgggtaccggggtacccggtacccgtcgggtacccacccggtttccgtacccgttccgacccggtccccgtaaccgaacccggtaaccggtcccgtaacgttccccggttaccccctccccggtcccgg

SEQ ID NO: 326278 - DNA, 765 bp, Homo sapiens
  misc_feature: GZ8MTXP02JT57E.22.38.D05.1.454.CMB.2.raw
  modified_base (284)..(284): a, c, t, g, unknown or other
  misc_feature (284)..(284): n is a, c, g, or t
  modified_base (333)..(333): a, c, t, g, unknown or other
  misc_feature (333)..(333): n is a, c, g, or t
  modified_base (382)..(382): a, c, t, g, unknown or other
  misc_feature (382)..(382): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggtccgtcacgccccaggaacggccctggaagtgggtnctacttattagtggatgacggtacgctacagtccatctctgaggagganactcacataccaccaacgaccaaacccccaaaacgaggtacgtccttanaactcgaccaccacgtacggaccctagtcggaaccacgacgaccctaactactttacgtttaccgttgttaccgacctaaacctaaccttacttaaacggtaaacggggaaccgaccgttaacccggttaggggttaacgttcccgttaacgggtaacccccgtaaaaacggtttcccgggggttttaccccgggaaacccccccggggtttacggggggacccccccgggggttaaaaccccggtccgggggttacccccgtaacccggttccccgttaccccgtacccgaacccggtcccccttaaccccgaaaccccggtaaaccgggggtccccctaacgtttcccccgggtttcccccgtttccccccggtcccgggg

SEQ ID NO: 326279 - DNA, 630 bp, Homo sapiens
  misc_feature: GZ8MTXP02G2TDM.22.38.D05.1.454.CMB.2.raw
  modified_base (278)..(278): a, c, t, g, unknown or other
  misc_feature (278)..(278): n is a, c, g, or t
  modified_base (361)..(361): a, c, t, g, unknown or other
  misc_feature (361)..(361): n is a, c, g, or t
  modified_base (395)..(395): a, c, t, g, unknown or other
  misc_feature (395)..(395): n is a, c, g, or t
  modified_base (412)..(412): a, c, t, g, unknown or other
  misc_feature (412)..(412): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtggctggtcgtcacgccccaggaacgcctggatgggtnctacttattagtggatgacggttacgctacagtcatctctgaggagagactcacatacccaccaacgaccaacccccaaaacncggtacgtcctacatacgaccacagtcgacctgngacacgacgccatattnttctgtgaccaactactactaagtaacgggacaccgtacgttggtacgtctacgaaccctaaacgttccggttacccgaccccgggtaccgggggtaccccggtaaacccgttcgggtacccctaccggttcccgtaccctaccgacccggtaccccaacccgaaccgtaacccgggtccctaacggttcccggttacccccgtttcccccgtccggg

SEQ ID NO: 326280 - DNA, 596 bp, Homo sapiens
  misc_feature: GZ8MTXP02JTOHC.22.38.D05.1.454.CMB.2.raw
  modified_base (545)..(545): a, c, t, g, unknown or other
  misc_feature (545)..(545): n is a, c, g, or t
  modified_base (552)..(552): a, c, t, g, unknown or other
  misc_feature (552)..(552): n is a, c, g, or t
  modified_base (557)..(557): a, c, t, g, unknown or other
  misc_feature (557)..(557): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgcccccaggaaacggccctggaatgggtgcacttattatgggatgacggttacgctacagtccatctctgaggaggagactcaccatcccgaaccaacggaacccaacccccgaaaaaccacggtacgtcccttaacaatacgacccaccagtcggaccctgtacggaccacgatcccactattacttcgtgtcactacacctactagtaggacgctaccgtaggtactcgtcgacctaaacgtcggtacccgtacccggtcggggaccccggaccgtcgggtacccnccgtccncctcnccgccaaccgaccgacggcctacgtccgtccctcccgcg

SEQ ID NO: 326281 - DNA, 568 bp, Homo sapiens
  misc_feature: GZ8MTXP02F8NW0.22.38.D05.1.454.CMB.2.raw
  modified_base (439)..(439): a, c, t, g, unknown or other
  misc_feature (439)..(439): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggttgcacttatttattgggatgacggttaccgctacagtccatctctgaggaggagactcaccatccaccaaggaccacccccaaaaccagtgtccttacaatgaccacatggaccctgtggacacagccacatatttctgtgcacactctataggancacctggtacgtctgaccaaaactggttaccgaccccgttgggggacccccggaacctggtaccaccgtcctccgtccacgcccctaaccgacccgaacgggccccagtccggttccttcccccgtcgg

SEQ ID NO: 326282 - DNA, 726 bp, Homo sapiens
  misc_feature: GZ8MTXP02H869Y.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcacctgaaggagtctggtcctacgctggtacgaaacccacacacgaccctcacgctcgacctgcctacctttctcgttggttcctcactacaactctaggtggaggtgggtggtgggtcgttcggtccgtcgaccggaccccgaagggaaacggcccgtagggtaagtgggtacgtctacgtttagtttagttagggtacgtggtaccggttaccgtctacgacgtccactcgtcgtaggacggaggacactacaacctactaccccaaaccgaaacgaaccccaaaaccccaaaaacgtacggttacgttacctaaacgaaactaccgaaccacacgtacgaccctgacgacacgacgaccatattattcagtacaccaactacttacgtaagtaaggacacctacggttggtaacgtcctaacggaacccgttaaaccggttccggtaccccggtaccccggggtacccgggggtaccccggtaaccgttcggacccctacccggtccctaccgtaccgaacccgtccccctaaccggaacccgacgggtccccaccggtttccccggtcccgtttccccgccgg

SEQ ID NO: 326283 - DNA, 631 bp, Homo sapiens
  misc_feature: GZ8MTXP02IDKN9.22.38.D05.1.454.CMB.2.raw
  modified_base (433)..(433): a, c, t, g, unknown or other
  misc_feature (433)..(433): n is a, c, g, or t
  modified_base (454)..(454): a, c, t, g, unknown or other
  misc_feature (454)..(454): n is a, c, g, or t
tcagacatacgcgtcacgaccggtgctcgatttagtatctgatagttgggtttggggagtgactcctgtgccccaccatggacacactttgctccacgatcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgccccaggaaggccctggaatgggtgctacttatttatgggatggtacggtaccgctacagtccatctctgaggagagactcacatccaccaacgacccaacccccaaaacgtacggtcgtccttacaatacgaccaccagtcgaccctgtggacacacgccacatactttctgtnacactactacctagtacgganctaccgtggtactcgtacggacctaaaacgttcgggttaccgaccccggtccgggggaccccggtaaacccgtcggtaccctaacccggtccttcccgacctaccggcccctaaccccgaacccgaaaccgggtccccctacgttccccggggttccctttccccccggtcccgggg

SEQ ID NO: 326284 - DNA, 621 bp, Homo sapiens
  misc_feature: GZ8MTXP02JDQHF.22.38.D05.1.454.CMB.2.raw
  modified_base (203)..(203): a, c, t, g, unknown or other
  misc_feature (203)..(203): n is a, c, g, or t
  modified_base (291)..(291): a, c, t, g, unknown or other
  misc_feature (291)..(291): n is a, c, g, or t
  modified_base (427)..(427): a, c, t, g, unknown or other
  misc_feature (427)..(427): n is a, c, g, or t
tcagacatacgcgtcacgaccggtgctcgatttagtatctgatagttgggtttgggggaggaactgctcatttaggacccagagggaaccatggaagccccagctcagcttctcttcctcctgctactctggctcccagataccaccggagaaattgtgttgacacagtctccagccaccctgtctttgtctccgggggaaanagccaccctctcctgcagggccagtcagaatgttagtagttacttagcctggtaccagacaaaagcctggccaggctcccagactccncatctctgataccatacccaaacacgggcccacgtggctactccccaagcctagggttcaggtcggactaggtcggggtctggggacaggtacttcactcctcaccatccgaagcgaacctagacgcctagaagtntttgacttagtttattactgtcagcagtacgtgctagtcgtcggtccctaccgtactacccgtttggacccgtaacgggggaacctaacgcgttaaccgggagtaacgttaaccgaaaacgtaaccgtaggttaacggccgttacggaacctaacccgtacttcgttacggtttacctttccacttttcccccg

SEQ ID NO: 326285 - DNA, 670 bp, Homo sapiens
  misc_feature: GZ8MTXP02F3X55.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtacgaaacccacacacgaccctcacgctgacctgccaccttctcgtggttctcactcaactctagtggagtgggtgtgggctggtccgtcacgccccgaggaacggcctggaagtgggtgctactttagttagtggatggtacggttaccgctacacgtccatctctgaggaggagactcacactacccaaccgaaccgaaccaacccccaaaacgaggtcgtcctaacaatacgaccacagtcgacctgtacgacacacgacctatatactttcgacgtcacctactaaccgtcgtaatacgggacacccgtaacggttgtacgtacgtacgtaacccgtaaacgttccggtacccggtaccccgggtccgggggaacccccggtacccgttcggtaccccgtacccgttccgtcccgtaccgacccgtaccccgtaacccgaacccgggtaaccggtacccccgtacggtttaccccggtttcccctacccccggtccgg

SEQ ID NO: 326286 - DNA, 721 bp, Homo sapiens
  misc_feature: GZ8MTXP02H6G0J.22.38.D05.1.454.CMB.2.raw
  modified_base (253)..(253): a, c, t, g, unknown or other
  misc_feature (253)..(253): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctgtcgtcncgcccaggaacgcctaggatggtgctacttattagtggatgacggttaccgctacagtccatctctgaggagagactacacatacccaacgaacgaaccaaaccccaaaaacaggttacggtaccttaacgaaatcgaaccaaccatacgaccctgtacgaaccaacgaacgaccaactattaacgtttcctagtccacctaacctaacttacttaacggtaagggaaacccgtacgtaaccgttgggtacgtaccgtaccgaacccggttaaaccggttccgggttacccccgggtaacccccggggtacccgggggtaacccccggttaaacccggtccggttaaccccgtaccccgttacccgtaccccgtacccgtacccgtaccccgtaacccccggaaaccccggaacccgggtacccccgtaccggtttcccccggtacccccgtttacccccggcccggg

SEQ ID NO: 326287 - DNA, 645 bp, Homo sapiens
  misc_feature: GZ8MTXP02I1AWL.22.38.D05.1.454.CMB.2.raw
  modified_base (328)..(328): a, c, t, g, unknown or other
  misc_feature (328)..(328): n is a, c, g, or t
  modified_base (467)..(467): a, c, t, g, unknown or other
  misc_feature (467)..(467): n is a, c, g, or t
  modified_base (590)..(590): a, c, t, g, unknown or other
  misc_feature (590)..(590): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtacgaaacccacacacgaccctcacgctgacctgcctaccttctctggttctcactcaactctaggtggaggtgggtggtgggcttcggttccgtcacgccccgaagggaacgccgtaggagtgggtgctacttattagtggatgacggttaccgctacngtccatctcgtggaggaggacgactccacacaccccaaccgaacgaacccaaaccccaaaacgcggttacgtaccttacaactacgaaccacctacgtccggaccctggacgaacaccgacgaccactatttacgttcncgtacacctactaacttacgtaagtacggacgtcctacggttgtacgtctacgaccgttaacgtccggttacccgacccgggtccgggacccggtactcgggtaccctaccgtcctcccgacncccgacccgtaaccgaaccggacggtcccacggtcccgttcccgtcccgtcccgg

SEQ ID NO: 326288 - DNA, 586 bp, Homo sapiens
  misc_feature: GZ8MTXP02HYN2Q.22.38.D05.1.454.CMB.2.raw
  modified_base (379)..(379): a, c, t, g, unknown or other
  misc_feature (379)..(379): n is a, c, g, or t
tcagacatacgcgtcacgaccggtgctcgatttagtatctgatagttgggtttgggggaggaactgctcagttaggacccagagggaaccatggaagccccagctcagcttctcttcctcctgctactctggctcccagataccaccggagaaattgtgttgacacagtctccagccaccctgtctttgtctccggggaaagagccaccctctcctgcagggccagtcagaatgttagtagttacttagctggtaccagcaaaagcctggccaggctcccagactcctcatctctgatacatccaaacaggccactggcatcccagccagtcagtggcagtcgggtctggggacaggactttcgactcctcaccatcancgaacctagagccctagaagtactttagctaagtttatttactagttcagtacagccgtagctaatctcgggaccctccggttaaccacccgttttcgggccgttaacgggggaccccgaaaagccgtaggacgacgttacaaaaaccggacttacgacgggtacttacgaaccgacctaactcgtagttaccttctaactttcccg

SEQ ID NO: 326289 - DNA, 661 bp, Homo sapiens
  misc_feature: GZ8MTXP02IHDOS.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgacccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgccccgaggaacggccctaggaagtgggtgcacttattagttggatggtacggttaccgctacagtcatctctgaggaggagactcaccactacccaaccgaaacggacccaaacccccaaaaacgtacggttacgtaccttaacaaataccgaacccaacctagtacgaccctgtacgaaccacacgaccaactattacttctagtcgacactacttactaagtaggacaccgtaccgttggtacgtcgtacgaccgtaaacgttcggttacccgaccccggtcgggggtaccccggtaacccgttcgggtaccctaccggtcctacccgtaccgtaccgtccctaacccgacccggaacgggtccccaacgtttccccggtccctttcccccggtaccggg

SEQ ID NO: 326290 - DNA, 681 bp, Homo sapiens
  misc_feature: GZ8MTXP02GRWPD.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctggttctcactcaactctagtggagtgggtgtggctggttccgtcgacgcccccaggaaacggcccgtggaagtgggtgctacttattagtggatgacgtacgctacagtccatctctgaggagagactcacatccacaacgaccaacccccaaaaacgacgttacggtccctaacaaactacgaacctaccagtacggtaccctagtacggaaccacgaacgacccaatacttaactttctcgttacgaccactaacttacctaagtaacggtagacctacccggttaggtaacgtcctagtaccccgtaaaacgttccggttacccggtacccccgggtaccgggggacccccgggtaaaccccgttccgggtacccgtaccccgttcccgttaccctaccgaccgtaccccgaacccgaacccgaaaccggggtcccctaacgtcccgttccccgttacccccgtcccgg

SEQ ID NO: 326291 - DNA, 635 bp, Homo sapiens
  misc_feature: GZ8MTXP02GEWVU.22.38.D05.1.454.CMB.2.raw
  modified_base (314)..(314): a, c, t, g, unknown or other
  misc_feature (314)..(314): n is a, c, g, or t
tcagacatacgcgtcacgaccggtgctcgatttagtatctgatagttgggtttggggagtgactcctgtgcccaccatggacacactttgctccacgctcctgctgctgaccatcccttcatgggtcttgtccagatcaccctgaaggagtctggtcctacgctggtagaaacccacacagaccctcacgctgacctgctaccttctcgtgggttctcactcaactctagtggagtgggtgtgggctggttccgtcacgcccccgaggaaacggccctggaactgggtgctacttattagtggatgacggtacntacagtcatctctgaggagagactcgacatcccaaccgaacgaaccaaaccccaaaacgtacggtacgtccgtaacaaactacgaaccaccaagtacgaccctagacgaacacgacgaccaaactatactttactagtcacaactaactacgtaagtaacggacgacgtaaccgttgggtaacttcgacgtaacctaaacgttcggttaacccgacccggtacggggtaccccggaaaccgtttcggaccgaaccgttcgtaccctacgaccgacctaacccgacgaaccggtcccacgttccggtaccttcccccgacgg

SEQ ID NO: 326292 - DNA, 731 bp, Homo sapiens
  misc_feature: GZ8MTXP02G8HL5.22.38.D05.1.454.CMB.2.raw
  modified_base (683)..(683): a, c, t, g, unknown or other
  misc_feature (683)..(683): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgccccgaggaacggccctggaatgggttgctacttatttagtgggatggtacggttaccgctacagtccatctcgtaggagggtaggacgtacctacaacctataccccgaacccgaaacgggaaccccaaaacccccccgtaaaaaaccgtacggggttaccggttaccctttaaaccaaacgttaccgtaaccccaaccgtaacgtaccgggtaacccccgttaggtacgggaaacccacccgaaacggtaccccaaaccgtaatttaacttttccgtaggttcgacctaaccaaccggttccttaaagggtacggacgtcctaaaccggttggtaacgtactcggtaacctaaacgttcgggtacccgtaccccgggtcgggggacccccggtaacgtcggtaccacccggtctacccgaccnccgtacccaacccgacggaccgtccctacgtcccgtcccgtcccgtcg

SEQ ID NO: 326293 - DNA, 707 bp, Homo sapiens
  misc_feature: GZ8MTXP02HKK8F.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtacgaaacccacacacgaccctcacgctcgacctgctaccttctcgtcggttctcactcaactcgtaggtggtaggtgggtggtgggtcttcggttccgtcaccgaccccgaaggaacggccgtaggaagtggtctactactttagttagttaggtatacggtaccggttaccgtcgtacgtaccgtctacgtctacgtaggagggaagacgtacctaccactacacccgaaacccgaaacgaaccccaaaaccccgaaaacgtacggttacgtacctaacaactacctaccactacgtccgtaccctaggacgaccacgcacctaacgtatttacttcgtacgtcgaccacttactacgtaggacggtactaccgtacgttagtacgtcgtaccgaaccgttacgtccgggtacccgtacccgggtaccgggggtaccccgtaacgtccggtaacccgtcccgttcctcccgtaccgtaccgacccgtaaccgacccgtaaccgtcccgtcgtccccggtacccgtttcccggcccgg

SEQ ID NO: 326294 - DNA, 587 bp, Homo sapiens
  misc_feature: GZ8MTXP02FXDTF.22.38.D05.1.454.CMB.2.raw
  modified_base (422)..(422): a, c, t, g, unknown or other
  misc_feature (422)..(422): n is a, c, g, or t
  modified_base (432)..(432): a, c, t, g, unknown or other
  misc_feature (432)..(432): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgccccgaggaacggccctggaagtgggtgctacttattagttgggatggacggttaccgctacagtccatctctgaggaggagactcaccatccaaccaacgaaccaacccccaaaacaggtacgtctacaatcgaccacatcgaccctgtacgacacacgccanatattctgtnacactactctaagaggagcctacgtaggtactcgtacgacctaaagtcggtaccgaccccggtcgggggaccccggtaacgtcgggtccaccggtcctcccgtcaccgccctaacccgaacgaaccgggcctacgtccggtccctccccgtccgg

SEQ ID NO: 326295 - DNA, 722 bp, Homo sapiens
  misc_feature: GZ8MTXP02HIWPW.22.38.D05.1.454.CMB.2.raw
  modified_base (302)..(302): a, c, t, g, unknown or other
  misc_feature (302)..(302): n is a, c, g, or t
  modified_base (318)..(318): a, c, t, g, unknown or other
  misc_feature (318)..(318): n is a, c, g, or t
  modified_base (323)..(323): a, c, t, g, unknown or other
  misc_feature (323)..(323): n is a, c, g, or t
  modified_base (436)..(436): a, c, t, g, unknown or other
  misc_feature (436)..(436): n is a, c, g, or t
  modified_base (446)..(446): a, c, t, g, unknown or other
  misc_feature (446)..(446): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctggttctcactcaactctagtggaggtgggtggtggtcgttcggtccgtcgaccgcccgaaggacgccgtaggagtggtgctattattagtggntcgtacgtacgctacncgtcntctcgtggaggagacactcacacacccaaccgaacgacccaaacccaaacgaggtactacctaacatacgaccactacgcgaccgtgtacgaacagaccgacactattcttgngtcacacgtntactaagacggtactaccgtacggtagttaccgtacgtaccgtaaaccggttaaacggttcccggtacccccgggtacccgggggtaacccccggggggtacccccgggtaaaacccggttccggttccccgtaaccccggtttccccgtaacccgtaccccgggtaacccccgtacccccgtaaacccccgggaaacccgggtaaaccccggggtcccccgtttaacccgggttccccccgggtttacccccgtttaccccccggtccccggggg

SEQ ID NO: 326296 - DNA, 676 bp, Homo sapiens
  misc_feature: GZ8MTXP02IOQCG.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtacgaaacccacacacgaccctcacgctgacctgctaccttctcgtggttctcactacactcgtagtggaggtgggtgtggcgtcggttccgcacgcccgaggaacggccgtaggagtggtgactacttagtttagtgggatggaccgttaccgactacacgtccatctcgtaggaggaggacgactacacactacccgaaccgaaacggaacccaaaacccccaaacgacggttacgtacctaacaataccgacccaccgacgtacgaccctgaccgaacaccacgaccactatttacttgtagtcaccacttactacgtaaagacggactaccgtacggtagggtactccgacgtaaaccgtaacggttccggtaccccggtacccccggggcggggtaaccccccggtacgtccgggtaccctaccgttccctccgaccgtcccggaccctaacccgaaccggtaacccggtccctacggtttcccctccccgtttccccgacgg

SEQ ID NO: 326297 - DNA, 610 bp, Homo sapiens
  misc_feature: GZ8MTXP02FST20.22.38.D05.1.454.CMB.2.raw
  modified_base (436)..(436): a, c, t, g, unknown or other
  misc_feature (436)..(436): n is a, c, g, or t
  modified_base (439)..(439): a, c, t, g, unknown or other
  misc_feature (439)..(439): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtcgaaacccacacagaccctcacgctgacctgcaccttctctgggttctcactcaactctagtggagtgggtgtggctggttccgtcacgccccaggaacggcctggagtgggtgctacttattagtgggatggtacggttaccgctacacgtcatctctggaggaggagactcacatcccaccaacgaccaaaccccaaaccgaggtcgtcctaacaactcgaccaccagtacggaccctgtacgacacacgaccatattactttcngtntaccactactacgtagtacggatccgtacgtggtacgtctacgacctaaacgttcggtacccgacccgggtcggggaccccgggtaccgtcggtaccgtaccgtcctcccgtacaccggtccctaaccgacccgtaacgggccccttacgtccggtccctttccccgccgg

SEQ ID NO: 326298 - DNA, 658 bp, Homo sapiens
  misc_feature: GZ8MTXP02FJ8X9.22.38.D05.1.454.CMB.2.raw
  modified_base (409)..(409): a, c, t, g, unknown or other
  misc_feature (409)..(409): n is a, c, g, or t
  modified_base (418)..(418): a, c, t, g, unknown or other
  misc_feature (418)..(418): n is a, c, g, or t
  modified_base (422)..(422): a, c, t, g, unknown or other
  misc_feature (422)..(422): n is a, c, g, or t
  modified_base (426)..(426): a, c, t, g, unknown or other
  misc_feature (426)..(426): n is a, c, g, or t
  modified_base (429)..(429): a, c, t, g, unknown or other
  misc_feature (429)..(429): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtacgaaacccacacagaccctcacgctgacctgctaccttctctggttctcactcaactctagtggagtgggtgtgggcttggttccgtcacgcccccgaaggaacggcccgtggaagtgggttgctactttatttagtgggatggacggttaccgctacagtccatctctggaggaggagactcaccatcccaccaacggaaccaacccccaaaacgaggtcgtcctacatcgaccacancggacctgngacncacncanatattctgtcgacactacgtatatagggactcgaccgttaggtacgtctcgaccgtaaacgttcggtacccggtaccccggtcgggggacccccggaaaccgttccgggtaacccgtacccggttcccttaccccttaccggaccgtacccctaacccggaaaccccggtaaacccggggtcccctaacccggtttcccggttcccccgtttacccccggtcccggggg

SEQ ID NO: 326299 - DNA, 629 bp, Homo sapiens
  misc_feature: GZ8MTXP02HNSA2.22.38.D05.1.454.CMB.2.raw
  modified_base (317)..(317): a, c, t, g, unknown or other
  misc_feature (317)..(317): n is a, c, g, or t
  modified_base (453)..(453): a, c, t, g, unknown or other
  misc_feature (453)..(453): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggtccgtcacgccccaggaaacggccctggaatgggtgctacttatttagtggatgacggttaccgctacngtccatctcgtgaggagagactacacatcccaaccaacggaaccaaacccccaaaaacgacggtacgtacccttaacaaactacgacccaaccagtacggaccctgtcggaacaccagtcccaactattactttcngtcacacactactataggagcctaccgtggtactcgtacgaacctaaacgtcgggttacccgaacccggtcgggggaccccggaaccgttcgggtacccacccggttctcccgtaccacggtaccctaacccgaacgaaccgggtccctacgtcccggtccccgttccccgtccgg

SEQ ID NO: 326300 - DNA, 693 bp, Homo sapiens
  misc_feature: GZ8MTXP02JYKBC.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctggttctcactcaactctagtggagtgggtggtgggctggttccgtcacgccccgaggaaacggcccgtggaagtgggttgctacttatttagttgggatggtacggttaccgctacagtcctatctcgtggaggaggagactcaccactacccaccaaacgaacccaaaccccccgaaaaccgacggttacggtacccttaacaaactaccgaccaccacgtaccggacccgtggtacggaccacgacgacccaactattactttctgtacgacctactacttactaagtacggacgtacctaccgttggtaacgtccgtacgtaaccgtaaacgttccgggttacccggacccccgggtacgggggaccccccggggtaacccgttgggtaccccgacccgttcccgtcccgtaccgaccgtccccctaaccgaacccgaacccgggtccctacgtccccggtttccccttcccccggccggg

SEQ ID NO: 326301 - DNA, 645 bp, Homo sapiens
  misc_feature: GZ8MTXP02GE4S9.22.38.D05.1.454.CMB.2.raw
  modified_base (311)..(311): a, c, t, g, unknown or other
  misc_feature (311)..(311): n is a, c, g, or t
  modified_base (464)..(464): a, c, t, g, unknown or other
  misc_feature (464)..(464): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtcgaaacccacacagaccctcacgctgacctgcaccttctctgggttctcactcaactctagtggagtgggtgtggctggtcgtcacgccccaggaagcctggaatgggtgctacttattagtggatgacggttaccgctacngtccatctctgaggaggagactcaccatacccaaccaacgaccaacccccaaaacgacggttacgtacctaacaactacgaccaccacgtacgaccctaggtcgacacacgaccaactattctttcagttcacaactacctataagtaggacncgtaccgtggtaacgtcgtacgaccgtaaacgttcgggttacccggaccccgggtaccgggggtacccccgggtaacccgttcgggtacccgtaccccgtccgtaccctaccggacctacccgtcccgaaacccgaccgggtcccctacggttccccggttacccctttcccccgtccggg

SEQ ID NO: 326302 - DNA, 709 bp, Homo sapiens
  misc_feature: GZ8MTXP02JDW93.22.38.D05.1.454.CMB.2.raw
  modified_base (288)..(288): a, c, t, g, unknown or other
  misc_feature (288)..(288): n is a, c, g, or t
  modified_base (316)..(316): a, c, t, g, unknown or other
  misc_feature (316)..(316): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtacgaaacccacacagaccctcacgctgacctgccaccttctcttggttctcactcaactctagtggagtgggtgtgggctggttccgtcacgccccgaggaacggccctggaagtggtnctacttattagtggatggacggttaccnctacacgtcctatctcgtagaggaggatacgtcaaccatacccaacccgaaacggaaccccaaaacccccgaaaaacgacggttacgtaccgtaacaaactcgaacccaccatcgacccttgacgaacacacgccaactattactttctgtacgaccacacgtatacgtaggacgactaccggttagtacgtcgttacgaacccgttaaacgtccggttaccccggaaccccggttccggggtaccgttccccgggggtaaaacccttcggggtaaacccctacccgggtttccctaccccgtacccgaaacccggtccccttaacccccgaaaacccggtaacccggggtccccctaaacggtttcccccggttcccccgtttccccccggg

SEQ ID NO: 326303 - DNA, 670 bp, Homo sapiens
  misc_feature: GZ8MTXP02GMY6T.22.38.D05.1.454.CMB.2.raw
  modified_base (250)..(250): a, c, t, g, unknown or other
  misc_feature (250)..(250): n is a, c, g, or t
  modified_base (267)..(267): a, c, t, g, unknown or other
  misc_feature (267)..(267): n is a, c, g, or t
  modified_base (275)..(275): a, c, t, g, unknown or other
  misc_feature (275)..(275): n is a, c, g, or t
  modified_base (308)..(308): a, c, t, g, unknown or other
  misc_feature (308)..(308): n is a, c, g, or t
  modified_base (466)..(466): a, c, t, g, unknown or other
  misc_feature (466)..(466): n is a, c, g, or t
  modified_base (609)..(609): a, c, t, g, unknown or other
  misc_feature (609)..(609): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtagaaacccacacacgaccctcacgctgacctgctaccttctctggttctcactcaactctagtggagtggtgtggctgtcncacgcccgaggacgcgngagtggtnactattattagtggatcggtaccgtacgctacncgtccatcgtcgtaggaggagacgacctacaccactaccccaaccgaaccgaacccaaaacccccgaaacgtacggttaccggttacctaacaacgtaccgaacccacacgtacgtacccgtaggaccgacacgacgacccaataactttctttacgnggtacactaacctacttaccgtaaggtaccggacacccgttacggtgttaacctcgtaacgaccgttaaaccggttcgggtaaaccccgccccggggttaccggggcccgtaaccgtcggtaccctacccgtcttaccgaccncccgtacccgaaccgaacccggaaccggtcccctcgttcccggtcccccttcccggaccgg

SEQ ID NO: 326304 - DNA, 602 bp, Homo sapiens
  misc_feature: GZ8MTXP02F9QWM.22.38.D05.1.454.CMB.2.raw
  modified_base (317)..(317): a, c, t, g, unknown or other
  misc_feature (317)..(317): n is a, c, g, or t
  modified_base (447)..(447): a, c, t, g, unknown or other
  misc_feature (447)..(447): n is a, c, g, or t
  modified_base (453)..(453): a, c, t, g, unknown or other
  misc_feature (453)..(453): n is a, c, g, or t
  modified_base (564)..(564): a, c, t, g, unknown or other
  misc_feature (564)..(564): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtggctggttccgtcacgccccaggaacgcccgtaggaatgggtgctacttagttagtggatgtacgttaccgctacncgtccatctcgtgaggaggacgactcaccactacccaaccgaacgaaccaaacccccaaaacgtacggtacgtcctaacgaactacgaccaccagtcggaccctgtcgacacagaccaactattactttntacgtnacctaactactctaaagtaggactacgaaccgttggaacgtctacgaccgtaaacgtggtacccgacccggtcggggaccccggtaacctggcctaccgtctcccgtaccnccgccaaccgaccgacgccctcgtccgtccctccgtcg

SEQ ID NO: 326305 - DNA, 687 bp, Homo sapiens
  misc_feature: GZ8MTXP02FKJU0.22.38.D05.1.454.CMB.2.raw
  modified_base (633)..(633): a, c, t, g, unknown or other
  misc_feature (633)..(633): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtacgaaacccacacacgaccctcacgctgacctgcctaccttctctcggttctcactcaactctaggtggaggtgggtggtgggcgttcggttccgtcgacgccccgaagggaacggccgtggaagtgggtgactactttattagttggagtgtacgtacgactacacgtccatctctaggaggaggagactaccaaccgactaccccgaaccgaaccgaaacccccaaacccccgaaaacgacggttacggttacctaacaaactacgacccaaccgtacgaccgtaccctaggtacgaaccgaacacgaccctaattactactttctgacacactactactaagtacggacaccttacggtgttaccgtcgtacgaaacccgtaaacggttccggtaccccgggtacccccgggcgggggtaaccccccgaaccgttcggtacccacccggtcctacccgtcncccgtaccaacccgaaccgtaccggccctaggtcccccgttcctacccgtccgg

SEQ ID NO: 326306 - DNA, 637 bp, Homo sapiens
  misc_feature: GZ8MTXP02I49VS.22.38.D05.1.454.CMB.2.raw
  modified_base (446)..(446): a, c, t, g, unknown or other
  misc_feature (446)..(446): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgccccaggaaacggccctggaatgggtgctacttattattgggatggacggttaccgctacagtccatctctgaggaggagactcacatcccaaccgaacggaccaaacccccaaaaacaggtcggtccttaacaactcgaccaccagtcggaccctgtacggaacacgacgacccactattactttcngtcacactactctaagtaggacgacaccgttagtacggtctacggaccctaaaacgttcggttacccgacccccggtcgggggtacccccggtaaccgttcgggtacctacccggttcctcccgtacgaccgtcccctaacccgaacccgaaccggcccctaacgtcccggttacccttcccccggtccgg

SEQ ID NO: 326307 - DNA, 661 bp, Homo sapiens
  misc_feature: GZ8MTXP02GJCZS.22.38.D05.1.454.CMB.2.raw
  modified_base (190)..(190): a, c, t, g, unknown or other
  misc_feature (190)..(190): n is a, c, g, or t
  modified_base (288)..(288): a, c, t, g, unknown or other
  misc_feature (288)..(288): n is a, c, g, or t
  modified_base (323)..(323): a, c, t, g, unknown or other
  misc_feature (323)..(323): n is a, c, g, or t
  modified_base (484)..(484): a, c, t, g, unknown or other
  misc_feature (484)..(484): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcacctgaaggagtctggtcctacgctggtacgaaacccacacacgaccctnacgctgacctgccaccttctcgtggttctcactcaactctaggtggagtgggtgtgggcttggttccgtcacgccccaaggaacgcctaggagtggtnctacttattagtggatggacgtacgctacacgtcntcgtcgtggaggaggacacgtcaccatacccacgaacgaaccaaccccgaaaacgtaggtacgtcctaacaacgtacgtacccactacgtcgaaccctggtacgaaccacgacgacccaatacttactttacgtgactaccacgtacctactaagtacggngtacctacgtagtactcgacgtaacctaaacgttcggtaaccgtccccgggacggggtacccccggaacgttcgggacccgtacccgttccttacccgaccgtaccgtaccccgtaaccgtaaaaccccggccgggtaccctacccggtaccgtttcccccgttacccggtcccggg

SEQ ID NO: 326308 - DNA, 684 bp, Homo sapiens
  misc_feature: GZ8MTXP02JTXGG.22.38.D05.1.454.CMB.2.raw
  modified_base (276)..(276): a, c, t, g, unknown or other
  misc_feature (276)..(276): n is a, c, g, or t
  modified_base (306)..(306): a, c, t, g, unknown or other
  misc_feature (306)..(306): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtagaaacccacacagaccctcacgctgacctgcaccttctctgggttctcactcaactctagtggagtggtgtggctggtcgcacgccccaggaacgcctggatggtnctattattagtggatgacggttaccgctanagtccatctcgtgaggagagactacgaccatacccgaccaacggaacccaaacccccaaaacgtacggtcgtaccgtacaaactacgaaccaccgtacgtacggaccctggtacgacaacgcgacactattacgttactgtcaccaactacgtactaaggtacggacaccgtaccggttaggtacgttccgtacggaacccttaaacggttccgggttacccggacccccgggttacgggggtacccccgggtaacccgtcggggtacccgtaccccggttcctacccgttccccgacggtacccccttaacccggaacccggtaaaccggggtcccctaacggtttcccccggtttacccgttcccccggtcccggg

SEQ ID NO: 326309 - DNA, 893 bp, Homo sapiens
  misc_feature: GZ8MTXP02G4AUF.22.38.D05.1.454.CMB.2.raw
  modified_base (825)..(825): a, c, t, g, unknown or other
  misc_feature (825)..(825): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtacgaaacccacacacgaccctcacgctcgacctgcctaccttctcgtggttctcactcaactcgtaggtggtaggtgggtgtgggtctcgggttccgtcgaccgacccccgaagggaaacggcccgtagggaacgttggggtcgtactaactttaagtttaggttaggggtacgttacggtaacccggttaaccggtcctaaccgtaccggttaccctaacgttccgttacggttagggaacggggtaacgggtaacggtaacccgttaaccgaaaccccgtaactaaccccccgaaaacccccggaaaacccggaaaaccccccgaaaaaccccccccgtaaaaaacggttaccggggttaacccgtttacccggtttaaaacctaaaccgttaacccggaaaccccctaaacccgtaacggtacccgggtaaacccccgttagggtaaacccgggaaacctaacccgaaccggtaacccccaaagtttaactttaccgtttaacgttcgggtaccgacctaacctaccgttactaaacggtacgggacaccgtacgttagggtacctacgtacggtaacctaacggtccggtaccccggacccgggtccgggggaccccgtaccgttcgtaccccgtcgttcccgtaccgtacncccggttacccaacccggacccggtaaccggtccctacggttccccgtttccccgtaccccggtccgg

SEQ ID NO: 326310 - DNA, 660 bp, Homo sapiens
  misc_feature: GZ8MTXP02JZ4JB.22.38.D05.1.454.CMB.2.raw
  modified_base (319)..(319): a, c, t, g, unknown or other
  misc_feature (319)..(319): n is a, c, g, or t
  modified_base (337)..(337): a, c, t, g, unknown or other
  misc_feature (337)..(337): n is a, c, g, or t
  modified_base (371)..(371): a, c, t, g, unknown or other
  misc_feature (371)..(371): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgccccaggaaacggccctggaatgggttgcacttattagttgggatgacggttaccgctacngtccatctctgaggaggngactcacatccaccaaggaccaaccccaaaacgnggtcgtccttacgaactacgaccaccagtacggaccctacgtacggaacacgacgaccacacttattctgtcgacacactacctatacgggcaccgtacgtcgtacgtaccgtacgtaaccgtaacggttaccggtaccccggtaccccgggtaccccgggggtacccccgggtacccggtcccggtacccgtacccgtacccgtacccgtaccgtacccgtaaccccgtaccccgaacccggtaccccggtaccccgtacccggttaccccgttacccccgtccccgg

SEQ ID NO: 326311 - DNA, 665 bp, Homo sapiens
  misc_feature: GZ8MTXP02HWEMI.22.38.D05.1.454.CMB.2.raw
  modified_base (463)..(463): a, c, t, g, unknown or other
  misc_feature (463)..(463): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtcgaaacccacacacgaccctcacgctgacctgcctaccttctcgtggttctcactcaactctagtggaggtgggtgtggctcggttccgcacgccccgaagggaaacggccctaggaagtgggtgctacttattagtgggatggacggttacgctacagtccatctcgtgaggtaggagactcacactaccaaccgaacgacccaaacccccaaaacacggtacgtaccttaacaaataccgaaccctacgacgtacggacccgtgtacgacaacgacaccaactattctttcngtcacactactcttaaagtacggacgtcctacggtgtagtccgtacgaacctaaacggttccggtacccgtaaccccggggtcgggggtacccccggtaaacccgttcggggtaccctaacccggttcttacccgtacgaccctcccgtaaccgacccgaaacgggtccccacggttccccggttccttcccccgtcccggg

SEQ ID NO: 326312 - DNA, 608 bp, Homo sapiens
  misc_feature: GZ8MTXP02JBA0U.22.38.D05.1.454.CMB.2.raw
  modified_base (438)..(438): a, c, t, g, unknown or other
  misc_feature (438)..(438): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttcgtcacgccccaggaaaggccctggaatgggtgctacttatttagtggatggtacgtaccgctacagtccatctctgaggaggagactcaccatcccaccaacggaccaacccccaaaacacggtacgtccttaacaatacgaccacatacgaccctgtcggacacagccaatacttattctggtacncaacactactagtaagggactactacccgtggtaacgtcctacgaccctaaaacgttcggtttacccgaccccgttcgggggaccccgggtaaccctcggtacccgaccgtctccctacgacgcccgtccgaaccgacgggtcccacgtcccggtaccctccccgtccgg

SEQ ID NO: 326313 - DNA, 676 bp, Homo sapiens
  misc_feature: GZ8MTXP02JPL1B.22.38.D05.1.454.CMB.2.raw
  modified_base (276)..(276): a, c, t, g, unknown or other
  misc_feature (276)..(276): n is a, c, g, or t
  modified_base (331)..(331): a, c, t, g, unknown or other
  misc_feature (331)..(331): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtacgaaacccacacagaccctcacgctgacctgcaccttctcgttggttctcactcaactcgtagtggaggtgggtgtgggctggttccgcagccccaggaaggccgngaagtgggtgctacttattagttggtatggtacggtacgctacacgtccatctcnggaggaggagactacaccactaccaaccgaacgaacccaaacccccgaaaacgacggttacgtccttaacaactacgacccaccacgtacgacccttagacgaccacacgaccaactattacgtttctggtacacctaactactacgttagtaacggagtacctacgtaggttacgtctacgacctaaaacggttccggtaccccggtaccccggggtacccgggggtaccccggtaaacccggtcgggtacccctaaccggttccctcccgtaccgaccgcccctaaccgtaacccggaaacccggtccgaccggttccccgttcccgtccccgttaccccggg

SEQ ID NO: 326314 - DNA, 665 bp, Homo sapiens
  misc_feature: GZ8MTXP02FRRMQ.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacacgaccctcacgctgacctgcaccttctctgggttctcactcaactctagtggagtgggtgtggctggttccgtcacgccccaggaaacggcctggaatgggtgctactttattagtggatgtacggttacgctacagtccatctctgaggaggagactcaccatcccaccaacgaccaaccccaaaacgaggtacgtcctacaactcgaaccaccagtcgacccgtgtacgacacacgccatattactttcgtgtcaccaactacttacgtaagtacggacgcctacgtaggtacgtaccgtcgaacctaaacgtcggttaccccgaccccgggttaccgggggtacccccggtaacccgttccgggttcccgtaaccccggttccttacccgttaccgacccgttacccccgtaacccgaaaccccggaccggggtaaccccctacggttaccccggttccccgttaccccccggttcccggg

SEQ ID NO: 326315 - DNA, 731 bp, Homo sapiens
  misc_feature: GZ8MTXP02JM8BD.22.38.D05.1.454.CMB.2.raw
  modified_base (423)..(423): a, c, t, g, unknown or other
  misc_feature (423)..(423): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagcccccaggaaaggccctggaatgggtgctacttatttattgggatggacgttaccgctacagtccatctctgaggagagactcacatccaccaaggacaacccccaaaacgacggtacggtcctacaaactcgaccaccatcgaccctgtcggacacagacccaanattaatttctgtcgtacaacctaacttcctaaagttaacgggacgtaccgtaaccgttacgggttaacgttacccgttacggacccccgtaaaaaccgtttcgggggtttaccccgtaaccccccggggttacggggggtacccccccggggtaaaacccccgttcgggggttacccccgtaaacccgggttccccttcccgttaccccgaccgggtacccccttaaccccgaaacccccggaaaccggggaccccccgtaacggtttcccccgggttacccccgtttacccccccggttccccgggg

SEQ ID NO: 326316 - DNA, 670 bp, Homo sapiens
  misc_feature: GZ8MTXP02HKFZH.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtacgaaacccacacacgaccctcacgctgacctgctaccttctcgtggttctcactcaactctagtggaggtgggtggtgggtcgttcggttccgtcgacggcccccgaaggaacggcccgtaggtaagtgggttgactactttagtttagttggatacggtacggttaccgctacgacgtacacttctcgtaggaggaggagactaccaaccactaccccaaccgaaacgaacccaaaacccccgaaaacgtacggtacggtaccttaaacaaagtaccaaccaacctacgtacgacccgtgacgacacacgaccatatactttctagtcacaactacttgtaacgtaggacactacggtaggtactacgttccgaacctaacggtccggtacccgacccggtaccgggggaccccgtaaccgtcggtaccctccgtcctccgaccgacgccctaaccgacccgaaccggtcccaacgtcccgtccctttccccggcccgg

SEQ ID NO: 326317 - DNA, 693 bp, Homo sapiens
  misc_feature: GZ8MTXP02JN5CU.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtggctggttccgtcacgccccaggaaaggccctggaacgtgggtgcacttatttatggatgacgttacgctacagtccatctcgtcgaggtaggagacgtcaccataccccgaacccaaacggaaccccaaaccccccaaaaaccgtacggtaccggtacctttaaacaacgttacgaacccacctacgtcggaccctgtacggaaccacgacgacccaactactttacttacctaggtacacctaacctacgttacttaaagtacgggaacgtccaaccgtttggtaacttcgttacggaccctaaacgtcgggttacccgtaacccgtcgggggaccccggtaaccgtcgggtaccctaacccggttcttaccccgtacgtacccgtacccctaacccgaacccgaaaccggggtccccacggttcccggttccccttcccccggtccggg

SEQ ID NO: 326318 - DNA, 629 bp, Homo sapiens
  misc_feature: GZ8MTXP02JJ0RF.22.38.D05.1.454.CMB.2.raw
  modified_base (582)..(582): a, c, t, g, unknown or other
  misc_feature (582)..(582): n is a, c, g, or t
tcagacatacgcgtcacgaccggtgctcgatttagtatctgatagttgggtttggggagtgactcctgtgcccgaccatggacacactttgctccacgctcctgctgctgaccatcccttcatgggtcttgtcccagatcaccctgaaggagtctggtcctacgctggtacgaaacccacacacgaccctcacgctgacctgcaccttctcttggttctcactcaactctagtggagtgggtgtggctggtccgtcgacgccccgaggaacggccctggacgtggtgctacttattagtggatcgtacggtaccgctacagtccatctcgtggaggagacgactcaccactacccaaccgtaacgaacccaaacccccgaaaacgacggttacgtaccttaacgaaactaccgaaccctaaccgacgtaccggtacccgtacgtacgaaaccgaccacgaccaactattactttcgtgtacacacgtactatagtacgcgactaccggtgtacgtcgtacgacctaacgtcggtacccgtacccgggtcgggtaccccgtacgtccggtcccacgtcctccnccgacgccctaaccgaccggaacgcctacgtccgttccctccgtccg

SEQ ID NO: 326319 - DNA, 718 bp, Homo sapiens
  misc_feature: GZ8MTXP02HU9Q3.22.38.D05.1.454.CMB.2.raw
tcagacatacgcgtcacgaccggtgctcgatttagtatctgatagttgggtttggggagtgactcctgtcgccccaccatggacacactttgctccacgctcctgctgctgaccatcccttcatgggtcttgtcccagatcaccctgaaggagtctggtcctacgctggtacgaaacccacacacgaccctcacgctgacctgctaccttctcgtggttctcactcaactctagtggagtgggtgtggctggttccgtcacgaccccaggaacggccctaggaatgggttgctacttattagtggatggtacgttacgctacacgtccatctcgtagaggagacgactaccgacactaccaaaccgaaaccggaacccaaaaccccccaaaactacgggttacggtaccctttaaacgactaccgaaccctaaccacgtaccgtaaccccgtggtaacggaccaaacgaccgtaccaaccttaaatttaactttcgttaggttacgacctaacctaaccgtttacgttaaacgtacggggtaactaccgtaaccggttacggttacggtactaccggaaaccctaaacgggttccggttacccggaccccggttacgggggaccccggtaaaccgttggacccgtaccgttcctcccgtacgaccgtaccaaccccgaacgaaccggtcccaacggttccgtcccgtttccccgccgg

SEQ ID NO: 326320 - DNA, 609 bp, Homo sapiens
  misc_feature: GZ8MTXP02H3VY4.22.38.D05.1.454.CMB.2.raw
  modified_base (322)..(322): a, c, t, g, unknown or other
  misc_feature (322)..(322): n is a, c, g, or t
  modified_base (436)..(436): a, c, t, g, unknown or other
  misc_feature (436)..(436): n is a, c, g, or t
  modified_base (562)..(562): a, c, t, g, unknown or other
  misc_feature (562)..(562): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtagaaacccacacagaccctcacgctgacctgccaccttctctgggttctcatcaacttctagtggagtgggtgtgggtctggttccgcacgccccgaaggaacggccctaggaagtgggtgactacttagtttagtgggatggtacgtaccgntacacgtccatctctgaggaggtagactcacatcccaacaacgaccaaaccccaaacaggtacgctaacatacgaaccacatacgaccctagagacacgacaccacatttactntggtacacacacttcgtaagtacggacgtaccaccgttgggaacttcgacggaccctaaacgttccggttacccggaaccccgtccgggggtaccccgaaccgtttcggacctaccgtaccgtccncgacgccctaaccgacgaacggccctagtcccggttcctccccgcgg

SEQ ID NO: 326321 - DNA, 644 bp, Homo sapiens
  misc_feature: GZ8MTXP02JJJ8E.22.38.D05.1.454.CMB.2.raw
  modified_base (315)..(315): a, c, t, g, unknown or other
  misc_feature (315)..(315): n is a, c, g, or t
  modified_base (404)..(404): a, c, t, g, unknown or other
  misc_feature (404)..(404): n is a, c, g, or t
  modified_base (452)..(452): a, c, t, g, unknown or other
  misc_feature (452)..(452): n is a, c, g, or t
  modified_base (456)..(456): a, c, t, g, unknown or other
  misc_feature (456)..(456): n is a, c, g, or t
  modified_base (468)..(468): a, c, t, g, unknown or other
  misc_feature (468)..(468): n is a, c, g, or t
  modified_base (478)..(478): a, c, t, g, unknown or other
  misc_feature (478)..(478): n is a, c, g, or t
  modified_base (483)..(483): a, c, t, g, unknown or other
  misc_feature (483)..(483): n is a, c, g, or t
  modified_base (496)..(496): a, c, t, g, unknown or other
  misc_feature (496)..(496): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctggttctcactcaactctagtggagtgggtgtggctggttccgtcacgccccgaggaaacggccctggaagtgggtgctacttatttagttgggatgaccggttacnctacagtccatctcgtagaggaggagactacaccatacccaaccaacggaacccaaacccccgaaaaaccgacggtacggtcccttaanaaactacgaaccaaccacgtcggaccctgtcgaacacacgacactatnttcngtcacactactntaagtacggntaccncgttaggaacgtntacggaacctaacgtcggttaccccgacccggcgggggtaccccggtaaacccgtcggtaccgtacccgtccgttcccgtaccacccgaccctccccgaaacggaacccggccccttacgtcccggttcccccttacccccgtccggg

SEQ ID NO: 326322 - DNA, 692 bp, Homo sapiens
  misc_feature: GZ8MTXP02GOORN.22.38.D05.1.454.CMB.2.raw
  modified_base (269)..(269): a, c, t, g, unknown or other
  misc_feature (269)..(269): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtagaaacccacacacgaccctcacgctgacctgcaccttctctggttctcactcaactctagtggagtggtgtggctggtccgtcacgcccaggaacgccnggatggtgctacttattagtggatcgacggttaccgctacagtccatctcgtggaggaggacgactcacctataccccaaccgaaccgaacccaaacccccaaaacgacggttacgtaccctaacaactaccgaccacctacgtacggtaccctggtacgaaccaccgaacgacccaacgttattactttcgtacgttcgacctaacctaacttaccttaaaggtacggtacgaccctaacccggttaggtacgttaccgtacgtaacccgtaaacgttccgggttaccccgtacccggggtacccggggaccccggtaacccgtcggtacccgtacccgttcctacccgtaccgacccgtcccgtaacccgaaccggtacccggtccctaccgttcccggttcccccgtccccggttcccgg

SEQ ID NO: 326323 - DNA, 696 bp, Homo sapiens
  misc_feature: GZ8MTXP02FHRTW.22.38.D05.1.454.CMB.2.raw
  modified_base (316)..(316): a, c, t, g, unknown or other
  misc_feature (316)..(316): n is a, c, g, or t
  modified_base (385)..(385): a, c, t, g, unknown or other
  misc_feature (385)..(385): n is a, c, g, or t
  modified_base (455)..(455): a, c, t, g, unknown or other
  misc_feature (455)..(455): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtagaaacccacacacgaccctcacgctgacctgccaccttctctgggttctcactcaactctagtggagtgggtgtggctggtccgtcacgccccaggaacggccctggaagtgggttgctacttagtttagttggatgacgttaccnctacagtccatctctgaggaggagacctcaaccactaccccaaccaaacggaccaaacccccaaaaacncggttacgtccttaacaaactacgaccacctagtacgaccctgtacgacacagccatatactttctcgtnactactactacgtagtacggactcgaacccgttgggtaccgtttacgacggtaaccccttaaacgggttccggttacccccggggtacccccgggtcccggggggtaccccccggtaaccccgttaggggttaccccacccccggttcttaccccggttacccgcccgtacccccgtaacccgaacccgggtaacccggtcccccgtaccggttccccggtccccctttacccccggtcgg

SEQ ID NO: 326324 - DNA, 731 bp, Homo sapiens
  misc_feature: GZ8MTXP02GZRYT.22.38.D05.1.454.CMB.2.raw
  modified_base (283)..(283): a, c, t, g, unknown or other
  misc_feature (283)..(283): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtagaaacccacacacgaccctcacgctgacctgcaccttctctgggttctcactcaactctagtggagtgggtgtgggctggtccgtcacgcccgaggaagccctggaatgggtnctacttatttagtggtagtgacggtaccgctacacgtccatctcgtagaggaggacgaccgtacaccactaccccaaccgaaacggaacccaaacccccgaaaaccgtacggtacgtaccgttaacaactaccggacccaccacgtaccggtaccctaggtacgaccaacacgaccaactacttactttcgtcggtacacctaactaccttacgtaaacgtacggacgtacccgtaacggttacggttacgtcgtaaccggtaaccgttaaaaccgggttccgggttaccccggtaaacccccggggtccccggggggtaaacccccggtaacccggtttcgggtacccgtacccgttccgttacccctccgaacccgtcccgaaccccgaaccggaaacccggtacccgtacgttcccccgggtttccccttacccccggtcccggg

SEQ ID NO: 326325 - DNA, 569 bp, Homo sapiens
  misc_feature: GZ8MTXP02H86H9.22.38.D05.1.454.CMB.2.raw
  modified_base (209)..(209): a, c, t, g, unknown or other
  misc_feature (209)..(209): n is a, c, g, or t
  modified_base (361)..(361): a, c, t, g, unknown or other
  misc_feature (361)..(361): n is a, c, g, or t
  modified_base (371)..(371): a, c, t, g, unknown or other
  misc_feature (371)..(371): n is a, c, g, or t
  modified_base (393)..(393): a, c, t, g, unknown or other
  misc_feature (393)..(393): n is a, c, g, or t
  modified_base (398)..(398): a, c, t, g, unknown or other
  misc_feature (398)..(398): n is a, c, g, or t
tcagacatacgcgtcacgaccggtgctcgatttagtatctgatagttgggtttggggagtgactcctgtgcccccaccatggacacactttgctccacgctcctgctgctgaccatccccttcatgggtcttgtcccagatcaccctgaaggagtctggtcctacgctggtgaaacccacacagaccctcacgctgacctgcaccttcnctgggttctcactcaactctagtggagtgggtgtgggctggtccgtcagccccaggaaaggccctggaatgggtgcacttatttatggatgacggttaccgctacagtccatctctgaggagagactcacatccaccagacaccccaaaacngtgtccttanaatgaccaccatcggaccctgngacanacgcacatatttctagtcgcacactcctaataggacgacaacccgtggtaacgtctacggaccaaaactggttacccgaccccgtcgggggaccccgggtaacccgtcgggtctacccggtcctcctccacgcctccaccgaacggcccacgtccggtcctccccgtccgg

SEQ ID NO: 326326 - DNA, 734 bp, Homo sapiens
  misc_feature: GZ8MTXP02HAOJB.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcacctgaaggagtctggtcctacgctggtacgaaacccacacacgaccctcacgctgacctgctaccttctcgttcgggttctcactctaactctagtggtaggtgggtgtggtctggtccgtcacgccccgaaggaacggccgtggtaagttgggtcgtactacgtttagtttagtggtagtagtacggtaccgctacgtacgtacactctcgtaggaggacggacactacaacgtactacccaaccgaaacgaaccccaaaacccccgtaaaaccggtacggttacggttacctaactaaacgtccgaacccaaccgtacgtaccgacccgtaggtacgaccaaccgtacgacctaacgttaatttccgttgtacgtcgacctaactacgtactaagtacggaacgtcctaccgtaggtctaccgtactaaccgtaaccgttcggtaacccccggtaccggggtccggtaccccgggtaacccgtcggttccccgaaacccgttcccgaacccgccgtacccgtaaacccgccccgggtaaaaccgccccgtacccggttccggttccccccttacccggtccggtaaccccg

SEQ ID NO: 326327 - DNA, 820 bp, Homo sapiens
  misc_feature: GZ8MTXP02IRGAO.22.38.D05.1.454.CMB.2.raw
  modified_base (577)..(577): a, c, t, g, unknown or other
  misc_feature (577)..(577): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtccagatcacctgaaggagtctggtcctacgctggtacgaaacccacacacgaccctcacgctgacctgcctaccttctcgttggttctcactcaactcgtaggtggtaggtgggtggtgggtcgttcgggttccgtccgaccgaccccggaagggaaacggcccgtaggtaagttcgggttcgtactactttaagtttagttagggtagttacggtaaccggttaccggtacctaaccgtaacgtacctattccgttacggtagggaagggacggacgtaacctaccaaacccgtactaacccccgaaaccgaaaaccggaaacccccaaaaaccccccgtaaaaaaccggtacggttaacggtacccttaaacaaacgtaccgaacccaacctaacgtacggtaacccttggaccgaacacgacgacctaatacttacttcgtntacgacctactaactcgtaaagtacggataccgtactaggtacgtcgtacgtaacccgttaacggtcccgggtttacccgggacccccgggtaccgggggtaacccccgtaacccggttcggttaccccgaaccccggtttccctaccccgttaaccgccccggttacccccgtaaacccgtaacccggaacccggaccccgttaccgttcccccggtttacccccggtcccccgtacccggg

SEQ ID NO: 326328 - DNA, 694 bp, Homo sapiens
  misc_feature: GZ8MTXP02JNAF7.22.38.D05.1.454.CMB.2.raw
  modified_base (329)..(329): a, c, t, g, unknown or other
  misc_feature (329)..(329): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgccaccttctcttgggttctcactcaactctagtggagtgggtgtggctggtccgtcacgccccgaggaaacggccctggaagtgggtgctacttagttagtggagtcgacggtacgctactagtcatctntgaggagagactcactactacccaaccgaaccgaaccaaacccccgaaaacgacggttacgtacccgtaaacaactacggaccacctacgtacggaccccgtagtacggaaccaccacggaccctaactactttactttcgtaggtcacaccgtaactgtaaagtacggacgtcctacggttaggtacgcgtacgacccgtaaacgttccgggtaacccggaccccgggtaccgggggtaccccgggaacccgttcgggtaaccccgtacccggtccttaccccgaccgtaaccgccccgtaaccgaaccccggtaaaccgggtcccctacgtttacccccggttcccgttaccccccgtccggg

SEQ ID NO: 326329 - DNA, 585 bp, Homo sapiens
  misc_feature: GZ8MTXP02FWJHH.22.38.D05.1.454.CMB.2.raw
  modified_base (203)..(203): a, c, t, g, unknown or other
  misc_feature (203)..(203): n is a, c, g, or t
  modified_base (294)..(294): a, c, t, g, unknown or other
  misc_feature (294)..(294): n is a, c, g, or t
  modified_base (404)..(404): a, c, t, g, unknown or other
  misc_feature (404)..(404): n is a, c, g, or t
  modified_base (408)..(408): a, c, t, g, unknown or other
  misc_feature (408)..(408): n is a, c, g, or t
tcagacatacgcgtcacgaccggtgctcgatttagtatctgatagttgggtttgggggaggaactgctcagttaggacccagagggaaccatggaagccccagctcagcttctcttcctcctgctactctggctcccagataccaccggagaaattgtgttgacacagtctccagccaccctgtctttgcgtccgggggaaangccaccctctcctgcgagggccagtcagaatgttagtagttacttagcctggtaccagacaaacgcctggccaggcctacccagacctccncactcgtctagactacaactaccaaacgacgggcccacgtcggaccaccgtccccacgtcctagggtttcaggtggcgtaggtcgggtcgtaggactagacttcactccncacntacagcacagacgctagaatatttgacttagttacttatgtcagcgtagcgtaagctatcgtacggtcctaccgtaccgtacgttcggacgtacgggacacggtcgtacggactagtaaccgaaacgacgtcggtacgactcgaacctacgacttcgtattcctactactttccccg

SEQ ID NO: 326330 - DNA, 722 bp, Homo sapiens
  misc_feature: GZ8MTXP02HU9TJ.22.38.D05.1.454.CMB.2.raw
  modified_base (390)..(390): a, c, t, g, unknown or other
  misc_feature (390)..(390): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcacgccccaggaacgccctggaatgggtgctacttatttagtggatgtacggttaccgctacagtccatctcgtagaggagagactcacatccaaccaacgacccaaacccccaaaacgtacggtacgtccttaanaactacgaccctaaccacgtccggtaacccttgacggaaccacgacgacccaactaattacttttcgtcgtacacctaaccacttacctaagttaacgggacgtacctacccgttaggtaacgtccgtacgaccgtaaaaccgttccgggttacccgaccccccgggtcgggggtaccccccggggtaaaacccttcggggtacccctaacccggtttccctaccccgttacccgaaccggtacccccttaaccccggaaaccccggtaacccgggggtaccccctaccggtttcccccgggtttcccccgtttacccccccggtccccggg

SEQ ID NO: 326331 - DNA, 617 bp, Homo sapiens
  misc_feature: GZ8MTXP02IURSF.22.38.D05.1.454.CMB.2.raw
  modified_base (283)..(283): a, c, t, g, unknown or other
  misc_feature (283)..(283): n is a, c, g, or t
  modified_base (314)..(314): a, c, t, g, unknown or other
  misc_feature (314)..(314): n is a, c, g, or t
  modified_base (448)..(448): a, c, t, g, unknown or other
  misc_feature (448)..(448): n is a, c, g, or t
  modified_base (470)..(470): a, c, t, g, unknown or other
  misc_feature (470)..(470): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtggctggttccgcacgccccaggaaacggccctggaatgggtnctactttattagtgggtatgacggttaccgntacagtcatctctgaggaggagactcaaccatacccaaccaacggaaccaaacccccaaaaacctacggtcgtaccttacaaactacgaaccaccatcgggacctcgtggacacacgaccatacttatttactntacgcacactactactaggacnccgtaccgtgtacgtctacgtaccgaaacgttcgggtacccgaccccggtcgggggaccccggaaccgtcggtccgtacccgtcctccctcaccgtcccgaaccgtacccgaacgggtcccctacgtccggttcccttccccgtcgg

SEQ ID NO: 326332 - DNA, 598 bp, Homo sapiens
  misc_feature: GZ8MTXP02IBDNI.22.38.D05.1.454.CMB.2.raw
  modified_base (272)..(272): a, c, t, g, unknown or other
  misc_feature (272)..(272): n is a, c, g, or t
  modified_base (441)..(441): a, c, t, g, unknown or other
  misc_feature (441)..(441): n is a, c, g, or t
  modified_base (463)..(463): a, c, t, g, unknown or other
  misc_feature (463)..(463): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtggctggttccgtcacgccccaggaacgcccnggaagtgggtgctacttatttatgggatgtacggttaccgctacagtccatctctgaggagagactcaccatccaccaacgaccaacccccaaaaccgaggtacgtccttacaactacgaccaccatcggaccctggtcgaccacgacgaccactattctttactgtancactacgtcctaatagggaccnctaccggtggtacgtctacgtacctaaacgttcggttaccgaccccggtcgggggacccccggtaccgtcggtccacccggtctcccgacacgcctaaccgaccgaacggcccacgtccggtccctccccgtcgg

SEQ ID NO: 326333 - DNA, 634 bp, Homo sapiens
  misc_feature: GZ8MTXP02HNWR4.22.38.D05.1.454.CMB.2.raw
  modified_base (382)..(382): a, c, t, g, unknown or other
  misc_feature (382)..(382): n is a, c, g, or t
tcagacatacgcgtcacgaccggtgctcgatttagtatctgatagttgggtttgggggaggaactgctcagttaggacccagagggaaccatggaagccccagctcagcttctcttcctcctgctactctggctcccagataccaccggagaaattgtgttgacacagtctccagccaccctgtctttgtcgtccgggggaaagacgccaccctctcctgcagggccagtcagatgttagtattacttagctggtaccagacaaagcctggccaggctcccagactcctcatctctgactacatccaaacgagggccacgtggcactccccagcccaggttcagtggcaggtgggtctggggcagtacttccatcctacacntccaacgcgaaccctagacgtacctaggtaaagttaacgttttgtacgttagtttttaacttacgtacgttcgtacgacgtaggtaccgtaagtctacgtcgttcgggcccttacccgtaccgttaccgtttcgggccggtaaacggggtaccgaaagtccggtaacggaaggtactaaaccgaaaacgtacggtacggttcggaccgtcgtaaccgaccgttacgtacgttctactttctacctttccccg

SEQ ID NO: 326334 - DNA, 652 bp, Homo sapiens
  misc_feature: GZ8MTXP02FQYRJ.22.38.D05.1.454.CMB.2.raw
  modified_base (300)..(300): a, c, t, g, unknown or other
  misc_feature (300)..(300): n is a, c, g, or t
tcagacatacgcgtcacgaccggtgctcgatttagtatctgatagttgggtttgggggaggaactgctcagttaggacccagagggaaccatggaagccccagctcagcttctcttcctcctgctactctggctcccagataccaccggagaaattgtgttgacacagtctccagccaccctgtctttgtcgtccggggaaagacgccaccctctcctgcgacgggccagtcagaattgttagtagttacttagcctggtacagacaaagctggcaggcctccagacctcctcatctctnatacactaccaacgacggccacgtggccacgtccccacgcctaggttcaggtcggacgtaggtcggggtacgtggggaacacgtaccttaccgaccttcctaccaaccctatccgaacgccgtaaacctagacgccgttaggtaagttacttttggactttagtttacttacgtgttacagctaggtcgtacggactacgttcgtaccgtcctacccgttaccgttaccggttacgggacccgtaacgggaccgaacggtcgtaacgggacgaagtaaaccgtaaacggtaaccgtcggtaccgtacgttaccgaacgtactacgttcgttcttacctacttaccgttcccg

SEQ ID NO: 326335 - DNA, 638 bp, Homo sapiens
  misc_feature: GZ8MTXP02JY6Q6.22.38.D05.1.454.CMB.2.raw
  modified_base (226)..(226): a, c, t, g, unknown or other
  misc_feature (226)..(226): n is a, c, g, or t
  modified_base (286)..(286): a, c, t, g, unknown or other
  misc_feature (286)..(286): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtcgaaacccacacacgaccctcacgctgacctgcaccttctctggtctcactcaactntagtggagtgggtgtgggctggttccgcacgccccgaggaacggcctaggaagtgggttnctacttatttagttgggatgtacggttaccgctacacgtccatctcgtggaggagacgactcaccatacccaaccaacggaacccaaacccccgaaaaccgaggtcgtacctaacaactacgaaccaccacgtacggaccctagtacggaacaccgaacgccctaactagttacttcgtaggtcaccactacctactaaggaggacgtaccgtacgttggtactcgtacaccgtaaacgtcggttacccgcccgggtaccgggggaccccggaccgtcggtccctaccggtcctacccgtcaccgccctaaccgaccgacggtccctacgtcccgttcccgtccccgtccgg

SEQ ID NO: 326336 - DNA, 646 bp, Homo sapiens
  misc_feature: GZ8MTXP02FJYTG.22.38.D05.1.454.CMB.2.raw
  modified_base (204)..(204): a, c, t, g, unknown or other
  misc_feature (204)..(204): n is a, c, g, or t
  modified_base (508)..(508): a, c, t, g, unknown or other
  misc_feature (508)..(508): n is a, c, g, or t
tcagacatacgcgtcacgaccggtgctcgatttagtatctgatagttgggtttgggggaggaactgctcagttaggacccagagggaaccatggaagccccagctcagcttctcttcctcctgctactctggctcccagataccaccggagaaattgtgttgacacagtctccagccaccctgtctttgtcgtacgggggaaanacgccaccctctcctgcgagggccagtcagtaattgttaagtagttacttacgtccgtaggtaccagacaaacgcctggacaggcctcccgagacctcctactactcctcttagactaccacttaaccaaacgacgggcctaacgtcgaccgactaccccgagaccgtaggtttcgacggtggaccgtaggtccggggtacgtacggggactacgtacttaccgacttccgccaaccagtccgagtaaccacgtacggactaccgtagttaaagttattttagcgtttaagttacttagttcgnaagcctagtacgtcgactacttcgtaccggacccttacccgtagttaccgttcgggaccggacggaactaacgcgtaggacacgtacaaacgtagttcgagactacgccaactacgtctccgttatcccagtttaccc

SEQ ID NO: 326337 - DNA, 613 bp, Homo sapiens
  misc_feature: GZ8MTXP02HUL0K.22.38.D05.1.454.CMB.2.raw
  modified_base (405)..(405): a, c, t, g, unknown or other
  misc_feature (405)..(405): n is a, c, g, or t
  modified_base (414)..(414): a, c, t, g, unknown or other
  misc_feature (414)..(414): n is a, c, g, or t
  modified_base (438)..(438): a, c, t, g, unknown or other
  misc_feature (438)..(438): n is a, c, g, or t
  modified_base (441)..(441): a, c, t, g, unknown or other
  misc_feature (441)..(441): n is a, c, g, or t
  modified_base (445)..(445): a, c, t, g, unknown or other
  misc_feature (445)..(445): n is a, c, g, or t
  modified_base (452)..(452): a, c, t, g, unknown or other
  misc_feature (452)..(452): n is a, c, g, or t
  modified_base (458)..(458): a, c, t, g, unknown or other
  misc_feature (458)..(458): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacacgaccctcacgctgacctgcaccttctctgggtctcactcaactctagtggagtgggtgtgggctggtccgcacgccccgaggaacggcccgtggaagtgggttgactacttatttagttgggtatgacggttaccgctacagtccatctcgtggaggaggagctacacatacccaccaacgaaccaacccccaaaacacggtcgtcctacaatacgaccacancgaccctgngacacacgccactacttattacgngtncacnctactanaggtanccgtaccgtggtagtcctaggtaccaaacgttccggtcccggtaaccccgggtcgggggccccgggtaacctccggtacccgtcgtacccgtcctcaaccgtccctaacccgaccgtaaccgggcccttaggtccccgttccttacccccgccgg

SEQ ID NO: 326338 - DNA, 608 bp, Homo sapiens
  misc_feature: GZ8MTXP02H7HTA.22.38.D05.1.454.CMB.2.raw
  modified_base (241)..(241): a, c, t, g, unknown or other
  misc_feature (241)..(241): n is a, c, g, or t
  modified_base (313)..(313): a, c, t, g, unknown or other
  misc_feature (313)..(313): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgngggtctggtcctcagaccccaggaacggccctaggaagtgggtgctacttatttagtggatgacggttaccnctacacgtacatctctaggaggagacgactcacactcccaccaacgacccaaaccccaaaacgcggtacgtcctaacaataccgtaccactatcggacctgtacgacacacgacactattattctgacgtcaccattcctaagttacgggactccgaccgttggtaacgttcacggtaacctaaacgttcggtaccgaccccggtccgggggacccggaccgtcggtaccaccgtacctcctcgaccgtccctaaccgaccgtaacggccctacgtcccggtccttcccgtccgg

SEQ ID NO: 326339 - DNA, 770 bp, Homo sapiens
  misc_feature: GZ8MTXP02I0AKB.22.38.D05.1.454.CMB.2.raw
  modified_base (178)..(178): a, c, t, g, unknown or other
  misc_feature (178)..(178): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccanacagaccctcacgctgacctgcaccttctctgggttctcactcaactctagtggagtgggtgtgggctggttccgtcacggcccccaggaaacggccctggaatgggttgctactttattagttggatgacggttaccgctacagtccatctcgtagaggaggagactcgaaccatccccaaccgaaacggacccaaaaccccccgaaaaaactacggggttacggtacctttacgaaataccgaacccaacccagtccgggaaccctggtacggaccaacgacgacctaactattacttttccgtgttcgactactaacttaccgttaaagttaggggacgtaaccgtaccgttagggggtaacttccgttacgggaccctaaaaacggtttccggggtttacccgtaaacccccggggtttcccggggggacccccggggtaaaccgtttccgggggtaacccctacccggtttacccgttaccccttcccgaacccggtacccccttaacccggaaacccccggtaacgggggtacccccctaacggttcccccggggtttacccctttaccccccccgggttccgggg

SEQ ID NO: 326340 - DNA, 667 bp, Homo sapiens
  misc_feature: GZ8MTXP02FWICB.22.38.D05.1.454.CMB.2.raw
  modified_base (286)..(286): a, c, t, g, unknown or other
  misc_feature (286)..(286): n is a, c, g, or t
  modified_base (325)..(325): a, c, t, g, unknown or other
  misc_feature (325)..(325): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtacgaaacccacacacgaccctcacgctgacctgccaccttctctggttctcactcaactctagtggagtgggtgtggctggttccgtcacgccccgaggaacgccgtggagtgggtnctacttattagtggatgtacggtacgctacagtcatctnggaggaggagactcacactaccaaccaacgaaccaaacccccaaaacgacggttacgtaccttaacaacgtacgacccacacgtacggacccttgtacggaaaccacgaacgaccaattaacttattttacgtggttacacctaacctacttacgtaagtacgggatcccgtaaccgttggtaaccgtcgtacgtaccgtaaacggttcggtacccgaccccgggtccgggggaccccggtacccgtcggtacccgtacccgttccttacccgaccgaccgtccccgtaacccgaaccggtaaccggcccctaacgttcccggtcccctttccccggcccgg

SEQ ID NO: 326341 - DNA, 681 bp, Homo sapiens
  misc_feature: GZ8MTXP02GIW5J.22.38.D05.1.454.CMB.2.raw
  modified_base (283)..(283): a, c, t, g, unknown or other
  misc_feature (283)..(283): n is a, c, g, or t
  modified_base (471)..(471): a, c, t, g, unknown or other
  misc_feature (471)..(471): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcacctgaaggagtctggtcctacgcgtggtacgaaacccacacacgaccctcacgctgacctgcctaccttctcgtggttctcactcaactcgtaggtggaggtgggtgtgggctggttccgcacgaccccgaggaacggccgnggagtgggtgctacttagttagtggtagtgtacgtaccgctactacgtccatctcgtaggaggtaggacgacctacaccactacccgaaccgaaccgaacccaaacccccgaaaacgacgtacgtaccgtacaacgtacgaccaaccacgtacgacctagtcgaaacacgacacaactattactttcngtacgacactactacgtaagtaggacgacctacgggttaggtacgtaccgtacggacccgtaaacggttccggtaccccgggaccccggggtccgggggtaaacccccggtaccgttcggtaccccggtacctcccgtccctacgacccgtacccgaacccgtaacccggaccggtaccctcggttcccccgttcccgttccccggacgg

SEQ ID NO: 326342 - DNA, 704 bp, Homo sapiens
  misc_feature: GZ8MTXP02JEXY1.22.38.D05.1.454.CMB.2.raw
  modified_base (271)..(271): a, c, t, g, unknown or other
  misc_feature (271)..(271): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtacgaaacccacaccagaccctcaccgctgacctgccaccttctctggttctcactcaactctagtggagtgggtgtggctggtctcacgcccaggaacgccnggagtggtgctattattagtggatgtacgtaccgctacacgtcctatctctaggaggaggtagacctccaacactaccccaacccgaacggaaaccccaaaaccccccgaaaaacgtacggtacgttacccttaaacaactacgaacccaccgagtaccgggacccttggacgaccaacggacacccaatactttactttcgtacggtacacaacctacttaactaggtacggaacgtacctaccggttggtaacgtcgtacgtaaaccctaacggttcccgggttacccgacccccggggtcgggggtaacccccggtacccgtttacggggacccctacccggttcccttaccaaccggtccgtaaccccgtaaccgaaacccggaaccggggtcccctaggtttcccccggtccctttccccccgggcgg

SEQ ID NO: 326343 - DNA, 624 bp, Homo sapiens
  misc_feature: GZ8MTXP02FX7NJ.22.38.D05.1.454.CMB.2.raw
  modified_base (490)..(490): a, c, t, g, unknown or other
  misc_feature (490)..(490): n is a, c, g, or t
  modified_base (614)..(614): a, c, t, g, unknown or other
  misc_feature (614)..(614): n is a, c, g, or t
tcagacatacgcgtcacgaccggtgctcgatttagtatctgatagttgggtttgggggaggaactgctcagttaggacccagagggaaccatggaagccccagctcagcttctcttcctcctgctactctggctcccagataccaccggagaaattgtgttgacacagtctccagccaccctgtctttgctccgggggaaagagccaccctctcctgcaggccagtcagaatgttagtagttacttagcctaggtacccagacaaaacgcctggccaggcctacccagacctcctacatctctgactacactcccaaacgacggccacgtggacactcccacgcctaggttcgagtggaccgaggtcgggtacgtacggggacaacgtctacaactcctaccacctatccgacgtacgaacctagacgtaccgtagtaacgtacttttgtacttagtttaacttactgttacacgctaaagtcggtaacncgtatcgttaccgccgtcctaaacgtccgttacggaccgacgggaccacggtcgaggtaacgactaaacggaaactacgtcggtcgacgtacgaaccgtaccctattaccgtcttacgttaccnctttaccccg

SEQ ID NO: 326344 - DNA, 740 bp, Homo sapiens
  misc_feature: GZ8MTXP02HKQ22.22.38.D05.1.454.CMB.2.raw
  modified_base (419)..(419): a, c, t, g, unknown or other
  misc_feature (419)..(419): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtggctggttccgcacgccccaggaaacggccctaggaatgggtgctacttatttagtgggatggaccggtaccgctacagtcatctctggaggaggagactcgacatcccaaccaacggaccaacccccaaaacgacggttacgtcctaactaaactacgaaccaaccagcggtacccnggtacggaccacgacgacccaataatttactttcgtacgtcgtaccaactaacttaccgtaaagtacgggtacgtaccgtaacccggttaggggttaaacctccgtttaaccggaacccttaaaaaccggtttccgggggttaacccccgtaaacccccgggggtccggggggtaaccccccgggaaccccgtttacggggtcccccgtaacccgggttcctccccgtaacggtacccggtacccccgttaacccggaaaccccgaaacgggggtcccccaaacccggtttcccgggtccccgttttccccccggcccggg

SEQ ID NO: 326345 - DNA, 572 bp, Homo sapiens
  misc_feature: GZ8MTXP02FEKJ0.22.38.D05.1.454.CMB.2.raw
  modified_base (203)..(203): a, c, t, g, unknown or other
  misc_feature (203)..(203): n is a, c, g, or t
  modified_base (376)..(376): a, c, t, g, unknown or other
  misc_feature (376)..(376): n is a, c, g, or t
  modified_base (428)..(428): a, c, t, g, unknown or other
  misc_feature (428)..(428): n is a, c, g, or t
  modified_base (431)..(431): a, c, t, g, unknown or other
  misc_feature (431)..(431): n is a, c, g, or t
tcagacatacgcgtcacgaccggtgctcgatttagtatctgatagttgggtttgggggaggaactgctcagttaggacccagagggaaccatggaagccccagctcagcttctcttcctcctgctactctggctcccagataccaccggagaaattgtgttgacacagtctccagccaccctgtctttgtctccgggggaaanagccaccctctcctgcagggccagtcagaatgttagtagttacttagcctggtaccagcaaaagctggccaggctcccagactctcatctctgatacatccaacagggccactggcatccccagccagggtttcagtgggcctaggtgggtactggggacagacttcacttcncaccaatcagcgacctagacgccttgaagtattttggctagttattactgtnagnagcgtagcatcgtcgggaccttcccgtaacctaacccgttttgggacccgaagggggaaccaaaagccgttacggacgtaactacgaaaaccgaaaccgttgttacggcttggaaccaccaatctgttccttcactttccc

SEQ ID NO: 326346 - DNA, 632 bp, Homo sapiens
  misc_feature: GZ8MTXP02JR0X9.22.38.D05.1.454.CMB.2.raw
  modified_base (178)..(178): a, c, t, g, unknown or other
  misc_feature (178)..(178): n is a, c, g, or t
  modified_base (254)..(254): a, c, t, g, unknown or other
  misc_feature (254)..(254): n is a, c, g, or t
  modified_base (270)..(270): a, c, t, g, unknown or other
  misc_feature (270)..(270): n is a, c, g, or t
  modified_base (309)..(309): a, c, t, g, unknown or other
  misc_feature (309)..(309): n is a, c, g, or t
  modified_base (321)..(321): a, c, t, g, unknown or other
  misc_feature (321)..(321): n is a, c, g, or t
  modified_base (334)..(334): a, c, t, g, unknown or other
  misc_feature (334)..(334): n is a, c, g, or t
  modified_base (379)..(379): a, c, t, g, unknown or other
  misc_feature (379)..(379): n is a, c, g, or t
  modified_base (389)..(389): a, c, t, g, unknown or other
  misc_feature (389)..(389): n is a, c, g, or t
  modified_base (396)..(396): a, c, t, g, unknown or other
  misc_feature (396)..(396): n is a, c, g, or t
  modified_base (424)..(424): a, c, t, g, unknown or other
  misc_feature (424)..(424): n is a, c, g, or t
  modified_base (443)..(443): a, c, t, g, unknown or other
  misc_feature (443)..(443): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccanacagaccctcacgctgacctgcaccttctctgggttctcactcaactctagtggagtgggtgtgggctggtcgtcngccccaggaaagcccnggaatgggtgctacttatttatggatgacgttacgctanacgtccatctcngtaggagagactnaccatacaccaacgacaacccccaaaacgagtacgtccttaagancgaccacaancgacccngtacgacacaacgcacattagtcttagnacataactctagagacgtnaccgttgtaagttcgtacgaacctaaacggttcggttaccggtaacccccgtcggggacccccggggtaaaaccccgttcggttaacccggaaacccgttacgtttccccctaaccggtaccccgtacccgtaacccgtaacccggtaaccggacccgtaccgtacccggttacccgttaccccgtccg

SEQ ID NO: 326347 - DNA, 680 bp, Homo sapiens
  misc_feature: GZ8MTXP02JJ0B3.22.38.D05.1.454.CMB.2.raw
  modified_base (285)..(285): a, c, t, g, unknown or other
  misc_feature (285)..(285): n is a, c, g, or t
  modified_base (313)..(313): a, c, t, g, unknown or other
  misc_feature (313)..(313): n is a, c, g, or t
  modified_base (330)..(330): a, c, t, g, unknown or other
  misc_feature (330)..(330): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtacgaaacccacacacgaccctcacgctgacctgcctaccttctctgggttctcactcaactctagtggagtgggtgtggctggtccgtcacgccccgaggaacgcctggagtggtnctattattagtggatgacgtacgctacngtcatctctgaggaganactcacatacccaaccgaacgaaccaaacccccaaaacgtaggtacgtacctacaactacgaaccacacgtacgacccgtgtacgaaccacacgccaatattacttcgtgtcacctactacgtactaagtacggacacctacggtagtactacgtacgtaacccgtaacgttccgggtaacccggtaccccgggtaccgggggtacccccgggtaaccgttccgggtaaccccgtacccgttcccgttacccgtacccgacccgtaccccgttaacccgaacccccgggtaaaccggggtcccccttaacggtttcccccggggtttacccccttcccccggtcccgggg

SEQ ID NO: 326348 - DNA, 678 bp, Homo sapiens
  misc_feature: GZ8MTXP02F31B2.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtagaaacccacacacgaccctcacgctgacctgcaccttctctgggttctcactcaactctagtggagtgggtgtgggctggtccgtcacgccccaggaacgccctggaatgggtgctacttattagttggtatggtacgttaccgctacgagtccatctctgaggaggagactcacactccaaccgaacggaccaaacccccaaaaaccgacggtacgtacctaacaactacgacccaccacgtacggtaccctgacgaacacaacgcccaataacttactttacgtgtacgaccacgtactactaagagtacgacctacgttaggtacgtacgtcgaaaccgtaacgttccgggtacccgtacccccggggtacgggggtacccccggtaacccggtcgggtacccgtacccgttccgtttccccgaccgtacccgccccgtaacccgaaacccggaaaccggggtccccctaacggtttccccggttcccctcccccggttcccggg

SEQ ID NO: 326349 - DNA, 638 bp, Homo sapiens
  misc_feature: GZ8MTXP02FZQ74.22.38.D05.1.454.CMB.2.raw
  modified_base (315)..(315): a, c, t, g, unknown or other
  misc_feature (315)..(315): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagccccgaggaaacggccctggaatgggtgctacttattatgggatgacgttaccgctanagtccatctctgaggaggagactcaccatacccaccaacggaccaaacccccaaaaacgacggttacggtccttaacaatcgaacccacatcggaccctgtcggaacacgacgacccactaatactttctagtcgacactacttactaagtagacgctaacgtcggttacgtctagaccctaaacgttccggttaccgacccccggttcgggggaccccggtaacccgttcgggtaccctacccggttctacccgttacacccgaccctaacccgaacccgaacgggtcccctaagttcccggtacccttcccccggtccggg

SEQ ID NO: 326350 - DNA, 729 bp, Homo sapiens
  misc_feature: GZ8MTXP02GEHXJ.22.38.D05.1.454.CMB.2.raw
  modified_base (522)..(522): a, c, t, g, unknown or other
  misc_feature (522)..(522): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtacgaaacccacacacgaccctcacgctgacctgcctaccttctcgtggttcctcactacaactctaggtggaggtgggtggtgggtcgttcggttccgtcgaccgaccccgaggaaacgcccgtaggtaagtgggtcgactactttagttagttggggatggtaccggttaccgtactacgtacgtcctattctcgtaggtaggaggtacgtacctacaacctatacccccgaaaccgaaaccggaaaccccaaaacccccgaaaaccggtacggttaacgttacccttaacaacgtcgaaacccaccgtacgccgtaccgtgtacggacacacgacactattacttcgcgtnacactactacgtaagtacggacgacgtaccggttagtacgtccgtacgaccggtaaaccgttcggtacccccgggtacccggtcccgggggtaccccgtaacccggttcggtaccccgtacccgtccgttcccgaccgcccggttacccaacccgtaacccggaacggtcccccgtaacgttcccggtaccccgtttccccggcccg

SEQ ID NO: 326351 - DNA, 671 bp, Homo sapiens
  misc_feature: GZ8MTXP02H87R9.22.38.D05.1.454.CMB.2.raw
  modified_base (354)..(354): a, c, t, g, unknown or other
  misc_feature (354)..(354): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtcgaaacccacacagaccctcacgctgacctgcaccttctctggttctcactcaactctagtggagtgggtgtgggtctggttccgtcacgcccccaggaacggccctggaagtgggttgctactttatttagttgggtatggtacggttaccgctacagtccatctctgaggagagactacacancccaacaacgaccaaacccccaaaacacggtcgtacctacaatcgaccaccagtcgaccctgtacgacacgacgccaacagttatttcgtagtcgacctaactaccttacgtaagtacggacgtcctaacccggttggttaacgtccgttacggacccgtaaacgttccgggttacccgtacccccgggtaccgggggacccccggaaacccggtttcgggaccctacccggtcctacccgtacgtacccgacccctaacccgaacccgtaaaccggggtccctaaccggtttcccggtccctttccccccggccgg

SEQ ID NO: 326352 - DNA, 649 bp, Homo sapiens
  misc_feature: GZ8MTXP02HY64D.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtcgaaacccacaccacgaccctcacgctgacctgcaccttctctgggttctcactcaactctagtggaggtgggtggtggcgtcggtccgtcgacgcccccaaggaacggccctaggaagtgggttgcactttattagtggatggacgttaccgtcacagtcatctctgaggagtagactcacactaccaaccgaaacggaaccaaaccccaaaactcggtacgtaccttacgaatacgaacctacactaccggacctgtacaacaacgactcccactattactttcctagtacactaactacgtacctagtagagtactaccgtgggtactcacggtaccgtaaacgttccggttacccggacccccggtcgggggtacccccgtaaccggtcggtacccacccggtccttcccggaacccaccgtacccgaaccgaaccggtacccgtcccgtaccgtccccgttcccgttaccccgcg

SEQ ID NO: 326353 - DNA, 586 bp, Homo sapiens
  misc_feature: GZ8MTXP02GDI7G.22.38.D05.1.454.CMB.2.raw
tcagacatacgcgtcacgaccggtgctcgatttagtatctgatagttgggtttgggggaggaactgctcagttaggacccagagggaaccatggaagccccagctcagcttctcttcctcctgctactctggctcccagataccaccggagaaattgtgttgacacagtctccagccaccctgtctttgtctccggggaaagagccaccctctcctgcagggccagtcagaatgttagtagttacttagcctggtaccagcaaagctggccaggctcccagactcctcatctctgatacatccaacagggccatggcatcccagccaggttcagtggcagtcggtctgggacagtacttcactctcaccgatcagcgacctagacgcctagaagtatttgcttagtttattactgtctagcgaagcgtagctagtctcgggcctacccgtactaccgtttggacccgtacggggaaccaacggtcccgtacgggaagtacgttaaccgaaaacgtaacgttcgttacgggacttcggaaccgtaaccgtaacttccgttcggttcctttaccttactttacccccg

SEQ ID NO: 326354 - DNA, 685 bp, Homo sapiens
  misc_feature: GZ8MTXP02HQY6L.22.38.D05.1.454.CMB.2.raw
  modified_base (337)..(337): a, c, t, g, unknown or other
  misc_feature (337)..(337): n is a, c, g, or t
  modified_base (373)..(373): a, c, t, g, unknown or other
  misc_feature (373)..(373): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgccaccttctctgggttctcactcaactctagtggagtgggtgtgggctggttccgtcacgccccgaggaacggccctggaactgggtgctactttattagttggatggacgttaccgctacagtccatctcgtgaggngagactcacactccacaacgaaccaaccccaaaacncggtagtccttaacatacgacccacaagtcgaaccctgtacgacacgacgacctaactatttacttcttgcgactactaccttgttaacgacgggtacacctaccgtaggtacgtcgtaccgtaaaccgtaaaccggttccggttaaccccgggtaccccgggtcccgggggtacccccggtaacccggttccggtccccgtaaccccggttccgtccccttaccgaccccggttaccctaaacccggaaacccggtaaccggggtccccctaacgtttcccccggttccccgtttaccccggtccccgggg

SEQ ID NO: 326355 - DNA, 615 bp, Homo sapiens
  misc_feature: GZ8MTXP02HKN29.22.38.D05.1.454.CMB.2.raw
  modified_base (279)..(279): a, c, t, g, unknown or other
  misc_feature (279)..(279): n is a, c, g, or t
  modified_base (289)..(289): a, c, t, g, unknown or other
  misc_feature (289)..(289): n is a, c, g, or t
  modified_base (303)..(303): a, c, t, g, unknown or other
  misc_feature (303)..(303): n is a, c, g, or t
  modified_base (320)..(320): a, c, t, g, unknown or other
  misc_feature (320)..(320): n is a, c, g, or t
  modified_base (352)..(352): a, c, t, g, unknown or other
  misc_feature (352)..(352): n is a, c, g, or t
  modified_base (446)..(446): a, c, t, g, unknown or other
  misc_feature (446)..(446): n is a, c, g, or t
  modified_base (464)..(464): a, c, t, g, unknown or other
  misc_feature (464)..(464): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtacgaaacccacacagaccctcacgctgacctgctaccttctctgggttctcactcaactctagtggaggtgggtggtggtcgtggttccgtcacgccccgaggaacgccnggtatgggtnctattattagtggngtacgacggttcgctancgtccatctcgtaggaggagagacctcactanacccaaccgaacgaacccaaaccccaaacgacgtcgtcctacaactacaccacgtagcgacctgcgacacacgaccatattacttacgtgtacncaactctactagacggcncgtaccgtgtacgcgtagacctaacggttcggtacccgtacccgggtccggggtaccccggaccgttcggtaccacccgttccacccgtccgtaccgcccctaaccgaccggaaaccggcccgtacctcccggttcccctccccggtccgg

SEQ ID NO: 326356 - DNA, 694 bp, Homo sapiens
  misc_feature: GZ8MTXP02JW7OB.22.38.D05.1.454.CMB.2.raw
  modified_base (290)..(290): a, c, t, g, unknown or other
  misc_feature (290)..(290): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtcgaaacccacacacgaccctcacgctgacctgcaccttctctgggttctcactcaactctagtggagtgggtgtggtctggttccgtcacgccccgaggaacggcccgtaggaagtgggtnctattatttagtggatcggtacggttaccgctacacgtccatctcgtggaggagagactacaccatacccaccgaacgacccaacccccaaacgtacggtacgtaccttaacaacgttccgaccaccagtaccgacccttggacgaaccacgaacgaccctaatactttacttcgtagtcacctactacgttacgtaagtacggacaccgtaccggtggtaccgttcgtacgtaacctaaccggttccgggttacccccggacccccgggtaccgggggtacccccggtaaccgttccgggacccgttacccggtccttacccgcccgtaccggtacccctaacccgaacccgggaaccgggtccctaaccggttcccggttcccccgttaccccgtcccgggg

SEQ ID NO: 326357 - DNA, 717 bp, Homo sapiens
  misc_feature: GZ8MTXP02HE5BM.22.38.D05.1.454.CMB.2.raw
  modified_base (285)..(285): a, c, t, g, unknown or other
  misc_feature (285)..(285): n is a, c, g, or t
  modified_base (322)..(322): a, c, t, g, unknown or other
  misc_feature (322)..(322): n is a, c, g, or t
  modified_base (652)..(652): a, c, t, g, unknown or other
  misc_feature (652)..(652): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtagaaacccacacagaccctcacgctgacctgctaccttctctggttctcactcaactctagtggagtgggtgtggctcggtccgtcacgccccgaggaacggcctggaagtgggtnctactttatttagtggtataggtacggtaccgctacncgtaccatcgtgtaggaggaggacgactcaaccactaccccaaccgaacggaaaccccaaacccccgtaaaacgacggttacgtaccgtaactaaacgtaccgaacccaaccgtacgtaccgggtaccctaggtacgaacccaacacgaccctaaactatttacgtttctggtacacctaacctaacttacgttaaggaacggtcgtaacctaccgggtttagggtaccttacgtacgtaaacctaaacggttccgggtttacccggaacccgggtcccgggggtaccccgtaaccgttcggtacccgtacccggttcctcccgtaaccnccgtacccctaacccggaaaccggtaccggaccctacggttcccggttcccctttccccggccgg

SEQ ID NO: 326358 - DNA, 572 bp, Homo sapiens
  misc_feature: GZ8MTXP02G4W8T.22.38.D05.1.454.CMB.2.raw
  modified_base (218)..(218): a, c, t, g, unknown or other
  misc_feature (218)..(218): n is a, c, g, or t
  modified_base (252)..(252): a, c, t, g, unknown or other
  misc_feature (252)..(252): n is a, c, g, or t
  modified_base (269)..(269): a, c, t, g, unknown or other
  misc_feature (269)..(269): n is a, c, g, or t
  modified_base (277)..(277): a, c, t, g, unknown or other
  misc_feature (277)..(277): n is a, c, g, or t
  modified_base (305)..(305): a, c, t, g, unknown or other
  misc_feature (305)..(305): n is a, c, g, or t
  modified_base (309)..(309): a, c, t, g, unknown or other
  misc_feature (309)..(309): n is a, c, g, or t
  modified_base (456)..(456): a, c, t, g, unknown or other
  misc_feature (456)..(456): n is a, c, g, or t
  modified_base (535)..(535): a, c, t, g, unknown or other
  misc_feature (535)..(535): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtcgaaacccacacacgaccctcacgctgacctgctaccttctctggttcncactcaactctagtggagtgggtgtggctggtcncacgcccaggaacgccnggatggtnctattattagtggatggacgtcgctacntacntctgtaggagaggcactcacactaccaaccgaacgacccaaacccaaacgcggtacgtacctaacactacgaacccacacgtcggaccctgtacgacccacgacgaccctaatatttacgttctgcacactacctagtagacgtacnctacgtatacgtctaccgactaacgtccggtaccgacccggcgggtaccgaccgtcgaccgcgtcctcgacctcacccnccgaaacgccggcctacgtcccgtccgtcccgcccgg

SEQ ID NO: 326359 - DNA, 737 bp, Homo sapiens
  misc_feature: GZ8MTXP02I256D.22.38.D05.1.454.CMB.2.raw
  modified_base (310)..(310): a, c, t, g, unknown or other
  misc_feature (310)..(310): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgctaccttctctgggttctcactcaactctagtggagtgggtgtgggctggtccgtcacgccccgaggaacggccctggaagtgggttgctacttattatggatgacgtacntacagtcatctcagaggagagactcacatcccaaccaacggaaccaaacccccgaaaacgtacggtacgtaccttaaacaacgtacgaacccaccaacgcgggtaccccagttacggaaccacccaacggcccaataactttactttacgtggttacacgaacctacttaccgtaaaggtaacggtacgacgtaacccgtttacgggtacttacccggtagtacccccgttaaaacgggtttcccgggttaccccggaacccccggtttacccggggggaaccccccggggttaaccccgttaccgggtaccccggtaaccccggttcccttaaccccgtcccgtaaccggcccctaaccccggaaacccggtaaacgggtccccctaacggtttccccggttccccttttaccccccggtcccggg

SEQ ID NO: 326360 - DNA, 712 bp, Homo sapiens
  misc_feature: GZ8MTXP02FO73R.22.38.D05.1.454.CMB.2.raw
  modified_base (661)..(661): a, c, t, g, unknown or other
  misc_feature (661)..(661): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtagaaacccacacacgaccctcacgctgacctgcaccttctctggttctcactcaactctagtggagtggtgtggctggttcctcgacgcccgaggaacgcccgtggagtgggtgctacttattagtggatcggtacgtaccgactacacgtccacttcgtcgtagggtaggaggacgtacctaccgaacctactaccccgaaaccgaaaccgaaacccaaaccccccgaaaaaccgtacgggttacgttccttaaacaaacgtacgaaacccctaaccgaacgttaccggaccctacggtacggaaccaacgacgaccctaacgttaactacttttccgtagtccgtacctacgtaaccttaccaaggttaacgggatacccgtacggttaggttacgtccgtacgaacccgtaacgttccgggttaacccggccccgggttaccgggggaccccggtacccgtggtacccgtaccggttcctccgtaaccnccgtacccgtaaccgacgaaccggccctacggtcccgtcctccccggtcgg

SEQ ID NO: 326361 - DNA, 625 bp, Homo sapiens
  misc_feature: GZ8MTXP02GNN36.22.38.D05.1.454.CMB.2.raw
  modified_base (233)..(233): a, c, t, g, unknown or other
  misc_feature (233)..(233): n is a, c, g, or t
  modified_base (241)..(241): a, c, t, g, unknown or other
  misc_feature (241)..(241): n is a, c, g, or t
  modified_base (299)..(299): a, c, t, g, unknown or other
  misc_feature (299)..(299): n is a, c, g, or t
  modified_base (342)..(342): a, c, t, g, unknown or other
  misc_feature (342)..(342): n is a, c, g, or t
  modified_base (461)..(461): a, c, t, g, unknown or other
  misc_feature (461)..(461): n is a, c, g, or t
  modified_base (496)..(496): a, c, t, g, unknown or other
  misc_feature (496)..(496): n is a, c, g, or t
  modified_base (577)..(577): a, c, t, g, unknown or other
  misc_feature (577)..(577): n is a, c, g, or t
tcagacatacgcgtcacgaccggtgctcgatttagtatctgatagttgggtttggggagtgaatcctgtgccccaccatggacacactttgctccacgctcctgctgctgaccatcccttcatgggtcttgtcccagatcaccctgaaggagtctggtcctacgctggtacgaaacccacacacgaccctcacgctcgacctgcctaccttctcgtggttctcactacaactntaggtggnggtgggtgtggtcgttggttccgtcacgaccccgaaggaacggccgtaggagtgggtntctattattagtggtagtagtaccgttaccgctacacgtcctntcgtcgtaggaggaggacgacctacaccgtactaccccgaaaccgaaccgaacccaaacccccgaaaacgtacggtacgtacctaacaacacgaccacacgcgacctgacgacacgacncaatattacttctgtcactactactactagagacnctacggtgtacgtctacgaccgtaacggtcggtaccccggtccgggtaccggggacccgtacgtcgtccctaccgtctccncgaccgacctaaccgacgaccggtcaccggtccctcccgtcccgccgg

SEQ ID NO: 326362 - DNA, 695 bp, Homo sapiens
  misc_feature: GZ8MTXP02HAEEH.22.38.D05.1.454.CMB.2.raw
  modified_base (150)..(150): a, c, t, g, unknown or other
  misc_feature (150)..(150): n is a, c, g, or t
  modified_base (394)..(394): a, c, t, g, unknown or other
  misc_feature (394)..(394): n is a, c, g, or t
  modified_base (429)..(429): a, c, t, g, unknown or other
  misc_feature (429)..(429): n is a, c, g, or t
  modified_base (499)..(499): a, c, t, g, unknown or other
  misc_feature (499)..(499): n is a, c, g, or t
  modified_base (504)..(504): a, c, t, g, unknown or other
  misc_feature (504)..(504): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcacctgaaggngtctggtcctacgctggtacgaaacccacacacgaccctcacgctcgacctgcctaccttctcgtggttctcactacaacttcgtaggtgggtaggttgggtggtgggtcttcggttccgtcgacgaccccgagggaaacggtcccgtaggtaacgtgggtcgacgtactttagtttagtgggatcggtaccggttacgactacacgtacctagtctcgtaggaggtaggacgactacacctanaccccaaccgaaccgaacccaaaccccgaaaacgnggttacgtacctacaacgtaccgacctaccagtcgacccttgacgacacgacgtcccaatatttacgttnacgtnactactaatccgtagaacggtctaccacgttagtaacgtcaccgtaaccgtaacgtccggtacccgggaacccggtccgggggtacccgtaaccggttcggacccttacccggccgttccgtaccaccggttacccaaccgaacccgtaaccgggccccttacgtcccccggttccctccccggtaaccgg

SEQ ID NO: 326363 - DNA, 649 bp, Homo sapiens
  misc_feature: GZ8MTXP02H9JKW.22.38.D05.1.454.CMB.2.raw
  modified_base (287)..(287): a, c, t, g, unknown or other
  misc_feature (287)..(287): n is a, c, g, or t
  modified_base (350)..(350): a, c, t, g, unknown or other
  misc_feature (350)..(350): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcacctgaaggagtctggtcctacgctggtacgaaaacccacacacgaccctcacgctgacctgcctaccttctcgtgggttctcactcaactcgtagtggagtgggtgtgggcttggtccgcacgacccaaggaacgccaggatggtnctacttattagtggtatgacggtacgctacagtcatctcgtaggaggagacgactaccactanacccaaaccgaaaacggaacccaaaacccccgaaaaaacgtcggttacggttaccttaaacaaacgtacgaaccaacctagacgacccgtagacggaacaaccacgaccctaataactttactttcgagtacacaacctactacgtaagtacggatacgtaccgtagtacgtacacgaacctaaacgtccggttacccgaccccggtacggggaccccgaaccgttcggaactcccgtacctcctaccaacgccctaaccgaccgaaacggccctaacgtcccgtcccttacccggccg

SEQ ID NO: 326364 - DNA, 691 bp, Homo sapiens
  misc_feature: GZ8MTXP02FXRU8.22.38.D05.1.454.CMB.2.raw
  modified_base (220)..(220): a, c, t, g, unknown or other
  misc_feature (220)..(220): n is a, c, g, or t
  modified_base (343)..(343): a, c, t, g, unknown or other
  misc_feature (343)..(343): n is a, c, g, or t
  modified_base (484)..(484): a, c, t, g, unknown or other
  misc_feature (484)..(484): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtccagatcaccctgaaggagtctggtcctacgctggtacgaaacccacacagaccctcacgctgacctgcctaccttctcgttggttcncactcaactgtagtggaggtgggtgtgggtcttggttccgtcgacgccccgaaggaacggcctaggagtgggtcactactttagttagtgggtagtggtacggtaccgctacgtcgcctatcncgtggaaggaggacgtacacaccactaccccaaccgaacgaaccccaaaccccctaaaacgacggtacgtacctaacaacgtaccgaccactacgtcggaccctgaacgaccaacgtaacgaccctaatattacgtttacnggttaccacacttaccgtacctaagtaccgggatacctaccggtggttaacgccgttacgaacccgtaacggtttccgggacccgtaccccggggccggggacccccggggtacacggggttcccacccggtcctacccgtcgaacctccccgaacccgaaccggaacccgggtccctcgggtccccgttcccgtacccccgtcggg

SEQ ID NO: 326365 - DNA, 742 bp, Homo sapiens
  misc_feature: GZ8MTXP02HMS92.22.38.D05.1.454.CMB.2.raw
  modified_base (659)..(659): a, c, t, g, unknown or other
  misc_feature (659)..(659): n is a, c, g, or t
  modified_base (670)..(670): a, c, t, g, unknown or other
  misc_feature (670)..(670): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaaacccacacagaccctcacgctgacctgcaccttctctgggttctcactcaactctagtggaggtgggtgtgggtcttcggtccgtcacgcccccgaaggaacggccctggaatgggttgctacttatttagtggatgacggttaccgctacacgtccatctctagaggaggagacctacaccactacccaaaccgaaacggaacccaaacccccctaaaaaaaacgcggttacgggttacccttaaactaaattacggaaacccccaacccgtaacgtacggtaacccccttagggtaccggaaaccgaaccctacgggacccctaaaacttatttaaacctttttcgaacgggttccgtaccaaacctaaccggtacctttacgaaagggttaccgactaccgtagttacgtaccgttacggaacctaaacgtcggtttacccgaccccgggttacggggacccccggtaaccggttcgtaaccncccggttaccncctaccgaccgacccgtaaccgaaccggaacccggtcccgtaccggttcccgttcccccgttaccccggccg

SEQ ID NO: 326366 - DNA, 697 bp, Homo sapiens
  misc_feature: GZ8MTXP02JYBIR.22.38.D05.1.454.CMB.2.raw
  modified_base (422)..(422): a, c, t, g, unknown or other
  misc_feature (422)..(422): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtggctggttccgtcacgccccgaggaacgccctggaactggtcgctacttattagtggatggacgtacgctacagtcatctctgaggagagactacaccatccccaaccaacggacccaaacccccgaaaacgcggtcgtacctaacaactacaccaccagtcggacctgtacgacacgacncccaacattacttcgtacgtagccaactactcgtaacgtagggactaccgtacggttacgtacgtaccgtacgtacccgtaaacggttcccgggtttaaaccccggacccccgggttcgggggaaccccccggtaaaccgttccggggtacccctaccccggtcccgttccctaccgaccccgggttaccctaacccccggtaaccccggaaaaccgggggtaccccctaccggttccccccgggtttaccccgttaccccccggtcccccgggg

SEQ ID NO: 326367 - DNA, 800 bp, Homo sapiens
  misc_feature: GZ8MTXP02I8EKA.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtagaaacccacacagaccctcacgctgacctgcaccttctctggttctcactcaactctagtggagtgggtgtgggctggtccgtcacgccccgaggaacggccctaggaagtgggtgctacttagtttacgtggtatcggtacggttaccgctacacgtccatctgtaggaggaggacgacctaccaaccgtactacccaacccgaaacggaaccccaaaacccccgaaaaaccgtacggttacgggtacccttaaacgaaacttaccggaacccctaaccgtacgtacccgggacccttggtacggaacccaccgaacgaccctaaacttacttaccttttaccgaggttacgaccctaaacctaccgttaccttaaaggtacgggtaacgtaccctacccgttagggtacgtaccgtaacgtaccccgtaaacggttccgggtttaaccccggacccccggggtaccgggggtacccccggggtaaccccgttccggggtaaccccgtaaccccggttccctacccggtaaccctacccgttaccccgtaacccccgaaaaccccggtacccgggtacccccttaacccggtttcccccgtttacccccgttaccccccggtccccggg

SEQ ID NO: 326368 - DNA, 791 bp, Homo sapiens
  misc_feature: GZ8MTXP02JBIAG.22.38.D05.1.454.CMB.2.raw
  modified_base (314)..(314): a, c, t, g, unknown or other
  misc_feature (314)..(314): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcacctgaaggagtctggtcctacgctggtacgaaacccacacagaccctcacgctgacctgcctaccttctcgttggttctcactcgaactcgtagtggtaggtgggtggtgggtcgttcgggttcccgtcgaccggaccccgaagggaaacggtcccgtaggaagttcgggttnaccgtactttagtttagttagggacttgggtaccggttaccgtacgtacctacgttacctattccgtacgtagggaggacggtaacgtacctaccaacctactaaccccgaacccgaaacgaaccccaaaacccccctaaaaacgacggttacgtaccttaacgaacctacgaccctaccagtaccgtacctggtacgacccgacacgacacgtattattcgtgtacacactactacgtataacgggactaccgtaacggttggtaacttccgacgtaaacccgttaaacggttccccggggttaacccggtacccccggggtcggggggtaaaccccccgtaaaccgttcgggtaacccccgtacccggtttaccctcccgttaccccgacccgtttccccgtaaccccggaacccggtaaaccggggtccccgtaacgtttcccccgggttcccccgtaccccgttcccccgggg

SEQ ID NO: 326369 - DNA, 784 bp, Homo sapiens
  misc_feature: GZ8MTXP02GY3WV.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcattgggtcttgtcccagatcaccctgaaggagtctggtcctacgctggtacgaaacccacacacgaccctcaccgctgacctgcctaccttctcgttgggttctcactcaactctagtggagtgggtgtgggcttggtccgtcaccgaccccgaggaacggcccgtaggaacgtgggttcgactaacgtttatttaggttggtaagtcggtaaccggttaccggtaccttaacgacgttcctaacgtcttacgtagggaggaacggacgtactaccaaccactaccccaaacccgaaacgaaccccaaaacccccgaaaaaccgtacgggttacgtacccttaaacaaacgttaccgaaacccgaaccacgtaccggtaacccgtaggtacgaacccaaccgacctaaccaaccgttaatttacgttttccgaggttacaccctaacttaaccggttactaaggttaacggacgtaccctaccgggttagggtaaccttcgacggtaaaccctaacggttacccggtacccggtaccccgggtaccggggcccccgggttaaacctcggggtaacccctcccggttcgtacccctaacgtcccgcccctaaccgacccggtaaccggcccgttaacgtccccggttacccttcccccgggccg

SEQ ID NO: 326370 - DNA, 754 bp, Homo sapiens
  misc_feature: GZ8MTXP02ICMBJ.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtacgaaacccacacacgaccctcacgctgacctgcctaccttctcgttgggttctctactcaactcgtaggtggaggtgggtggtgggtcgttcggtccgtcgaccgcccccgaagggaacggccccgtaggtaacgtgggttgacccttagtttaagtttagttggggtaagttacggtaccggttacccgtacctaccgtacggtaccctaagttctccgttagggaaggaggacgacctaccaaccataaccccacccgaaaacgaaccccaaacccccaaaaaacgtaggttccggtaccttaaacgaaactaccgaacccaacctacgtacgacccgtagtacggaaccacgaacaccctaacctaatttacgtttcgtacgttacacctaacaaccttaccgttaaaggttacggaacgtacgtaacccgttaggggtactacgttacgaacccgtaaacggtccggtccccgtaaaccccgggcccggggtaccccgggtacccgtcgggtaccctacccgtccttaccgcctcgccctaaccgacgtaacccgccacgttccgccctttccgccccgg

SEQ ID NO: 326371 - DNA, 688 bp, Homo sapiens
  misc_feature: GZ8MTXP02J02R2.22.38.D05.1.454.CMB.2.raw
  modified_base (486)..(486): a, c, t, g, unknown or other
  misc_feature (486)..(486): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtacgaaacccacacacgaccctcacgctcgacctgccaccttctcgttggttctcactcaactcgtagtggagtgggtggtggtctcggttccgtcgacgccccgaggaacggcccgtaggaagtgggtgctacttattagtggtatggtacggtaccgctacgagtccatctcgtggaggaggagtactacgaccaactacccaaccgaacgaacccaaaacccccgtaaaacgacggttacgtacctaactaacgtaccgaccaacgacgtcgacccgtacgacgaccacaacgacctaatatacttacgtgtacnctactactaatagtacggctacgacgtcgtagtacctcgtaaaccgtaaccgttccgggttaacccggaccccgggtacccgggggtacccccgggaaaccggtttccggaaaccggttcccgttacccttcccgaccgacctaccccgaacccgaaccggacccggtacctaaccggtcccgttccccgtcccgtccccgg

SEQ ID NO: 326372 - DNA, 706 bp, Homo sapiens
  misc_feature: GZ8MTXP02F10RX.22.38.D05.1.454.CMB.2.raw
  modified_base (323)..(323): a, c, t, g, unknown or other
  misc_feature (323)..(323): n is a, c, g, or t
  modified_base (331)..(331): a, c, t, g, unknown or other
  misc_feature (331)..(331): n is a, c, g, or t
  modified_base (341)..(341): a, c, t, g, unknown or other
  misc_feature (341)..(341): n is a, c, g, or t
  modified_base (344)..(344): a, c, t, g, unknown or other
  misc_feature (344)..(344): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtccagatcaccctgaaggagtctggtcctacgctggtagaaacccacacacgaccctcacgctgacctgctaccttctctgggttctcactcaactctagtggagtgggtgtgggctggtccgtcacgccccaggaaacggcccgtggaagtgggttgctacttattagtggtatggacggttaccgctacngtcatctntgaggagganacncaccatcccaaccaacggaaccaaacccccaaaacgacggtacgtccttacaactcgacccaccacgtacgtaccctagtcgaaccacacgacccaacgtattactttacgacgttcacctaaacctacttaccgttaaacgtaacgggtacaccgtaaccggttaggggttacttccgtacgtaacccgtaaaacggttccggttaccccggaccccgggtacccgggggtacccccgggtaacccgtttccggggtacccctaacccggttccctacccgttccgaaccgttaccccctaacccgaccccggaaaccggggtcccctacggtcccggttaccccttccccccggtccggg

SEQ ID NO: 326373 - DNA, 636 bp, Homo sapiens
  misc_feature: GZ8MTXP02F1654.22.38.D05.1.454.CMB.2.raw
  modified_base (369)..(369): a, c, t, g, unknown or other
  misc_feature (369)..(369): n is a, c, g, or t
  modified_base (486)..(486): a, c, t, g, unknown or other
  misc_feature (486)..(486): n is a, c, g, or t
  modified_base (602)..(602): a, c, t, g, unknown or other
  misc_feature (602)..(602): n is a, c, g, or t
  modified_base (608)..(608): a, c, t, g, unknown or other
  misc_feature (608)..(608): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtacgaaacccacacacgaccctcacgctgacctgccaccttctcgttggttctcactcaactctaggtggtaggtgggtggtgggtcgttcgggttccgtcgacggaccccgaagggaaacggcccgtaggaagttgggttgctactttattagtggatggtacgtaccgctactgtcctatctgtggaggaggacgtacncacactacccaacgaaccgaaccaaacccccaaaacgcggtacgtacctaacaacgtacgaacccacacgtacgaccctaggacgaccacgacaccctatacgttacttcgtacgtnaaccacgtacttaacgtaagtacggtacgaccgttaccggtaggtaacctcgtacgtaaccgtacgttcggtacccgcccggtcgggacccgtacgtcgtaccctacgtcacgtcncgtccncgacgacgcctacgtccgtccctcgccg

SEQ ID NO: 326374 - DNA, 742 bp, Homo sapiens
  misc_feature: GZ8MTXP02FRH3K.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtacgaaacccacacacgaccctcacgctcgacctgcctaccttctcgtggttctcactcaactcgtagtggagtcggtgtggctggtccgtcacgcccaggaacgcctggaagtgggtgctacttattagtggatgtacggttacgctacagtccatctcgtggaggaggacgactacaaccataccccaaccgaaaccggaacccaaacccccgaaaaacgtacggttaccggttacctaacaaacgtacgaaccccgaacctaacgtccgggaccctggtacggaacccaaccggaacgaaccccctaaattaaactttacgttttaccgtacggttacgaaccctaaccgttaaaccttccgtaaagttacggggtaacaccgtaacccggttggtaaacgtcgtaccgaaacccgttaaacggttccggttacccggaccccgggtccgggggaaccccgtaacccgtcggtacccgtacccgtccgtacccgtaccgaccgttaccccgaacccgaacccggaaacggtccccgtacgttccccggttccccgtttccccgtcccgggg

SEQ ID NO: 326375 - DNA, 734 bp, Homo sapiens
  misc_feature: GZ8MTXP02FPIWW.22.38.D05.1.454.CMB.2.raw
  modified_base (327)..(327): a, c, t, g, unknown or other
  misc_feature (327)..(327): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcacctgaaggagtctggtcctacgctggtcgaaacccacacacgaccctcacgctgacctgctaccttctctggttctcactcaactctagtggtagtgggtgtgggctggttccgtcacgaccccgaggaaacgcccgtaggaagtgggtgactactttattagttggatcgacggttaccgctacngtccatctacgtgaggaggacgactacaccagtaccccaaacccgaaacggaaccccaaaaccccccgaaaaaccgtacgggtacggttaccttaacgaaactacggaaccctaaccgacgttcgggaacccttacgggtacggaaccaacgacgaccctaagtattactttcgtagtcgacctaacctaacttacctaaagtacggaacgacccgtaaccggttaggtacgttaccgtacggaacccttaaaacggttccgggttacccggacccccgggtacgggggacccccgggtaaacccgtccgggtaccctacccggttcctcccgtacgaccgtaccccgtaacccgaaacccggtaaccggtccctaacggttccccgttacccgtcccccgtccggg

SEQ ID NO: 326376 - DNA, 687 bp, Homo sapiens
  misc_feature: GZ8MTXP02H6J56.22.38.D05.1.454.CMB.2.raw
  modified_base (150)..(150): a, c, t, g, unknown or other
  misc_feature (150)..(150): n is a, c, g, or t
  modified_base (223)..(223): a, c, t, g, unknown or other
  misc_feature (223)..(223): n is a, c, g, or t
  modified_base (311)..(311): a, c, t, g, unknown or other
  misc_feature (311)..(311): n is a, c, g, or t
  modified_base (476)..(476): a, c, t, g, unknown or other
  misc_feature (476)..(476): n is a, c, g, or t
  modified_base (522)..(522): a, c, t, g, unknown or other
  misc_feature (522)..(522): n is a, c, g, or t
  modified_base (536)..(536): a, c, t, g, unknown or other
  misc_feature (536)..(536): n is a, c, g, or t
tcagacatacgcgtcacgaccggtgctcgatttagtatctgatagttgggtttggggagtgactcctgtgccccaccatggacacactttgctccacgctcctgctgctgaccatcccttcatggtcttgtcccagatcaccctgaaggngtctggtcctacgctggtacgaaacccacacacgaccctcacgctgacctgcctaccttcgtcttgggttccncactacaacgttcgtaggtggaggtgggtggtgggtcttcgggttccacgaccgaccccgaagggaaccgcccgtaggtaagtgggtncctatttagttagttggattggacggttacgctaacgacgtcctatcgtcgtaggagggagtacgactccgaacactacccgaaccgaaacgaaaccccaaaaccccgaaaacgtgggttaccgtaccttaacgaactacccgaacctacctacgacgtacccgngtacggaactacacgacccatattacttcgagtcactaactacctnttaagacggtaacnccctagtagtcgtacgacaaccggtaacgtccggtaccccgtacccggggtaccggggaccccgtaccgtcggtaccctccggtaccttacccgacaaccgcccctaaccgcccgaaacggtccctacgtccccgttaccctcccgcccgg

SEQ ID NO: 326377 - DNA, 638 bp, Homo sapiens
  misc_feature: GZ8MTXP02HV0K4.22.38.D05.1.454.CMB.2.raw
  modified_base (316)..(316): a, c, t, g, unknown or other
  misc_feature (316)..(316): n is a, c, g, or t
  modified_base (376)..(376): a, c, t, g, unknown or other
  misc_feature (376)..(376): n is a, c, g, or t
  modified_base (388)..(388): a, c, t, g, unknown or other
  misc_feature (388)..(388): n is a, c, g, or t
  modified_base (435)..(435): a, c, t, g, unknown or other
  misc_feature (435)..(435): n is a, c, g, or t
  modified_base (438)..(438): a, c, t, g, unknown or other
  misc_feature (438)..(438): n is a, c, g, or t
  modified_base (458)..(458): a, c, t, g, unknown or other
  misc_feature (458)..(458): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagccccccaggaaacggccctggaatggggtgcacttatttattgggatgacggttaccgntacacgtccatctctgaggaggagactcgaccatcccaccaagaccaacccccaaaaacnggtcgtccttanaatcgaccacatcgacccctgtcggacacgagacccatattatttcngtncaacactactactaaggganccaccgtggtaacgtcgtcgaaccgaaacttcggggttaccgaaccccccgttgggggaccccccgggtaaacccgttcggtacccgtaacccggttcctaccccgttcgaaccggcccttaaccccgaaccgaaacggggtcccctaacggtcccgggttcccctttacccccgccggg

SEQ ID NO: 326378 - DNA, 617 bp, Homo sapiens
  misc_feature: GZ8MTXP02FO1NJ.22.38.D05.1.454.CMB.2.raw
  modified_base (288)..(288): a, c, t, g, unknown or other
  misc_feature (288)..(288): n is a, c, g, or t
  modified_base (341)..(341): a, c, t, g, unknown or other
  misc_feature (341)..(341): n is a, c, g, or t
  modified_base (346)..(346): a, c, t, g, unknown or other
  misc_feature (346)..(346): n is a, c, g, or t
  modified_base (463)..(463): a, c, t, g, unknown or other
  misc_feature (463)..(463): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtacgaaacccacacacgaccctcaccgctgacctgctaccttctcgtggttctcactcaactctagtggagtgggtgtggctggtccgtcacgaccccgaggaacgcctaggagtgggtnctacttattagtggagtgtaccgtacgctacagtccatctcgtagaggaggancgtanaccatacccaaccgaacgaaccaaacccccaaaacgcggtacgtacctacaatacgaccacagtcgtaccgtgtacgacctacacgacctagtactatttccgtgcgacactacttntaagttacggctaccgtacggtagtacgtctacgtaccgtaaacggttcgtacccggcccggtaccggggacccgtaccgtcgtacctaccggtcctcctacgccctaccgtcccgaaccggaccgtacctcggtccccgtcctccccgtccgg

SEQ ID NO: 326379 - DNA, 613 bp, Homo sapiens
  misc_feature: GZ8MTXP02I0RDA.22.38.D05.1.454.CMB.2.raw
  modified_base (207)..(207): a, c, t, g, unknown or other
  misc_feature (207)..(207): n is a, c, g, or t
  modified_base (364)..(364): a, c, t, g, unknown or other
  misc_feature (364)..(364): n is a, c, g, or t
  modified_base (444)..(444): a, c, t, g, unknown or other
  misc_feature (444)..(444): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttcnctgggttctcactcaactctagtggagtgggtgtgggctggttccgtcagcccccaggaaaggccctggaatgggtgcactattatgggatgacgtacgctacagtccatctctgacggagagactcacatccaccaagaccaaccccctaaaaacngtcggtcctacaatcgaccaccatgaccctgtggacacagcctacataacttctgtcactacgaactctaaatacggganccctaaccgtggtaacgtcttacggaccctaaaacgttcggttaccgaccccggacgggggtacccccggtaaacccgtcgggttaccaaaccggttcccttccgacaccggcccttaaccgaccgaaacgggttccccaagttcccggtaccctttccccgtcccggg

SEQ ID NO: 326380 - DNA, 816 bp, Homo sapiens
  misc_feature: GZ8MTXP02FZQPO.22.38.D05.1.454.CMB.2.raw
  modified_base (296)..(296): a, c, t, g, unknown or other
  misc_feature (296)..(296): n is a, c, g, or t
  modified_base (362)..(362): a, c, t, g, unknown or other
  misc_feature (362)..(362): n is a, c, g, or t
  modified_base (368)..(368): a, c, t, g, unknown or other
  misc_feature (368)..(368): n is a, c, g, or t
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtagaaacccacacacgaccctcacgctgacctgcctaccttctctggttctcactcaactctagtggaggtgggtggtgggcgtcggttccgtcgacgccccgaggaaacgtccgtggaagtgggtcnctactttattaggttcggagtcgtacggttaccgctacgacgtccatctctaggaggagacgaccncaaccnctaccccacgaacgaacccaaaccccaaaacgcggtacgtccgtaacactacaacctacgacgtacgtacccgtgtacgacaacacgtaccaacttagttcttacggttataccgactaactaccgttactaaagtacggggtactacccgttacccgttagggtaacccgtttacgtaccggtacccccgttaaaacggttccccgggggttttaacccccggggaaccccccgggggtaccccggggggtttaaaaccccccgggggtaacccccgtttacccgggggttaaaccccgttacccccgggtttacccttaccccgttacccgtaaaccccggtttaccccccgaaaccccggttaaacccccggaaacccggggtaccccccgttaacccggtttttaccccggtcccccccggtttttaacccccggtccccgggg

SEQ ID NO: 326381 - DNA, 647 bp, Homo sapiens
  misc_feature: GZ8MTXP02FQ812.22.38.D05.1.454.CMB.2.raw
tcagacatacgcgtcacgaccggtgctcgatttagtatctgatagttgggtttggggagtgactcctgtgccccaccatggacacactttgctccacgctcctgctgctgaccatcccttcatgggtcttgtcccagatcaccctgaaggagtctggtcctacgctggtgaaacccacacagaccctcacgctgacctgcaccttctctgggttctcactcaactctagtggagtgggtgtgggctggttccgtcagccccaggaaaggccctggaatgggtgcacttattagttgggatgacggttaccgctacagtccatctctggaggaggagactcaccatccaccaaggaaccaacccccaaaaaccacggttacggtccttaacgaactacgaaccaccaactcgggaccctagtacggacacgacgacccatacttaatttcgtgtacgacacctactacgtaagtacggacgtactaccggttggtaacgtcgtacgaccgtaaacgttccggttccgaccccggtcgggggaccccggtacccgttacgggtcctaaccggtcctcccgtaccgccgtacccaacccgtaacccgaacggggtacccctacgttcccggtccctttccccggtccggg

SEQ ID NO: 326382 - DNA, 694 bp, Homo sapiens
  misc_feature: GZ8MTXP02JHOBZ.22.38.D05.1.454.CMB.2.raw
  modified_base (248)..(248): a, c, t, g, unknown or other
  misc_feature (248)..(248): n is a, c, g, or t
  modified_base (276)..(276): a, c, t, g, unknown or other
  misc_feature (276)..(276): n is a, c, g, or t
  modified_base (338)..(338): a, c, t, g, unknown or other
  misc_feature (338)..(338): n is a, c, g, or t
tcagacatacgcgtcacgaccggtgctcgatttagtatctgatagttgggtttggggagtgactcctgtgccccaccatggacacactttgctccacgctcctgctgctgaccatcccttcattgggtcttgtcccagatcaccctgaaggagtctggtcctacgctgggtacaaaaccccacaccacgaccctcaccgctacgaccctgcctaccttctcgttggttcctccactctaactcgtagngggtagtgggtgtgggcttggttcccgngaccgaccccgaggaaacgccagaagtcggtacactacttatttagtggtatcgtacggtcncgtactctacgactctagtaggaggaggtactactcaccacgtaccccaaaccgaaccggaaccccaaacccccgtaaaacgtacgggttacgtacccttaacaacgtaccggaccccaacgacgtaccggtacccgtagggtacaccgacgtacacctaacgtattccgttcgtacgacgtacaacgtacttacgtaagtacggactcgtaacggtcggtctacgtacgtaccgtaacgtttccggacccgaccggtcgggggaacccgttcgtccgtacccaccgttcctaccgtccgaccgtccgtaaccgaccgtaaccggtcccacgtttcccgtccccgttcccgcccgg

SEQ ID NO: 326383 - DNA, 585 bp, Homo sapiens
  misc_feature: GZ8MTXP01APUEO.10.65.F10.1.454.CMB.2.raw
  modified_base (195)..(195): a, c, t, g, unknown or other
  misc_feature (195)..(195): n is a, c, g, or t
  modified_base (217)..(217): a, c, t, g, unknown or other
  misc_feature (217)..(217): n is a, c, g, or t
  modified_base (227)..(227): a, c, t, g, unknown or other
  misc_feature (227)..(227): n is a, c, g, or t
  modified_base (265)..(265): a, c, t, g, unknown or other
  misc_feature (265)..(265): n is a, c, g, or t
  modified_base (287)..(287): a, c, t, g, unknown or other
  misc_feature (287)..(287): n is a, c, g, or t
tcagcatagtagtgcacgaccggtgctcgatttagctacgctctaagggggcaggagtcagtctcagtcaggacacagcatggacatgagggtccccgctcagctcctggggctcctgctactctggctccgaggtgccagatgtgacatccagatgacccagtcctccaccgtccctgtctgctatttgtgganacagatcacatctcttgccganaagtcagacnttgacactattgaattgatacaacaaaacgtgggaacncccctacactacctgatcaatncagcgtctagtttacaggtacgtcgggtccctagaaggttccagtggcagtgaatcgtggactagtactttactctacactatcagcgtatcgtgactacgtcctagtacgtatttcgacttacttactacgtgtactaacgtacgttaccgtttcccggtaacccgtttagtttaccgggacgggtaacgggaacctaggggtcgaagaacgttacgaaaaccggttacgtggtacgggttcttcggacctaaaccttcgttccgttcgttccttactaaccgtttcccgtaacccg

SEQ ID NO: 326384 - DNA, 643 bp, Homo sapiens
  misc_feature: GZ8MTXP01CZOQP.10.65.F10.1.454.CMB.2.raw
  modified_base (219)..(219): a, c, t, g, unknown or other
  misc_feature (219)..(219): n is a, c, g, or t
  modified_base (275)..(275): a, c, t, g, unknown or other
  misc_feature (275)..(275): n is a, c, g, or t
tcagcatagtagtgcacgaccggtgctcgatttagctacgctctaaggggggcaggagtcagtctcagtcaggacacagcatggacatgagggtccccgctcagctcctggggctcctgctactctggctccgaggtgccagatgtgacatccagatgacccagtctccaccgtccctgtctgctatttgtggagacagagtcaccatctcttgccganaagtcagaaacattgacactattgaattggatacaaacaaaaacgtaggggaaacncccctaacactcctagaatcaaatgacaagcgtacctaagtttacaggtacggtcgggggtccccctagtaaaggttccaaggtggcaaggtggaaattcgtggggtaacaggtaaactttactactaccaaccatccaaggccgtaattcagcaacgcctagtacgtatttagtacgtacttaacttaactacgttactaaacgaacgtacggtttacccggtaaccccgttaccgtttacggtacgggtaacgggaaccgtaaacgggtagggaaggaagttaactaaacgaaacgtaacggttggttacggttcgactaacccaaagtaaccgtttcgttacttacctaaccgttcccgttcccg

SEQ ID NO: 326385 - DNA, 546 bp, Homo sapiens
  misc_feature: GZ8MTXP02HLZ3S.10.65.F10.1.454.CMB.2.raw
  modified_base (194)..(194): a, c, t, g, unknown or other
  misc_feature (194)..(194): n is a, c, g, or t
  modified_base (218)..(218): a, c, t, g, unknown or other
  misc_feature (218)..(218): n is a, c, g, or t
  modified_base (229)..(229): a, c, t, g, unknown or other
  misc_feature (229)..(229): n is a, c, g, or t
  modified_base (234)..(234): a, c, t, g, unknown or other
  misc_feature (234)..(234): n is a, c, g, or t
  modified_base (264)..(264): a, c, t, g, unknown or other
  misc_feature (264)..(264): n is a, c, g, or t
  modified_base (271)..(271): a, c, t, g, unknown or other
  misc_feature (271)..(271): n is a, c, g, or t
  modified_base (325)..(325): a, c, t, g, unknown or other
  misc_feature (325)..(325): n is a, c, g, or t
tcagcatagtagtgcacgaccggtgctcgatttagctacgctctaagggggcaggagtcagtctcagtcaggacacagcatggacatgagggtccccgctcagctcctggggctcctgctactctggctccgaggtgccagatgtgacatccagatgacccagtctccaccgtccctgtctgctatttgtgganacagagtcaccatctctgccgganaagtcagaacntgacnctattgatgtatacaacaaaactgggaaancccctanactcctgatcaatgacaacgtcagttacagagtcgggccctactagtcacgtgnagtgatcgtgggctacgtacttacgtctactacatcagcgtatcacgcacgctagacgtatttcgacgactttactactgtactaactacgtacgtttacccgtaccgttaccgttcgggacggtacgggaaccgaggtacggagaacgttaccgaaacgtaaccgtagtcgggacttcgaccaaccgtaatcgttacgtacttctactccttcccgtacc

SEQ ID NO: 326386 - DNA, 511 bp, Homo sapiens
  misc_feature: GZ8MTXP01CBN0R.10.17.B06.1.454.CMB.2.raw
  modified_base (195)..(195): a, c, t, g, unknown or other
  misc_feature (195)..(195): n is a, c, g, or t
  modified_base (483)..(483): a, c, t, g, unknown or other
  misc_feature (483)..(483): n is a, c, g, or t
tcagcatagtagtgcacgaccggtgctcgatttagtcgatagtgaaggggaggaactgctcagttaggacccagacggaaccatggaagccccagcgcagcttctcttcctcctgctactctggctcccagataccactggagaagtagtgatgacgcagtctccggccaccctgtctgtgtctccaggggaaangtcaccctctcctgcagggccagtcagactattagacaaacttggcctggtaccagcataaacctggccaggctcccaggctcctcatccatggtgcatcctccagggcccactaatatcccagccaggttcagtggcagtgggtcggggtcagagttcactctcaccatcagcagcctgcagtctgaagtatttgctagtttatactgtcagcaggtatgatacctgcctccgtactacgtttcggccgggggtaccaaggctaagggaaattcaaagcgaaactgnggcttgcacaatctgttcttcaacttcc

SEQ ID NO: 326387 - DNA, 533 bp, Homo sapiens
  misc_feature: GZ8MTXP01CJBW1.10.17.B06.1.454.CMB.2.raw
  modified_base (271)..(271): a, c, t, g, unknown or other
  misc_feature (271)..(271): n is a, c, g, or t
  modified_base (292)..(292): a, c, t, g, unknown or other
  misc_feature (292)..(292): n is a, c, g, or t
tcagcatagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaagagtcaccctctcctgcagggccagtcagactattagacaaacttggcctggtaccagcataaacctggccaggcncccaggctcctcatccatggngcatccctccaggggcccactaatatcccagccaggttcagtggcaggtgggtcggggtcagagttcactctcacatcagcagcctgcagtctgaagtattttgctagtttattactgttcagcagggtatgtactaccgtggccctccgtactacgtttcggccggggacctaaggctaagggaaattcgaaagcgaaacgtgttcggcttgccacgaattctgttctcttaacttcccg

SEQ ID NO: 326388 - DNA, 508 bp, Homo sapiens
  misc_feature: GZ8MTXP01D16AV.10.17.B06.1.454.CMB.2.raw
  modified_base (195)..(195): a, c, t, g, unknown or other
  misc_feature (195)..(195): n is a, c, g, or t
  modified_base (502)..(502): a, c, t, g, unknown or other
  misc_feature (502)..(502): n is a, c, g, or t
tcagcatagtagtgcacgaccggtgctcgatttagtcgatagtgaaggggaggaactgctcagttaggacccagacggaaccatggaagccccagcgcagcttctcttcctcctgctactctggctcccagataccactggagaagtagtgatgacgcagtctccggccaccctgtctgtgtctccaggggaaangtcaccctctcctgcagggccagtcagactattagtacaaacttggcctggtaccagcataaacctggccaggctcccaggctcctcatccatggtgcatcctccagggccactaatatcccagccaggttcagtggcagtgggtcggggtcagagttcactctcaccatcagcagcctgcagtctgaagtattttgctagtttattactgtcagcaggtatgatacctggcctcgtactacttttggccggggtacagctaaggaaattcaagcgaactgttaggcttgcaccaatctgttcttcntttccc

SEQ ID NO: 326389 - DNA, 505 bp, Homo sapiens
  misc_feature: GZ8MTXP01CY3SG.10.17.B06.1.454.CMB.2.raw
  modified_base (195)..(195): a, c, t, g, unknown or other
  misc_feature (195)..(195): n is a, c, g, or t
  modified_base (268)..(268): a, c, t, g, unknown or other
  misc_feature (268)..(268): n is a, c, g, or t
  modified_base (499)..(499): a, c, t, g, unknown or other
  misc_feature (499)..(499): n is a, c, g, or t
tcagcatagtagtgcacgaccggtgctcgatttagtcgatagtgaaggggaggaactgctcagttaggacccagacggaaccatggaagccccagcgcagcttctcttcctcctgctactctggctcccagataccactggagaagtagtgatgacgcagtctccggccaccctgtctgtgtctccaggggaaangtcaccctctcctgcagggccagtcagactattagacaaacttggcctggtaccagcataacctggccaggcnccaggctcctcatccatggtgcatcctcagggccactaatatcccagccaggttcagtggcagtggggtcgggtcagagttcactctcaccatcagcagccctgcagtctgaagtatttgactagtttatactgtcagtcaggtatgtataccgtgcctcgtactacgtttcgggccggggacagctggaaattcaagcgtaactgttcgcttgcaccaatctgttcttcnttcccg

SEQ ID NO: 326390 - DNA, 508 bp, Homo sapiens
  misc_feature: GZ8MTXP01DAODP.10.17.B06.1.454.CMB.2.raw
  modified_base (472)..(472): a, c, t, g, unknown or other
  misc_feature (472)..(472): n is a, c, g, or t
  modified_base (482)..(482): a, c, t, g, unknown or other
  misc_feature (482)..(482): n is a, c, g, or t
  modified_base (494)..(494): a, c, t, g, unknown or other
  misc_feature (494)..(494): n is a, c, g, or t
  modified_base (498)..(498): a, c, t, g, unknown or other
  misc_feature (498)..(498): n is a, c, g, or t
  modified_base (504)..(504): a, c, t, g, unknown or other
  misc_feature (504)..(504): n is a, c, g, or t
tcagcatagtagtgcacgaccggtgctcgatttagtcgatagtgaaggggaggaactgctcagttaggacccagacggaaccatggaagccccagcgcagcttctcttcctcctgctactctggctcccagataccactggagaagtagtgatgacgcagtctccggccaccctgtctgtgtctccaggggaaagagtcaccctctcctgcagggccagtcagactattagtacaaacttggcctggtaccagcataaacctggccaggctcccaggctcctcatccatggtgcatcctccaggggccactaatactcccagccaggttcagtggctaggtggggtcggggtcagagttcactctcaccatcagcagccctgcagtctagaagtatttgctagtttatactgtcagcaggtatgatacgtgccctcgtactacgtttcgggccggggtacagctaagaattnagcgaactgnggcttgcacgtntctnttctcnctcc

SEQ ID NO: 326391 - DNA, 518 bp, Homo sapiens
  misc_feature: GZ8MTXP01EEX7T.10.17.B06.1.454.CMB.2.raw
  modified_base (195)..(195): a, c, t, g, unknown or other
  misc_feature (195)..(195): n is a, c, g, or t
  modified_base (259)..(259): a, c, t, g, unknown or other
  misc_feature (259)..(259): n is a, c, g, or t
  modified_base (266)..(266): a, c, t, g, unknown or other
  misc_feature (266)..(266): n is a, c, g, or t
  modified_base (284)..(284): a, c, t, g, unknown or other
  misc_feature (284)..(284): n is a, c, g, or t
tcagcatagtagtgcacgaccggtgctcgatttagtcgatagtgaaggggaggaactgctcagttaggacccagacggaaccatggaagccccagcgcagcttctcttcctcctgctactctggctcccagataccactggagaagtagtgatgacgcagtctccggccaccctgtctgtgtctccaggggaaanagtcaccctctcctgcagggccagtcagactattagtacaaacttggcctgtaccagcataacngcaggcnccagctctcatccatgtncatcctccagggccactaatactcccagcctaggttcagtggctaggtggggtcgggtcagtagttcactctcaccatcagcagcctgcagtctgaagtatttgtctagtttatatgtcagcagtatgtataccgtggcctccgtactacgtttcggccggggtactaaggtctaaggaaattacgaaacgcgaaactggttaggcttagtcacaattctgttcttcaattccc

SEQ ID NO: 326392 - DNA, 558 bp, Homo sapiens
  misc_feature: GZ8MTXP01D0K6R.10.17.B06.1.454.CMB.2.raw
  modified_base (263)..(263): a, c, t, g, unknown or other
  misc_feature (263)..(263): n is a, c, g, or t
  modified_base (272)..(272): a, c, t, g, unknown or other
  misc_feature (272)..(272): n is a, c, g, or t
  modified_base (294)..(294): a, c, t, g, unknown or other
  misc_feature (294)..(294): n is a, c, g, or t
  modified_base (415)..(415): a, c, t, g, unknown or other
  misc_feature (415)..(415): n is a, c, g, or t
tcagcatagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaagagtcaccctctcctgcagggccagtcagactattagtacaaacttggcctggtaccagcataaaccnggccaggcncccaggctcctcatccatggtncatcctcagggccactaatatcccagccaggttcagtggcaggtggggtcggggtcagtagttcactctcacccatcagcagcctgcagtctgaagtattttagctagtttattactgtanagtctaggtatgtactaccgtcgtcccttcgttacgttacgtttcgggaccggggtactaacggcgtaaggtaaacttacgaaacggacgtaacgtggttcggttcgttacgctactaactctcgttctttcgttcgttcccg

SEQ ID NO: 326393 - DNA, 519 bp, Homo sapiens
  misc_feature: GZ8MTXP01ANZI0.10.17.B06.1.454.CMB.2.raw
  modified_base (195)..(195): a, c, t, g, unknown or other
  misc_feature (195)..(195): n is a, c, g, or t
  modified_base (292)..(292): a, c, t, g, unknown or other
  misc_feature (292)..(292): n is a, c, g, or t
  modified_base (351)..(351): a, c, t, g, unknown or other
  misc_feature (351)..(351): n is a, c, g, or t
  modified_base (489)..(489): a, c, t, g, unknown or other
  misc_feature (489)..(489): n is a, c, g, or t
  modified_base (498)..(498): a, c, t, g, unknown or other
  misc_feature (498)..(498): n is a, c, g, or t
  modified_base (513)..(513): a, c, t, g, unknown or other
  misc_feature (513)..(513): n is a, c, g, or t
tcagcatagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaanagtcacctctcctgcagggccagtcagactattagtacaaacttggcctggtaccagcataaacctggccaggctcccaggctcctcatccatggtncatcctcaggccactaatatcccagccaggttcagtggctaggtggggtcggggtcagngttcactctcacccatcagcagcctgcagtctagaagtattttgactagtttattacgtgtcagtctaggtatgtactacctggccttcgtactacgtttcgggccgggacacgcgtaaggaattcgaagcgtactgnggcttcgcnctaatctgttcttcncttccc

SEQ ID NO: 326394 - DNA, 543 bp, Homo sapiens
  misc_feature: GZ8MTXP01BFD2V.10.17.B06.1.454.CMB.2.raw
  modified_base (196)..(196): a, c, t, g, unknown or other
  misc_feature (196)..(196): n is a, c, g, or t
  modified_base (205)..(205): a, c, t, g, unknown or other
  misc_feature (205)..(205): n is a, c, g, or t
  modified_base (346)..(346): a, c, t, g, unknown or other
  misc_feature (346)..(346): n is a, c, g, or t
  modified_base (349)..(349): a, c, t, g, unknown or other
  misc_feature (349)..(349): n is a, c, g, or t
  modified_base (385)..(385): a, c, t, g, unknown or other
  misc_feature (385)..(385): n is a, c, g, or t
  modified_base (523)..(523): a, c, t, g, unknown or other
  misc_feature (523)..(523): n is a, c, g, or t
tcagcatagtagtgcacgaccggtgctcgatttagtcgatagtgaaggggaggaactgctcagttaggacccagacggaaccatggaagccccagcgcatcttctcttcctcctgctactctggctcccagataccactggagaagtagtgatgacgcagtctccggccaccctgtctgtgtctccgaaggggaangtcaccctntcctgcagggccagtcagactattagtacaaacttggcctggtaccagcataaacctggccaggctcccaggctcctcatccatgtgcatcctccagggccactaatatcccagccaggttcagtggcaggtgggtcgggnagngttcactctcacatcagcagcctgcagtctgaagtntttgcttagtttatctgtcagtcagttatggtaactaccgtggtcctcgtacttacggtttcgggccgggggacctaaggtcgtaagggaacttcgaaacgcgtaaacgtgttcgggcttcggcacgtaacgttcgtnttacctcttaacgtttcccc

SEQ ID NO: 326395 - DNA, 529 bp, Homo sapiens
  misc_feature: GZ8MTXP01CIW9F.10.17.B06.1.454.CMB.2.raw
  modified_base (207)..(207): a, c, t, g, unknown or other
  misc_feature (207)..(207): n is a, c, g, or t
  modified_base (414)..(414): a, c, t, g, unknown or other
  misc_feature (414)..(414): n is a, c, g, or t
tcagcatagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccgaggggaaagagtcaccctntcctgcagggccagtcagactattagacaaattggcctggtaccagcataaacctggccaggctcccaggctcctcatccatggtgcatcctccagggccaactaatatccccagccaggttcagtggcacggtggggtcggggtcagtagttcactctcaccatcagcagcctgcagtctagaagtatttgacttagttattactntacagcaggtatgactacctgtcctccgtactacgtttcggccggggacagcgtaagaaagttgaacgcgtaaactggttggcttcggcacaatctgttccttcgaactttcccg

SEQ ID NO: 326396 - DNA, 532 bp, Homo sapiens
  misc_feature: GZ8MTXP01BEPZA.10.17.B06.1.454.CMB.2.raw
  modified_base (196)..(196): a, c, t, g, unknown or other
  misc_feature (196)..(196): n is a, c, g, or t
  modified_base (272)..(272): a, c, t, g, unknown or other
  misc_feature (272)..(272): n is a, c, g, or t
  modified_base (294)..(294): a, c, t, g, unknown or other
  misc_feature (294)..(294): n is a, c, g, or t
tcagcatagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaanagtcaccctctcctgcagggccagtcagactattagtacaaacttggcctggtaccagcataaacctggccaggcncccaggctcctcatccatggtncatccctcagggccactaatactcccagccaggttcagtggcaggtggggtcggggtcagacgttcactctcaccctatcagcagcctgcagtctgaagtatttgactagtttattactgtcagtcaggtatgtactaccgtcgtcccttccgtacgtacgtttcgggcccggggtaccaagctaaggaaattcgaagcgaacgtggaggcttgcacaatctgttcttcaacttcccg

SEQ ID NO: 326397 - DNA, 551 bp, Homo sapiens
  misc_feature: GZ8MTXP01CFET8.10.17.B06.1.454.CMB.2.raw
  modified_base (197)..(197): a, c, t, g, unknown or other
  misc_feature (197)..(197): n is a, c, g, or t
  modified_base (270)..(270): a, c, t, g, unknown or other
  misc_feature (270)..(270): n is a, c, g, or t
  modified_base (289)..(289): a, c, t, g, unknown or other
  misc_feature (289)..(289): n is a, c, g, or t
  modified_base (345)..(345): a, c, t, g, unknown or other
  misc_feature (345)..(345): n is a, c, g, or t
tcagcatagtagtgcacgaccggtgctcgatttagtcgatagtgaaggggaggaactgctcagttaggacccagacggaaccatggaagccccagcgcagcttctcttcctcctgctactctggctcccagataccactggagaagtagtgatgacgcagtctccggccaccctgtctgtgtctccgaaggggaaanagtcaccctctcctgcagggccagtcagactattagtacaaacttggcctggtaccagcataacctgcaggcnccaggctctcatccatgtncatcctcaggccactatactcccagccaggttcaggtggcaggtggggtcggggtnagtagttcactctcaccatcagcagcctgcagtctagaagtattttggacttagtttatactgtcagtctaaggtataggacttaccgtcggtcccttccgtacttaacgtttcggggacccgggggtacctaacggcgtaaggaaattcgaaagttcgtaaacgtggttaggcttgccactaactctcgttcttcgctttccccg

SEQ ID NO: 326398 - DNA, 502 bp, Homo sapiens
  misc_feature: GZ8MTXP01B3JQ1.10.17.B06.1.454.CMB.2.raw
  modified_base (268)..(268): a, c, t, g, unknown or other
  misc_feature (268)..(268): n is a, c, g, or t
  modified_base (343)..(343): a, c, t, g, unknown or other
  misc_feature (343)..(343): n is a, c, g, or t
  modified_base (480)..(480): a, c, t, g, unknown or other
  misc_feature (480)..(480): n is a, c, g, or t
tcagcatagtagtgcacgaccggtgctcgatttagtcgatagtgaaggggaggaactgctcagttaggacccagacggaaccatggaagccccagcgcagcttctcttcctcctgctactctggctcccagataccactggagaagtagtgatgacgcagtctccggccaccctgtctgtgtctccaggggaaagagtcaccctctcctgcagggccagtcagactattagtacaaacttggcctggtaccagcataactggcaggcnccagctctcatccatgtgcatcctccagggccactaatatcccagccaggttcagtggcagtgggtcgggtcagngttcactctcacatcagcagccctgcagtctgaagattttgctagtttattactgtcagcaggtatgatacctggcctcgtactactttggccggggacagctaaggaaattcgaagcgtaaactgttaggcttgcnccaatcctgttcttcaattccc

SEQ ID NO: 326399 - DNA, 661 bp, Homo sapiens
  misc_feature: GZ8MTXP01CJ9WU.10.17.B06.1.454.CMB.2.raw
  modified_base (195)..(195): a, c, t, g, unknown or other
  misc_feature (195)..(195): n is a, c, g, or t
  modified_base (260)..(260): a, c, t, g, unknown or other
  misc_feature (260)..(260): n is a, c, g, or t
  modified_base (639)..(639): a, c, t, g, unknown or other
  misc_feature (639)..(639): n is a, c, g, or t
tcagcatagtagtgcacgaccggtgctcgatttagtcgatagtgaaggggaggaactgctcagttaggacacagacggaaccatggaagccccagcgcagcttctcttcctcctgctactctggctcccagataccactggagaagtagtgatgacgcagtctccggccaccctgtctgtgtctccgaggggaangtccacccctctcctgcgacgggcagtcagacttattacgtaactaacgttcggcctggtaaccngacaactaaaccgtggccaggcctacccgaggtcctccctacactccgtagttgggtcacctacttccccgtaccggaacgggtacccctaaacttaactaccttacccccgaaggtacccgttagggtttaccgagggttcgggaccgtagggggttcggggggtcggggtacaggtaacgttccaaccgttctaccacctatcaggccacgcccgtgacctaggtctaggtaagttagttttcgacttaagtttacttacgtgtactacgtagtagttatgtactccgtcgcccttacgtcgttacggttccggggaccgggtacacgtcgtaaggaactacgacgtacgtacgttggttcgcgtaagcctaacctnttcgttcgttccttaacgtccc

SEQ ID NO: 326400 - DNA, 521 bp, Homo sapiens
  misc_feature: GZ8MTXP01BQ4OV.10.17.B06.1.454.CMB.2.raw
  modified_base (194)..(194): a, c, t, g, unknown or other
  misc_feature (194)..(194): n is a, c, g, or t
  modified_base (280)..(280): a, c, t, g, unknown or other
  misc_feature (280)..(280): n is a, c, g, or t
  modified_base (421)..(421): a, c, t, g, unknown or other
  misc_feature (421)..(421): n is a, c, g, or t
  modified_base (503)..(503): a, c, t, g, unknown or other
  misc_feature (503)..(503): n is a, c, g, or t
tcagcatagtagtgcacgaccggtgctcgatttagtcgatagtgaaggggaggaactgctcagttaggacccagacggaaccatggaagccccagcgcagcttctcttcctcctgctactctggctcccagataccactggagaagtagtgatgacgcagtctccggccaccctgtctgtgtctccaggggaangtcaccctctcctgcagggccagtcagactattagtacaaacttggcctggtaccagcataaacctggccaggctcccaggctccncatccatggtgcatccctcagggccaactaatatccccagccaggttcaggtggcaggtggggtcggggtcaggagttcactctcaccatcagcagccctgcagtctgaagtattttgctagtttatactgtcagcaggtntgataccgtggccttcgtctacgtttgggccgggggtacaaggctaagggaaattcaagcgaacgtgttcggcttggcaccntctgttcttcgcgttccc

SEQ ID NO: 326401 - DNA, 523 bp, Homo sapiens
  misc_feature: GZ8MTXP01CBGU8.10.17.B06.1.454.CMB.2.raw
  modified_base (195)..(195): a, c, t, g, unknown or other
  misc_feature (195)..(195): n is a, c, g, or t
  modified_base (355)..(355): a, c, t, g, unknown or other
  misc_feature (355)..(355): n is a, c, g, or t
  modified_base (372)..(372): a, c, t, g, unknown or other
  misc_feature (372)..(372): n is a, c, g, or t
  modified_base (396)..(396): a, c, t, g, unknown or other
  misc_feature (396)..(396): n is a, c, g, or t
  modified_base (506)..(506): a, c, t, g, unknown or other
  misc_feature (506)..(506): n is a, c, g, or t
  modified_base (517)..(517): a, c, t, g, unknown or other
  misc_feature (517)..(517): n is a, c, g, or t
tcagcatagtagtgcacgaccggtgctcgatttagtcgatagtgaaggggaggaactgctcagttaggacccagacggaaccatggaagccccagcgcagcttctcttcctcctgctactctggctcccagataccactggagaagtagtgatgacgcagtctccggccaccctgtctgtgtctccaggggaaanagtcaccctctcctgcagggccagtcagactattagtacaaacttggcctggtaccagcataaacctggccaggctcccaggctcctcatccatggtgcatccctccgagggcccaactaatactcccagccaggttcagtggcaggtggggtcggggtnagagttcactctcaccntcagcagcctgcagtctagaagtntttgacttagtttacttactgtcagctaggtatgtactacgtggcctcgtactacgttgggcccggggacagcgtaaggaattcgaagcgtaacgtgttggcttgcactntctgttcttcncttccc

SEQ ID NO: 326402 - DNA, 563 bp, Homo sapiens
  misc_feature: GZ8MTXP01D2DYJ.10.17.B06.1.454.CMB.2.raw
  modified_base (196)..(196): a, c, t, g, unknown or other
  misc_feature (196)..(196): n is a, c, g, or t
  modified_base (206)..(206): a, c, t, g, unknown or other
  misc_feature (206)..(206): n is a, c, g, or t
tcagcatagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaanagtcaccctntcctgcagggccagtcagactattagtacaaacttggcctggtaccagcataaacctggccaggctcccaggctcctcatccatggtgcatcctccagggccactaatactcccagccaggttcagtggcagtgggtcggggtcagagttcactctcaccatcagcagccctgcagtctgaagtattttgctagtttattactgtcagcagggtatggtaactaccgtggtccctccgtactacgttttcgggcccgggggtaccaacggtccgtaagggaaacttcgaaagcgtaaacgtggttacgggcttcggccacctaattccgttcgttcctttccgttaacgtttccccg

SEQ ID NO: 326403 - DNA, 514 bp, Homo sapiens
  misc_feature: GZ8MTXP01C5VAE.10.17.B06.1.454.CMB.2.raw
  modified_base (196)..(196): a, c, t, g, unknown or other
  misc_feature (196)..(196): n is a, c, g, or t
  modified_base (271)..(271): a, c, t, g, unknown or other
  misc_feature (271)..(271): n is a, c, g, or t
  modified_base (291)..(291): a, c, t, g, unknown or other
  misc_feature (291)..(291): n is a, c, g, or t
  modified_base (348)..(348): a, c, t, g, unknown or other
  misc_feature (348)..(348): n is a, c, g, or t
  modified_base (497)..(497): a, c, t, g, unknown or other
  misc_feature (497)..(497): n is a, c, g, or t
  modified_base (508)..(508): a, c, t, g, unknown or other
  misc_feature (508)..(508): n is a, c, g, or t
tcagcatagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaanagtcaccctctcctgcagggccagtcagactattagtacaaacttggcctggtaccagcataacctggccaggcnccaggctctcatccatggtncatcctccagggccactaatatcccagccaggttcagtggcaggtggggtcggggtnagagttccactctcaccatcagcagcctgcagtctagaagtattttgctagtttattactgtcagcaggtatgataccgtggtccctcgtactacgtttcgggccggggtacagctaaggaaattcgaagcgaactgttggcttgcacntctgttcttcncttccc

SEQ ID NO: 326404 - DNA, 532 bp, Homo sapiens
  misc_feature: GZ8MTXP01DWC8I.10.17.B06.1.454.CMB.2.raw
  modified_base (196)..(196): a, c, t, g, unknown or other
  misc_feature (196)..(196): n is a, c, g, or t
  modified_base (205)..(205): a, c, t, g, unknown or other
  misc_feature (205)..(205): n is a, c, g, or t
  modified_base (271)..(271): a, c, t, g, unknown or other
  misc_feature (271)..(271): n is a, c, g, or t
  modified_base (282)..(282): a, c, t, g, unknown or other
  misc_feature (282)..(282): n is a, c, g, or t
  modified_base (292)..(292): a, c, t, g, unknown or other
  misc_feature (292)..(292): n is a, c, g, or t
tcagcatagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaangtcaccctntcctgcagggccagtcagactattagtacaaacttggcctggtaccagcataaacctggccaggcnccaggctcctnatccatggtncatcctcagggccaactaatctcccagccaggttcagtggcaggtggggtcgggtcagcgttcacttctcaccatcagcagccctgcagtctgtaagtatttagcttagtttattactgtcagtctaggtatgtatacgtcgtcctccgtactacgtttcgggaccggggtacacgcgtaaggaaacttcgaagcgtaacgtgttcggcttgcactaatctagttcttcgttctttcccg

SEQ ID NO: 326405 - DNA, 569 bp, Homo sapiens
  misc_feature: GZ8MTXP01D96YC.10.17.B06.1.454.CMB.2.raw
  modified_base (198)..(198): a, c, t, g, unknown or other
  misc_feature (198)..(198): n is a, c, g, or t
  modified_base (270)..(270): a, c, t, g, unknown or other
  misc_feature (270)..(270): n is a, c, g, or t
  modified_base (279)..(279): a, c, t, g, unknown or other
  misc_feature (279)..(279): n is a, c, g, or t
  modified_base (290)..(290): a, c, t, g, unknown or other
  misc_feature (290)..(290): n is a, c, g, or t
tcagcatagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccgaaggggaaangtcaccctctcctgcagggccagtcagactattagtacaaacttggcctggtaccagcataactggcaggcnccagctccncatccatggtncatcctcgaggccaactaatactcccagccaggttcaggtggctacggtggggtcgggtcagtgttacactctcaccatcagcacgctgcagtctagtagtattttagcttagtttacttactgtacagtctaggttatgtacttaccgtcggtcccttccgttacttaccggttttcggggcccgggggtaacctaacggcgttaacggtaaacttacgaaaggacgtaaacgtgttggcttcgaactaccaagttctcgttcttcgaacgtttcccg

SEQ ID NO: 326406 - DNA, 525 bp, Homo sapiens
  misc_feature: GZ8MTXP01D1723.10.17.B06.1.454.CMB.2.raw
  modified_base (196)..(196): a, c, t, g, unknown or other
  misc_feature (196)..(196): n is a, c, g, or t
  modified_base (293)..(293): a, c, t, g, unknown or other
  misc_feature (293)..(293): n is a, c, g, or t
  modified_base (357)..(357): a, c, t, g, unknown or other
  misc_feature (357)..(357): n is a, c, g, or t
tcagcatagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaangtcaccctctcctgcagggccagtcagactattagtacaaacttggcctggtaccagcataaacctggccaggctcccaggctcctcatccatggtncatccctccagggcccaactaatactcccagccaggttcagtggcaggtggggtcggggtcagngttcactctcaccatcagcagccctgcagtctgaagtattttgcttagtttattactgtcagcaggtatgatacctggcctcgtactacgtttgggccgggggacagctaaggaaattcgaaagcgaaacgtgttggcttcgcaccaattctgttcttcttcgttccc

SEQ ID NO: 326407 - DNA, 552 bp, Homo sapiens
  misc_feature: GZ8MTXP01A988S.10.17.B06.1.454.CMB.2.raw
  modified_base (195)..(195): a, c, t, g, unknown or other
  misc_feature (195)..(195): n is a, c, g, or t
  modified_base (293)..(293): a, c, t, g, unknown or other
  misc_feature (293)..(293): n is a, c, g, or t
  modified_base (526)..(526): a, c, t, g, unknown or other
  misc_feature (526)..(526): n is a, c, g, or t
tcagcatagtagtgcacgaccggtgctcgatttagtcgatagtgaaggggaggaactgctcagttaggacccagacggaaccatggaagccccagcgcagcttctcttcctcctgctactctggctcccagataccactggagaagtagtgatgacgcagtctccggccaccctgtctgtgtctccaggggaaanagtcaccctctcctgcagggccagtcagactattagtacaaacttggcctggtaccagcataaacctggccaggctcccaggctcctcatccatggtncatcctccaggcccaactaactactccccagcctaggttcaggtggctaggtgggggtcggggtcagtagttcactctcaccatcagcagcctgctagtctagaagtattttgacttagtttattactgtacagctagggtatgactaccgtcggcctccgtacgtacgtttcgggccggggtaccaaggcgtaaggaattcgaagcgtaaacgtggttacgcttcgcaactnttacttcgttcttcgaactttccccg

SEQ ID NO: 326408 - DNA, 530 bp, Homo sapiens
  misc_feature: GZ8MTXP01BGMIJ.10.17.B06.1.454.CMB.2.raw
  modified_base (196)..(196): a, c, t, g, unknown or other
  misc_feature (196)..(196): n is a, c, g, or t
  modified_base (206)..(206): a, c, t, g, unknown or other
  misc_feature (206)..(206): n is a, c, g, or t
  modified_base (351)..(351): a, c, t, g, unknown or other
  misc_feature (351)..(351): n is a, c, g, or t
  modified_base (360)..(360): a, c, t, g, unknown or other
  misc_feature (360)..(360): n is a, c, g, or t
tcagcatagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaanagtcaccctntcctgcagggccagtcagactattagtacaaacttggcctggtaccagcataaacctggccaggctcccaggctcctcatccatgtgcatcctccagggccactaatactcccagccaggttcagtgcaggtgggtcgggtcagngttcactcncaccatcagcagcctgcagtctgtaacgtattttagacttagtttacttagttgtcagtcaggtatgatacgtcgtcctccgtactacgtttcgggccgggggtactaaggcgtaaggaaattcgaagcgaacgtgttcggcttgcactaatctgttcttcaacgttccc

SEQ ID NO: 326409 - DNA, 545 bp, Homo sapiens
  misc_feature: GZ8MTXP01A0AWB.10.17.B06.1.454.CMB.2.raw
  modified_base (197)..(197): a, c, t, g, unknown or other
  misc_feature (197)..(197): n is a, c, g, or t
  modified_base (398)..(398): a, c, t, g, unknown or other
  misc_feature (398)..(398): n is a, c, g, or t
tcagcatagtagtgcacgaccggtgctcgatttagtcgatagtgaagggggaggaactgctcagttaggacccagacggaaccatggaacccccagcgcagcttctcttcctcctgctactctggctcccagataccactggagaagtagtgatgacgcagtctccggccaccctgtctgtgtctccgaggggaaanagtcaccctctcctgcagggccagtcagactattagtacaaacttggcctggtaccagcataaacctggcaggctcccaggctcctcatccatggtgcatcctccagggccactaatactcccagccaggttcagtggcaggtcggggtcggggtcaggtagttcaactctcaccatcagcacgcctgcagtctagaagtntttgactagtttattactgtcagctagtagtgtacttaccgtcggtccttaccgtacgttacgtttcggggacccggggtaccaaggtcgtaggaaactcgaaagcgaacgtggtcgcttggcaacatctgtcttcgtcttcgttcc

SEQ ID NO: 326410 - DNA, 567 bp, Homo sapiens
  misc_feature: GZ8MTXP01C16IB.10.17.B06.1.454.CMB.2.raw
  modified_base (270)..(270): a, c, t, g, unknown or other
  misc_feature (270)..(270): n is a, c, g, or t
tcagcatagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaagagtcaccctctcctgcagggccagtcagactattagacaaacttggcctggtaccagcataacctggccaggcncccaggctcctcatccatggtgcatcctccagggaccactaatactcccagccaggttcagtggcaggtggggtcggggtcagagttcacgtctcaccatcagtcagcctgcagtctagaagtatttgctagtttattactgtacagtactaggttatggtactaccgtcggtccctccgttacgtaccggttttcggggacccgggggtaccaaggcgtaacgggaaattcgaaacgcgtaaacgtggttacgggcttcggccaccgtaactctcgttcttcttaacgtttccccg

SEQ ID NO: 326411 - DNA, 591 bp, Homo sapiens
  misc_feature: GZ8MTXP01D1N5E.10.17.B06.1.454.CMB.2.raw
  modified_base (195)..(195): a, c, t, g, unknown or other
  misc_feature (195)..(195): n is a, c, g, or t
tcagcatagtagtgcacgaccggtgctcgatttagtcgatagtgaaggggaggaactgctcagttaggacccagacggaaccatggaagccccagcgcagcttctcttcctcctgctactctggctcccagataccactggagaagtagtgatgacgcagtctccggccaccctgtctgtgtctccaggggaaanagtcaccctctcctgcagggccagtcagactattagtacaaacttggcctggtaccagcataaacctggccaggctcccgagcctcctcatccatgtgcactccctccgaggccaactaactactccccagccctaggttccaggtggcagggttgggggtcgggggtcaggtacgttcacgttctacgaccatcagcagccctgccagtctagaagttattttgacttagtttattactgttacagtctaggtatgtaactccgtggtccctaccgtacttacggttttcgggacccgggggacctaaggtcgtaagggaaacttcgaaagccgtaaacgtggttacggcgttcgaacctacctaacttcgtcgttcttcgttaacgtttccccg

SEQ ID NO: 326412 - DNA, 720 bp, Homo sapiens
  misc_feature: GZ8MTXP01EREI6.10.17.B06.1.454.CMB.2.raw
  modified_base (272)..(272): a, c, t, g, unknown or other
  misc_feature (272)..(272): n is a, c, g, or t
  modified_base (281)..(281): a, c, t, g, unknown or other
  misc_feature (281)..(281): n is a, c, g, or t
tcagcatagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccgaaggggaagagtcaccctctcctgcagggccagtcagactattagtacaaacttggcctggtaccagcataaacctggccagcnccagctccncatccatggtgcactcctccgagggcccaactaaactactccccagccgtaggttcaggtggccgtaaggtcgggggttcgggggtacaaggtacggtttaccaaccgttcctaccaacccgacttaccgaggtcccaacgtcccgttgacccgtaggttacctagggtaaaagttacgttttttacggaacctttaacgggtttttaaattaaccgttacgggtttaccaagggtaccttaaacggggtttaattacgggtaaaccttaccccgttcggggtaccccttccccggttaaacctttaccgggtttttcgggggacccgggggtaaccctaaaggtcccgtaaagggtaaacttaccgaaaggttaccgtaaacgttcgggttaggcttacggcaccctaagttctcgttccttcttaacgtttcccccg

SEQ ID NO: 326413 - DNA, 556 bp, Homo sapiens
  misc_feature: GZ8MTXP01BB9UR.10.17.B06.1.454.CMB.2.raw
  modified_base (194)..(194): a, c, t, g, unknown or other
  misc_feature (194)..(194): n is a, c, g, or t
  modified_base (204)..(204): a, c, t, g, unknown or other
  misc_feature (204)..(204): n is a, c, g, or t
  modified_base (269)..(269): a, c, t, g, unknown or other
  misc_feature (269)..(269): n is a, c, g, or t
  modified_base (280)..(280): a, c, t, g, unknown or other
  misc_feature (280)..(280): n is a, c, g, or t
  modified_base (290)..(290): a, c, t, g, unknown or other
  misc_feature (290)..(290): n is a, c, g, or t
  modified_base (365)..(365): a, c, t, g, unknown or other
  misc_feature (365)..(365): n is a, c, g, or t
tcagcatagtagtgcacgaccggtgctcgatttagtcgatagtgaaggggaggaactgctcagttaggacccagacggaaccatggaagccccagcgcagcttctcttcctcctgctactctggctcccagataccactggagaagtagtgatgacgcagtctccggccaccctgtctgtgtctccaggggaanagtcaccctntcctgcagggccagtcagactattagtacaaacttggcctggtaccagcataacctggccaggcnccaggctcctnatccatggtncatcctccaggcccataatactcccagccaggttcagtggcaggtgggtcggggtcaggtgttccactctcaccntcagcagtccctgctagtctgtaagtattttagcttagtttattactgttacagtctagtagtagtactaccgtcggtccctccgttactaccgtttcgggacccgggggtaacctaggtcctaagggtaaattaccggaagttcgaaactggttcggcttgccactaatctagttcttcttaacgttccc

SEQ ID NO: 326414 - DNA, 542 bp, Homo sapiens
  misc_feature: GZ8MTXP01CB9QD.10.17.B06.1.454.CMB.2.raw
  modified_base (197)..(197): a, c, t, g, unknown or other
  misc_feature (197)..(197): n is a, c, g, or t
tcagcatagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaagngtcaccctctcctgcagggccagtcagactattagtacaaacttggcctggtaccagcataaacctggccaggctcccaggctcctcatccatggtgcatcctccagggccaactaatactcccagccaggttcagtggcaggtggggtcggggtcagagttcactctcaccatcagcagcctgcagtctgaagtattttgctagtttatactgtcagcaggtatgtactaccgtggtcccttccgtactacggttttcgggcccgggggtaccaaggcgtaagggaaacttcgaaacgcgtaaacgtgttcggcttgcactaatctcgttcttcgctttccccg

SEQ ID NO: 326415 - DNA, 575 bp, Homo sapiens
  misc_feature: GZ8MTXP01BTT8X.10.17.B06.1.454.CMB.2.raw
  modified_base (198)..(198): a, c, t, g, unknown or other
  misc_feature (198)..(198): n is a, c, g, or t
  modified_base (207)..(207): a, c, t, g, unknown or other
  misc_feature (207)..(207): n is a, c, g, or t
  modified_base (295)..(295): a, c, t, g, unknown or other
  misc_feature (295)..(295): n is a, c, g, or t
tcagcatagtagtgcacgaccggtgctcgatttagtcgatagtgaaggggggaggaactgctcagttaggacccagacggaaccatggaagccccagcgcagcttctcttcctcctgctactctggctcccagataccactggagaagtagtgatgacgcagtctccggccaccctgtctgtgtctccgaggggaaangtcaccctntcctgcagggccagtcagactattagtacaaacttggcctggtaccagcataaacctggccaggctcccaggctcctcatccatggtncatccctccgagggccaactaatactccccagcctaggttcaggtggcaggtgggggtcggggtcaggtagttcactctcaccatcagcagcctgcagtctagtaagttatttgacttagtttatactgtcagtctaggtatgtactaccgtcgtcccttccgtactacggtttcgggacccgggggtaacctaaggtcgtaagggaaattacggaaacgttcgtaaacgtggttacggcttacggccactaacttctcgttcctcgttaactttccccg

SEQ ID NO: 326416 - DNA, 518 bp, Homo sapiens
  misc_feature: GZ8MTXP01AYBQS.10.17.B06.1.454.CMB.2.raw
  modified_base (195)..(195): a, c, t, g, unknown or other
  misc_feature (195)..(195): n is a, c, g, or t
  modified_base (205)..(205): a, c, t, g, unknown or other
  misc_feature (205)..(205): n is a, c, g, or t
  modified_base (271)..(271): a, c, t, g, unknown or other
  misc_feature (271)..(271): n is a, c, g, or t
  modified_base (293)..(293): a, c, t, g, unknown or other
  misc_feature (293)..(293): n is a, c, g, or t
  modified_base (354)..(354): a, c, t, g, unknown or other
  misc_feature (354)..(354): n is a, c, g, or t
  modified_base (420)..(420): a, c, t, g, unknown or other
  misc_feature (420)..(420): n is a, c, g, or t
tcagcatagtagtgcacgaccggtgctcgatttagtcgatagtgaaggggaggaactgctcagttaggacccagacggaaccatggaagccccagcgcagcttctcttcctcctgctactctggctcccagataccactggagaagtagtgatgacgcagtctccggccaccctgtctgtgtctccaggggaaanagtcaccctntcctgcagggccagtcagactattagtacaaacttggcctggtaccagcataaacctggccaggcncccaggctcctcatccatggtncatcctcagggccactaatactccccagccaggttcagtggcaggtggggtcggggtcagngttcactctcaccatcagcagccctgcagtctgaagtatttgactagtttatactgtcagcaggtntgatacgtgcctcgtactcgtttcgggccggggtacagctggaaacttcgaagcgaactggttagcttcggcacgtaatctacgttcttcgcttcccg

SEQ ID NO: 326417 - DNA, 589 bp, Homo sapiens
  misc_feature: GZ8MTXP01CFVV9.10.17.B06.1.454.CMB.2.raw
  modified_base (406)..(406): a, c, t, g, unknown or other
  misc_feature (406)..(406): n is a, c, g, or t
tcagcatagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaagagtcaccctctcctgcagggccagtcagactattagtacaaacttggcctggtaccagcataaacctggccaggctcccaggcctcctcatccatggtgcactccctccagggccactaatactccccagccaggttcagtcggctacggtggggtcgggggtcagtagttccacgtctcaacccatcagcagcctgcagtctagaagtnttttgctagtttattactgtcagtcaggttatgacttaccgtggtccccttaccggtacgttccggttttacggggcccgggggtaacctaggccgtaaggaaacgttcgaaaggccgtaaacgttggacggttcttcgggcctacccgtaagttccgttcgttccttccgaactttcccccg

SEQ ID NO: 326418 - DNA, 524 bp, Homo sapiens
  misc_feature: GZ8MTXP01ED2SO.10.17.B06.1.454.CMB.2.raw
  modified_base (195)..(195): a, c, t, g, unknown or other
  misc_feature (195)..(195): n is a, c, g, or t
  modified_base (268)..(268): a, c, t, g, unknown or other
  misc_feature (268)..(268): n is a, c, g, or t
  modified_base (277)..(277): a, c, t, g, unknown or other
  misc_feature (277)..(277): n is a, c, g, or t
  modified_base (287)..(287): a, c, t, g, unknown or other
  misc_feature (287)..(287): n is a, c, g, or t
tcagcatagtagtgcacgaccggtgctcgatttagtcgatagtgaaggggaggaactgctcagttaggacccagacggaaccatggaagccccagcgcagcttctcttcctcctgctactctggctcccagataccactggagaagtagtgatgacgcagtctccggccaccctgtctgtgtctccaggggaaanagtcaccctctcctgcagggccagtcagactattagacaaacttggcctggtaccagcataaacctgccagcnccagctctnatccatggtncatcctcaggccactaatatcccagccaggttcagtggcagtgggtcggttcagtagttcactctcaccatcagcagcctgcagtctgaagtattttgctagtttattactgtcagcaaggttatgtataccgtggcctccgtacgtacgttttcgggccgggggaccaagccttaagggaaaattcaaacgcgtaaacgtcgttggcttgcacaatctgttctttcaatttccccg

SEQ ID NO: 326419 - DNA, 674 bp, Homo sapiens
  misc_feature: GZ8MTXP01DVOOH.10.17.B06.1.454.CMB.2.raw
  modified_base (195)..(195): a, c, t, g, unknown or other
  misc_feature (195)..(195): n is a, c, g, or t
  modified_base (205)..(205): a, c, t, g, unknown or other
  misc_feature (205)..(205): n is a, c, g, or t
  modified_base (433)..(433): a, c, t, g, unknown or other
  misc_feature (433)..(433): n is a, c, g, or t
tcagcatagtagtgcacgaccggtgctcgatttagtcgatagtgaaggggaggaactgctcagttaggacccagacggaaccatggaagccccagcgcagcttctcttcctcctgctactctggctccccagataccactggagaagtagtgatgacgcagtctccggccaccctgtctgtgtctccaggggaanagtcaccctntcctgcagggccagtcagacttatagtacaacttggcctggtaccagcaataacctgccaggctcccaggctccgtacatccatggtcgacctactcccgtaccgacgggcccaacttaactactccccgagccgtaggtttcaggttcgggccgtagggtcggggtcggggttacagtacgttacacgtctacacctatcagcacgcctgactagtcgtagaagttnttttacgacttagtttacttaacgtgtacagtacctagggttatcggtaacttaccgtcgtcccgttccgttacgttaacgggttttcggggacccgggggtaaacctaacgggtcgtaaacggtaaaacgttccggaaacggttacccggtaaacgtttgggaccggtttcgttaccggtaaccaaaccccgttttaacgttccgttaccgtttaccttaaccgttaacccgtttccccg

SEQ ID NO: 326420 - DNA, 557 bp, Homo sapiens
  misc_feature: GZ8MTXP01B8V0W.10.17.B06.1.454.CMB.2.raw
  modified_base (195)..(195): a, c, t, g, unknown or other
  misc_feature (195)..(195): n is a, c, g, or t
  modified_base (267)..(267): a, c, t, g, unknown or other
  misc_feature (267)..(267): n is a, c, g, or t
  modified_base (277)..(277): a, c, t, g, unknown or other
  misc_feature (277)..(277): n is a, c, g, or t
  modified_base (285)..(285): a, c, t, g, unknown or other
  misc_feature (285)..(285): n is a, c, g, or t
  modified_base (364)..(364): a, c, t, g, unknown or other
  misc_feature (364)..(364): n is a, c, g, or t
  modified_base (366)..(366): a, c, t, g, unknown or other
  misc_feature (366)..(366): n is a, c, g, or t
tcagcatagtagtgcacgaccggtgctcgatttagtcgatagtgaaggggaggaactgctcagttaggacccagacggaaccatggaatccccagcgcagcttctcttcctcctgctactctggctcccagataccactggagaagtagtgatgacgcagtctccggccaccctgtctgtgtctccgaggggaangtcaccctctcctgcagggccagtcagactattagtacaaacttggcctggtaccagcataacctgcaggcnccagctcctnatcatgtncatcctcaggccactaatactacccagccagttcagtggcaggtgggtcgggtcagagttacactctcaccatcagcancngcagtctgagtatttgtacttagtttattactgtacagtctaggtatgtactcgtacgtccgtaccgttacgtaccgttttcggggacccgggggtacctaacggtcgtaacgggaaattacgaaacgacggtaaaccgtggttacggcttacgccgacctaagttcctggttcttcgttaactttccccg

SEQ ID NO: 326421 - DNA, 627 bp, Homo sapiens
  misc_feature: GZ8MTXP01ETG93.10.17.B06.1.454.CMB.2.raw
  modified_base (206)..(206): a, c, t, g, unknown or other
  misc_feature (206)..(206): n is a, c, g, or t
  modified_base (271)..(271): a, c, t, g, unknown or other
  misc_feature (271)..(271): n is a, c, g, or t
  modified_base (292)..(292): a, c, t, g, unknown or other
  misc_feature (292)..(292): n is a, c, g, or t
  modified_base (569)..(569): a, c, t, g, unknown or other
  misc_feature (569)..(569): n is a, c, g, or t
tcagcatagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaagagtcaccctcncctgcagggccagtcagactattagtacaaacttggcctggtaccagcataaacctggccaggcncccaggctctcatccatggtncactccctccgacggccaactaactactacccgagtccgtaggttcaggttgggcgtaggggttcgggggtcggggtacaggtacgttaccacttcctaccacctatacgacgcgacgcctgctagtcgtagtaagttattttagcttagtttattactcgtcagctagggtataggtactaccgtcggtcccgttaccgttacgtaccggttttcggggaccgggggtaccaacggtccggtaaggtaaacttacggaaacgttacggtaaacgtnttacggggcttacggcctaccgttaagttcgttcgttacctttcgttaacgttccccg

SEQ ID NO: 326422 - DNA, 583 bp, Homo sapiens
  misc_feature: GZ8MTXP01A9163.10.17.B06.1.454.CMB.2.raw
  modified_base (194)..(194): a, c, t, g, unknown or other
  misc_feature (194)..(194): n is a, c, g, or t
  modified_base (269)..(269): a, c, t, g, unknown or other
  misc_feature (269)..(269): n is a, c, g, or t
  modified_base (427)..(427): a, c, t, g, unknown or other
  misc_feature (427)..(427): n is a, c, g, or t
  modified_base (513)..(513): a, c, t, g, unknown or other
  misc_feature (513)..(513): n is a, c, g, or t
tcagcatagtagtgcacgaccggtgctcgatttagtcgatagtgaaggggaggaactgctcagttaggacccagacggaaccatggaagccccagcgcagcttctcttcctcctgctactctggctcccagataccactggagaagtagtgatgacgcagtctccggccacctgtctgtgtctccgaggggaangtcaccctctcctgcagggccagtcagactattagtacaaacttggcctggtaccagcataaacctggccaggcncccaggctcctcatccatggtgcactccctccgacggggcccaactaatactccccagccctaggtttcaggttgggccagggttcgggggtcgggggtcaggtacggttaccaactccgtacaccactcagccagtccctgctagtcgtagaagttnttttacgcttagtttattactgtcagtctaggttactagtactacgtcggtcctccgtacttacgtttcgggaccggggactacgngtaaggaaattcgacgacgtaacgtgttcgggcttcgctactaacttctcgttaccttcgttcttccccg

SEQ ID NO: 326423 - DNA, 583 bp, Homo sapiens
  misc_feature: GZ8MTXP01BLD1G.10.17.B06.1.454.CMB.2.raw
  modified_base (196)..(196): a, c, t, g, unknown or other
  misc_feature (196)..(196): n is a, c, g, or t
  modified_base (206)..(206): a, c, t, g, unknown or other
  misc_feature (206)..(206): n is a, c, g, or t
  modified_base (368)..(368): a, c, t, g, unknown or other
  misc_feature (368)..(368): n is a, c, g, or t
  modified_base (373)..(373): a, c, t, g, unknown or other
  misc_feature (373)..(373): n is a, c, g, or t
  modified_base (378)..(378): a, c, t, g, unknown or other
  misc_feature (378)..(378): n is a, c, g, or t
tcagcatagtagtgcacgaccggtgctcgatttagtcgatagtgaaggggaggaactgctcagttaggacccagacggaaccatggaagccccagcgcagcttctcttcctcctgctactctggctcccagataccactggagaagtagtgatgacgcagtctccggccaccctgtctgtgtctccgaggggaaanagtcaccctntcctgcagggccagtcagactattagtacaaattggcctggtaccagcataaacctgcaggctccaggctctcatccatgtgcatcctccaggccataatatcccagccagttcagtgcaggtggggtgggtcagtagttcactctcaccatcagcagctgnagtcngaatntttagctagtttatactgtcagtcaggtatgtactacgtaggtccctccgtacgttacgtttcgggacccgggggtaactaacggcgtaagggaaaacttacgtaaacggacggtaaaccgtgggtttacggggccttacgggaaccctaacccgtaaactttcccggttagtttcccgtttaaccgttaacgtttttccccccg

SEQ ID NO: 326424 - DNA, 811 bp, Homo sapiens
  misc_feature: GZ8MTXP01B0Z0Z.10.17.B06.1.454.CMB.2.raw
  modified_base (194)..(194): a, c, t, g, unknown or other
  misc_feature (194)..(194): n is a, c, g, or t
tcagcatagtagtgcacgaccggtgctcgatttagtcgatagtgaaggggaggaactgctcagttaggacccagacggaaccatggaagccccagcgcagcttctcttcctcctgctactctggctcccagataccactggagaagtagtgatgacgcagtcctccggccacctgtctgtgtctcgaggggaanagtccaccctctctgcgagggccagtcagtactattagtaacaacgttggcctggtaccagacaataacctggccaggcctccaggctctcactcagtggtgcactccctccgacggccaactaactactaccccagtaccgtaggttccgaggtcgggcgtacggggttcgggggttcgggggtacgtaacggtacggtttaaccacccttccgtacccaacccgtaattacccgaacgggacctaaccggtcccgtttacgggacccgttaacggtttaccgttaagggttaaacggttttagttttttaacgggtaccgtttttaaagtttttaacgtttacgttacggttaaccgtaaggttaccgttaaggggtttaacgttacggttaaaccgttaccgggttacccggttcccgtttaccccggtttaaccggtttacccggggtttttaccgggggaaaccccggggggtaaaccgtaaacgggttaaccggtaaagggtaaaacctttacgggaaacggttaccggtaaacggttcgggttaacgggttccttacggtaaccctactaacgttccttacgtttccttaaccgttaacgttttcccccg

SEQ ID NO: 326425 - DNA, 656 bp, Homo sapiens
  misc_feature: GZ8MTXP01ELS10.10.17.B06.1.454.CMB.2.raw
  modified_base (196)..(196): a, c, t, g, unknown or other
  misc_feature (196)..(196): n is a, c, g, or t
  modified_base (205)..(205): a, c, t, g, unknown or other
  misc_feature (205)..(205): n is a, c, g, or t
  modified_base (271)..(271): a, c, t, g, unknown or other
  misc_feature (271)..(271): n is a, c, g, or t
  modified_base (292)..(292): a, c, t, g, unknown or other
  misc_feature (292)..(292): n is a, c, g, or t
tcagcatagtagtgcacgaccggtgctcgatttagtcgatagtgaaggggaggaactgctcagttaggacccagacggaaccatggaagccccagcgcagcttctcttcctcctgctactctggctcccagataccactggagaagtagtgatgacgcagtctccggccaccctgtctgtgtctccgaggggaaangtcaccctntcctgcagggccagtcagactattagtacaaacttggcctggtaccagcataaacctggccaggcnccaggctcctcatccatggtncactccctaccgacgggccaactaatactccccagtccgtaggttccaggtggcgtagggttcgggggtacggggtcaggtacgttacaaccttcgtaccacctatcaagcagccctgctagtcgtagtaacgttagttttacgactttaaggtttacttacgttggtactagtacgtaaggttagtagtaacttaccgtcggtcccttaccgttacgttacggttttcggggacccgggggtaactaacggtcgtaacggtaaacttacggaaacggttacggtaaacgttcggttacgggttcttacggtaaccctacctaacgttccgttacggttacctttaaccgttaactttcccccg

SEQ ID NO: 326426 - DNA, 609 bp, Homo sapiens
  misc_feature: GZ8MTXP01BFXYM.10.17.B06.1.454.CMB.2.raw
  modified_base (194)..(194): a, c, t, g, unknown or other
  misc_feature (194)..(194): n is a, c, g, or t
  modified_base (203)..(203): a, c, t, g, unknown or other
  misc_feature (203)..(203): n is a, c, g, or t
  modified_base (268)..(268): a, c, t, g, unknown or other
  misc_feature (268)..(268): n is a, c, g, or t
tcagcatagtagtgcacgaccggtgctcgatttagtcgatagtgaaggggaggaactgctcagttaggacccagacggaaccatggaagccccagcgcagcttctcttcctcctgctactctggctcccagataccactggagaagtagtgatgacgcagtctccggccaccctgtctgtgtctccaggggaangtcaccctntcctgcagggccagtcagactattagtacaaacttggcctggtaccagcataacctggccaggcncccaggctcctcatccatggtgcatccctccgagggcccaactaatactccccagccaggttcagtggcaggtggggtcggggtcaggacgttcactctacaccatcagcagcctagcagtctgtaagtattttgacttagtttattacttgtactagtctagggttatacggtaacttaccgtcggtcccttccggttaccgtaccggttttcgggacccgggggtaacctaacgggtcgtaagggtaaacgttacggaaacgttaccggtaaacgttggttcgggaccttcggcctaaccgtaacttccgttcgttcctttccgttaacgttttccccg

SEQ ID NO: 326427 - DNA, 578 bp, Homo sapiens
  misc_feature: GZ8MTXP01B250K.10.17.B06.1.454.CMB.2.raw
  modified_base (196)..(196): a, c, t, g, unknown or other
  misc_feature (196)..(196): n is a, c, g, or t
  modified_base (272)..(272): a, c, t, g, unknown or other
  misc_feature (272)..(272): n is a, c, g, or t
  modified_base (292)..(292): a, c, t, g, unknown or other
  misc_feature (292)..(292): n is a, c, g, or t
  modified_base (393)..(393): a, c, t, g, unknown or other
  misc_feature (393)..(393): n is a, c, g, or t
tcagcatagtagtgcacgaccggtgctcgatttagtcgatagtgaagggggaggaactgctcagttaggacccagacggaaccatggaagccccagcgcagcttctcttcctcctgctactctggctccagataccactggagaagtagtgatgacgcagtctccggccaccctgtctgtgtctccgaggggaaanagtcaccctctcctgcagggccagtcagactattagtacaaacttggcctggtaccagcataaacctggccaggcnccaggctctcatccatggtncatccctccgagggccaataactactcccagcctaggttcaggtggcgtaggtggggtcgggtcagtacgttcactctcaccatcagcagccctgcagtcngaatatttgcttagtttatacgtgtctagtctagggtatcgtaactacccgttgcccttccgtaacgttaccgttttcggggacccgggggtaacaacgtcgtaagggtaaacttcgaaacgttccgaaagttcggcgttcgttcgaacctaccgtaatcgtcgttcttaacgaacgtttccccg

SEQ ID NO: 326428 - DNA, 624 bp, Homo sapiens
  misc_feature: GZ8MTXP01EWPSU.10.17.B06.1.454.CMB.2.raw
  modified_base (197)..(197): a, c, t, g, unknown or other
  misc_feature (197)..(197): n is a, c, g, or t
  modified_base (206)..(206): a, c, t, g, unknown or other
  misc_feature (206)..(206): n is a, c, g, or t
  modified_base (271)..(271): a, c, t, g, unknown or other
  misc_feature (271)..(271): n is a, c, g, or t
  modified_base (280)..(280): a, c, t, g, unknown or other
  misc_feature (280)..(280): n is a, c, g, or t
  modified_base (291)..(291): a, c, t, g, unknown or other
  misc_feature (291)..(291): n is a, c, g, or t
tcagcatagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccgaaggggaangtcaccctntcctgcagggccagtcagacttatagtacaacttggcctggtaccagcataaacctggccaggcnccaggctcncatccatggtncactcctcgaggccaactaatactcccagccaggttcaggtggctagggtcggggtacggggtcaggtacgttacacgtctcaccatcagcagccctgctagtcgtagaagttattttaggactttaggttttactacgttgtacagtctaaggttataggtacttacccggttgtaccccgttcggttacgttaccggttttcgggggacccgggggtaacctaacggtcgtaaggtaaacttcgaaacggttccgtaaaccgttgggttcgggttcttacggtaacctaaccgtctttcgttcggttacctttccgttaacgtttcccccg

SEQ ID NO: 326429 - DNA, 627 bp, Homo sapiens
  misc_feature: GZ8MTXP01BJZUT.10.17.B06.1.454.CMB.2.raw
  modified_base (196)..(196): a, c, t, g, unknown or other
  misc_feature (196)..(196): n is a, c, g, or t
  modified_base (261)..(261): a, c, t, g, unknown or other
  misc_feature (261)..(261): n is a, c, g, or t
  modified_base (269)..(269): a, c, t, g, unknown or other
  misc_feature (269)..(269): n is a, c, g, or t
  modified_base (277)..(277): a, c, t, g, unknown or other
  misc_feature (277)..(277): n is a, c, g, or t
  modified_base (288)..(288): a, c, t, g, unknown or other
  misc_feature (288)..(288): n is a, c, g, or t
tcagcatagtagtgcacgaccggtgctcgatttagtcgatagtgaaggggaggaactgctcagttaggacccagacggaaccatggaagccccagcgcagcttctcttcctcctgctactctggctcccagataccactggagaagtagtgatgacgcagtctccggccaccctgtctgtgtctccgaggggaaanagtcaccctctcctgcagggccagtcagactattagtacaaacttggcctgtaccagcataaccnggcaggcncaggctcncatccatggtnctactcctccgagggccctaagtaactactcccagccgtaggttcaggtggctaggggtggggtcggggtcaggtacgttcactcgtcaccatcagcagtccctgcgacgtcgtaggtaagttattttggacgtttaagttttacgttacttggttactacggtactaggggttaattacggtaacttacccggttggtccccttccggttaacgttacggttttcgggggacccgggggtaacaacggtcggtaaggtaaacgttccgaaaggttccgtaaacgtcgggttcggttccttcgtccaactcttcgtgttccttcttaacccgtttcccg

SEQ ID NO: 326430 - DNA, 547 bp, Homo sapiens
  misc_feature: GZ8MTXP01AIEIM.10.17.B06.1.454.CMB.2.raw
  modified_base (196)..(196): a, c, t, g, unknown or other
  misc_feature (196)..(196): n is a, c, g, or t
  modified_base (206)..(206): a, c, t, g, unknown or other
  misc_feature (206)..(206): n is a, c, g, or t
  modified_base (272)..(272): a, c, t, g, unknown or other
  misc_feature (272)..(272): n is a, c, g, or t
  modified_base (320)..(320): a, c, t, g, unknown or other
  misc_feature (320)..(320): n is a, c, g, or t
  modified_base (399)..(399): a, c, t, g, unknown or other
  misc_feature (399)..(399): n is a, c, g, or t
tcagcatagtagtgcacgaccggtgctcgatttagtcgatagtgaaggggaggaactgctcagttaggacccagacggaaccatggaagccccagcgcagcttctcttcctcctgctactctggctcccagataccactggagaagtagtgatgacgcagtctccggccaccctgtctgtgtctccgaggggaaanagtcaccctntcctgcagggccagtcagactattagtacaaacttggcctggtaccagcataaacctggccaggcncccaggctcctcatccatggtgcatccctccacgggccaactaatacncccagccaggttcaggtggcacggtggggtcggggtcaggtagttcactctcacatcagcagcctgctagtctgaagtnttttgcttagtttattactgtcagtcaggtatgtactaccgtggcccttccgtacttacggtttcgggcccgggggtaaccaaggcgtaagggaaacttcgaagacgtaacgtggttgcttgccactgtctgttcttcaacttccccg

SEQ ID NO: 326431 - DNA, 665 bp, Homo sapiens
  misc_feature: GZ8MTXP01A9F5H.10.17.B06.1.454.CMB.2.raw
  modified_base (197)..(197): a, c, t, g, unknown or other
  misc_feature (197)..(197): n is a, c, g, or t
  modified_base (273)..(273): a, c, t, g, unknown or other
  misc_feature (273)..(273): n is a, c, g, or t
tcagcatagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccgaggggaaanagtcaccctctcctgcagggccagtcagactattagtacaaacttggcctggtaccagcataaacctggccaggcncccaggctcctcatccatggtgcactccctccgacgggcccactaactactccccagccgtaggttcaggtcggcgtacggtggggtcggggtcagtcgttacacgtctacaccatcagcacgcctgcagtctagtaagtattttaggacttagtttattacgtgtacagtaccgtaggggttacttagtaaccttacccgtacggttccccttaccggttacgttaacccgggtttttcggggggaccccgggggttaaccctaaaggtcccggtaaaggtaaacgttaccggaaacggttaccgtaaacggttcgggttcggggttccttacgggaacctacccgtaacgtttccgttacggttccctttccgttaaccgttttcccccg

SEQ ID NO: 326432 - DNA, 674 bp, Homo sapiens
  misc_feature: GZ8MTXP01AIOZI.10.17.B06.1.454.CMB.2.raw
  modified_base (194)..(194): a, c, t, g, unknown or other
  misc_feature (194)..(194): n is a, c, g, or t
  modified_base (264)..(264): a, c, t, g, unknown or other
  misc_feature (264)..(264): n is a, c, g, or t
  modified_base (352)..(352): a, c, t, g, unknown or other
  misc_feature (352)..(352): n is a, c, g, or t
  modified_base (365)..(365): a, c, t, g, unknown or other
  misc_feature (365)..(365): n is a, c, g, or t
  modified_base (373)..(373): a, c, t, g, unknown or other
  misc_feature (373)..(373): n is a, c, g, or t
tcagcatagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccacctgtctgtgtctcgaggggaancgtcacctctcctgcagggccagtcagtactattagacaacttggctggtaccagcataacctgcaggcnccaggctcctcatccatggtgctactcctccgaggccaactaatactcccaagtccaggttcaggtggcgtacgggtggggtcgggtnagtacgtcacgtntcacctancagtcacgtctgactagttctaggtaattgtttacggactttaacggtttaacttcgtagttcgaggtacttaagggggtaacttacggtaaccgttaacccgttcgggtacccgtttaccccgggtaaacgtttaccggggttttaccgggggaaccccgggggtaaaccgtaacgggtcccgttaaaagggggaaacttaacggaaaccggttacgggttaaacgttcggttccgggttaccttagggaacccctaacggtctttccggttaccgtttacctcgtttaactttcccccg

SEQ ID NO: 326433 - DNA, 593 bp, Homo sapiens
  misc_feature: GZ8MTXP01B8IGH.10.17.B06.1.454.CMB.2.raw
  modified_base (197)..(197): a, c, t, g, unknown or other
  misc_feature (197)..(197): n is a, c, g, or t
  modified_base (260)..(260): a, c, t, g, unknown or other
  misc_feature (260)..(260): n is a, c, g, or t
  modified_base (264)..(264): a, c, t, g, unknown or other
  misc_feature (264)..(264): n is a, c, g, or t
  modified_base (268)..(268): a, c, t, g, unknown or other
  misc_feature (268)..(268): n is a, c, g, or t
  modified_base (349)..(349): a, c, t, g, unknown or other
  misc_feature (349)..(349): n is a, c, g, or t
tcagcatagtagtgcacgaccggtgctcgatttagtcgatagtgaaggggaggaactgctcagttaggacccagacggaaccatggaagccccagcgcagcttctcttcctcctgctactctggctcccagataccactggagaagtagtgatgacggcagtctccggccaccctgtctgtgtctccaggggaaagngtcaccctctcctgcagggccagtcagactattagtacaaacttggcctgtacagcataaccnggcnggcnccagctcctcatccatgtgcactcctccgagggccaactaatactcccagcctaggttcagtggctaggtggggtcgggtnagtcgttacactctcaccatcagcacgcctgcgtagtctagtaagtattttagtcttagtttacttacttgtactagtcgtagggttaactgtacttaccgtccggtcccgttaccggttaccgttaccggttttcggggacccgggggtaccgacggtcgtaaggtaaacgttacaacgttcgtaaacgtggttacggcttggaactaccgtaacttcgttcgttactccttaactttccccg

SEQ ID NO: 326434 - DNA, 613 bp, Homo sapiens
  misc_feature: GZ8MTXP01BET19.10.17.B06.1.454.CMB.2.raw
  modified_base (196)..(196): a, c, t, g, unknown or other
  misc_feature (196)..(196): n is a, c, g, or t
  modified_base (266)..(266): a, c, t, g, unknown or other
  misc_feature (266)..(266): n is a, c, g, or t
  modified_base (275)..(275): a, c, t, g, unknown or other
  misc_feature (275)..(275): n is a, c, g, or t
  modified_base (284)..(284): a, c, t, g, unknown or other
  misc_feature (284)..(284): n is a, c, g, or t
  modified_base (410)..(410): a, c, t, g, unknown or other
  misc_feature (410)..(410): n is a, c, g, or t
tcagcatagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccgaggggaangtcaccctctcctgcagggccagtcagactattagacaaacttggctggtaccagcataacctggcagcnccaggctcncatcatgtncatcctccagggccactaatactcccagccgaggttcaggtgcgtacgggtggggtacggggtcagtacgttacacgttcctacaccctaagtcacgtcgagccctgctacggttctagtaagttnttttaggactttagtttattacgttgtcagtctagggttatcgtaactaccgtcgtcccgtaccgttacgttacggtttacggggcccgggggtaaccaacgggtcgtaagggtaaacttcgtaaacggacggtaaacgttcgggttacgggttcttacggaacctacgtaacttcgtacgttcctttccgaacttttccccg

SEQ ID NO: 326435 - DNA, 599 bp, Homo sapiens
  misc_feature: GZ8MTXP01DS0W4.10.17.B06.1.454.CMB.2.raw
  modified_base (267)..(267): a, c, t, g, unknown or other
  misc_feature (267)..(267): n is a, c, g, or t
  modified_base (275)..(275): a, c, t, g, unknown or other
  misc_feature (275)..(275): n is a, c, g, or t
  modified_base (283)..(283): a, c, t, g, unknown or other
  misc_feature (283)..(283): n is a, c, g, or t
tcagcatagtagtgcacgaccggtgctcgatttagtcgatagtgaaggggaggaactgctcagttaggacccagacggaaccatggaagccccagcgcagcttctcttcctcctgctactctggctcccagataccactggagaagtagtgatgacgcagtctccggccaccctgtctgtgtctccgaggggaagagtcaccctctcctgcagggccagtcagactattagtacaaacttggcctggtaccagcataactgcaggcnccagctcncatcatgngcactcctcgacgggccaactaatactcccagcctaggttcaggtggcgtaggtggggtcggggtcaggtacgttccacgtctacgaaccctatacgacgtcacgtcctgcagtctagaattagtttgacttagtttactacgttgtactagctaaggttctaggtacttaccgtcggtcccttaccggtacgttacggttttccgggggacccggggtaacctaacgggtcgtaaaggtaacttacgaaacggacggtaacgtcggttcggttcttacggtcaccgtaattcgtcgttcttccgaactttccccg

SEQ ID NO: 326436 - DNA, 566 bp, Homo sapiens
  misc_feature: GZ8MTXP01C12VE.10.17.B06.1.454.CMB.2.raw
  modified_base (195)..(195): a, c, t, g, unknown or other
  misc_feature (195)..(195): n is a, c, g, or t
  modified_base (267)..(267): a, c, t, g, unknown or other
  misc_feature (267)..(267): n is a, c, g, or t
  modified_base (276)..(276): a, c, t, g, unknown or other
  misc_feature (276)..(276): n is a, c, g, or t
  modified_base (285)..(285): a, c, t, g, unknown or other
  misc_feature (285)..(285): n is a, c, g, or t
  modified_base (345)..(345): a, c, t, g, unknown or other
  misc_feature (345)..(345): n is a, c, g, or t
  modified_base (365)..(365): a, c, t, g, unknown or other
  misc_feature (365)..(365): n is a, c, g, or t
tcagcatagtagtgcacgaccggtgctcgatttagtcgatagtgaaggggaggaactgctcagttaggacccagacggaaccatggaagccccagcgcagcttctcttcctcctgctactctggctcccagataccactggagaagtagtgatgacgcagtctccggccaccctgtctgtgtctccgaggggaanagtcaccctctcctgcagggccagtcagactattagacaaacttggcctggtaccagcataacctgcaggcnccaggctcncatcatgtncatcctcacggccaactatactcccagcctaggttcaggtggctaggtcggggtcgggtnaggtattccactctcacctntcagcagcctgctagtctagtaagttgtttagcgttagttttactacgtgtcagctaggttatgtacttaccgtcgtccctcgttacgttacgtttcgggacccggggtaacaggtcgtaacggtaaattcgaaagccgtaaacgtcggttacggcttcggccctaacgtcttactcggttccttcgttaacgtttccccg

SEQ ID NO: 326437 - DNA, 614 bp, Homo sapiens
  misc_feature: GZ8MTXP01DJFH9.10.17.B06.1.454.CMB.2.raw
  modified_base (196)..(196): a, c, t, g, unknown or other
  misc_feature (196)..(196): n is a, c, g, or t
  modified_base (257)..(257): a, c, t, g, unknown or other
  misc_feature (257)..(257): n is a, c, g, or t
  modified_base (263)..(263): a, c, t, g, unknown or other
  misc_feature (263)..(263): n is a, c, g, or t
  modified_base (269)..(269): a, c, t, g, unknown or other
  misc_feature (269)..(269): n is a, c, g, or t
  modified_base (271)..(271): a, c, t, g, unknown or other
  misc_feature (271)..(271): n is a, c, g, or t
  modified_base (279)..(279): a, c, t, g, unknown or other
  misc_feature (279)..(279): n is a, c, g, or t
  modified_base (300)..(300): a, c, t, g, unknown or other
  misc_feature (300)..(300): n is a, c, g, or t
  modified_base (375)..(375): a, c, t, g, unknown or other
  misc_feature (375)..(375): n is a, c, g, or t
tcagcatagtagtgcacgaccggtgctcgatttagtcgatagtgaaggggaggaactgctcagttaggacccagacggaaccatggaagccccagcgcagcttctcttcctcctgctactctggctcccagataccactggagaagtagtgatgacgcagtctccggccaccctgtctgtgtctccgaaggggaangtccaccctctcctgcagggccagtcagtactattagtacaattggcctgacagcataacngcagcnccagcncncatcatgncatcctcaggaccataatacncccagaccgtaggttcaggtggcgtagggtcggggtcggggtacagtacgttacactcgtacacatcagcagccngcgtagtcaggtaagttagtttagacttagtttattacgtgtacgagtacgtaggtattacgtaacttaacccgtcggtccctacccggttacgtttacgggtttcggggaaccccgggggtaacaacgggtcgtaaacgggtaaacttacggaaacggacggttaaaccggtggttacggccgttacggaacctaaccgtaactttccgtcgttaccttaacgttaacctttccccgg

SEQ ID NO: 326438 - DNA, 611 bp, Homo sapiens
  misc_feature: GZ8MTXP01BEOWL.10.17.B06.1.454.CMB.2.raw
  modified_base (195)..(195): a, c, t, g, unknown or other
  misc_feature (195)..(195): n is a, c, g, or t
  modified_base (206)..(206): a, c, t, g, unknown or other
  misc_feature (206)..(206): n is a, c, g, or t
  modified_base (272)..(272): a, c, t, g, unknown or other
  misc_feature (272)..(272): n is a, c, g, or t
  modified_base (283)..(283): a, c, t, g, unknown or other
  misc_feature (283)..(283): n is a, c, g, or t
  modified_base (292)..(292): a, c, t, g, unknown or other
  misc_feature (292)..(292): n is a, c, g, or t
tcagcatagtagtgcacgaccggtgctcgatttagtcgatagtgaaggggaggaactgctcagttaggacccagacggaaccatggaagccccagcgcagcttctcttcctcctgctactctggctcccagataccactggagaagtagtgatgacgcagtctccggccaccctgtctgtgtctccgaggggaanagtccaccctntcctgcagggccagtcagactattagtacaaacttggcctggtaccagcataaacctggccaggcncccaggctccnatccatggncatcctccgaggccataatactcccagccagttcaggtggcgaggtcgggggtcggtcagtagttaccaccttcgtcaacctagtcacgcacgccctgcagtctagtaattagttttcgcttagtttatacgtgtactagtcaaggttatggtaacttaccgtcggtcccttacggttacgttaccggtttcgggggccccggggtaacgtaacggtcggtaacgggtaaaacttcggtaaacggcgtaaaccgttgggttacggttccttaggaaccctaacgtcgttcgtaccgttcttaaccttaacgtttccccg

SEQ ID NO: 326439 - DNA, 608 bp, Homo sapiens
  misc_feature: GZ8MTXP01ENV34.10.17.B06.1.454.CMB.2.raw
  modified_base (196)..(196): a, c, t, g, unknown or other
  misc_feature (196)..(196): n is a, c, g, or t
  modified_base (205)..(205): a, c, t, g, unknown or other
  misc_feature (205)..(205): n is a, c, g, or t
  modified_base (255)..(255): a, c, t, g, unknown or other
  misc_feature (255)..(255): n is a, c, g, or t
  modified_base (261)..(261): a, c, t, g, unknown or other
  misc_feature (261)..(261): n is a, c, g, or t
  modified_base (270)..(270): a, c, t, g, unknown or other
  misc_feature (270)..(270): n is a, c, g, or t
  modified_base (280)..(280): a, c, t, g, unknown or other
  misc_feature (280)..(280): n is a, c, g, or t
tcagcatagtagtgcacgaccggtgctcgatttagtcgatagtgaaggggaggaactgctcagttaggacccagacggaaccatggaagccccagcgcagcttctcttcctcctgctactctggctcccagataccactggagaagtagtgatgacgcagtctccggccaccctgtctgtgtctccgaggggaaangtcaccctntcctgcagggccagtcagactatagtacaacttgcctggacagcataacngcagcnccagctctnatccatggtncatcctcgacggccaactaatactcccagccaggttcaggtggcagggtggggtcggggtcaggtacgtttccaacgttcctcaaccctatccagcacgtccctgcctagtctagtaaagttagttttagactttaaggttttacttacgtagtacaaggtctaaggggttattggtaacttaccgtcggtcccttaccggttacgttacggttttcggggacccgggggttacaacggtcgtaaggtaaacttacgaaaggacgtaaacgtggttacggttcttacggcctaactcgttcgtcggttccttccgttaactttccccg

SEQ ID NO: 326440 - DNA, 508 bp, Homo sapiens
  misc_feature: GZ8MTXP02G5MOT.10.17.B06.1.454.CMB.2.raw
  modified_base (195)..(195): a, c, t, g, unknown or other
  misc_feature (195)..(195): n is a, c, g, or t
tcagcatagtagtgcacgaccggtgctcgatttagtcgatagtgaaggggaggaactgctcagttaggacccagacggaaccatggaagccccagcgcagcttctcttcctcctgctactctggctcccagataccactggagaagtagtgatgacgcagtctccggccaccctgtctgtgtctccaggggaaanagtcaccctctcctgcagggccagtcagactattagtacaaacttggcctggtaccagcataaacctggccaggctcccaggctcctcatccatggtgcatcctccagggccactaatatcccagccaggttcagtggcagtggggtcggggtcagagttcactctcaccatcagcagccctgcagtctgaagattttagctagtttattactgtcagcagtatgatacctggcctcgtactacgtttggccgggggtacaaagctaggaaatcaagcgaaactgtaggctagcaccatctgtcttcacttcc

SEQ ID NO: 326441 - DNA, 513 bp, Homo sapiens
  misc_feature: GZ8MTXP02JTZN4.10.17.B06.1.454.CMB.2.raw
  modified_base (194)..(194): a, c, t, g, unknown or other
  misc_feature (194)..(194): n is a, c, g, or t
tcagcatagtagtgcacgaccggtgctcgatttagtcgatagtgaaggggaggaactgctcagttaggacccagacggaaccatggaagccccagcgcagcttctcttcctcctgctactctggctcccagataccactggagaagtagtgatgacgcagtctccggccaccctgtctgtgtctccaggggaanagtcaccctctcctgcagggccagtcagactattagtacaacttggcctggtaccagcataaacctggccaggctcccaggctcctcatccatggtgcatcctccaggggccactaatatcccagccaggttcagtggcagtggggtcggggtcaggagttcactctcaccatcagcagcctgcagtctgaagatttttgctagtttattactgtcagcagtatgatacctggccttccgtactactttcgggccgggggtaccaagcctaggaaatccaaagcgaactcggtcgctgcacactctgtcttcacttccc

SEQ ID NO: 326442 - DNA, 508 bp, Homo sapiens
  misc_feature: GZ8MTXP02GBI3L.10.17.B06.1.454.CMB.2.raw
  modified_base (195)..(195): a, c, t, g, unknown or other
  misc_feature (195)..(195): n is a, c, g, or t
  modified_base (351)..(351): a, c, t, g, unknown or other
  misc_feature (351)..(351): n is a, c, g, or t
tcagcatagtagtgcacgaccggtgctcgatttagtcgatagtgaaggggaggaactgctcagttaggacccagacggaaccatggaagccccagcgcagcttctcttcctcctgctactctggctcccagataccactggagaagtagtgatgacgcagtctccggccaccctgtctgtgtctccaggggaaanagtcaccctctcctgcagggccagtcagactattagtacaaacttggcctggtaccagcataaacctggccaggctcccaggctcctcatccatggtgcatcctccagggccactaatatcccagccaggttcagtggcagtgggtcggggtcagngttcactctcacatcagcagcctgcagtctgaagtattttgctagtttattactgtcagcagtatgatacctgcctcgtactctttgggccggggtacagctacggaaatcgaaacgcgaaacgtgtacggctgcaccatctgtcttcactttcccg

SEQ ID NO: 326443 - DNA, 503 bp, Homo sapiens
  misc_feature: GZ8MTXP02GDJ7C.10.17.B06.1.454.CMB.2.raw
  modified_base (195)..(195): a, c, t, g, unknown or other
  misc_feature (195)..(195): n is a, c, g, or t
  modified_base (348)..(348): a, c, t, g, unknown or other
  misc_feature (348)..(348): n is a, c, g, or t
tcagcatagtagtgcacgaccggtgctcgatttagtcgatagtgaaggggaggaactgctcagttaggacccagacggaaccatggaagccccagcgcagcttctcttcctcctgctactctggctcccagataccactggagaagtagtgatgacgcagtctccggccaccctgtctgtgtctccaggggaaangtcaccctctcctgcagggccagtcagactattagtacaaacttggcctggtaccagcataaacctggccaggctccaggctcctcatccatggtgcatcctccagggccactaatatcccagccaggttcagtggcagtgggtcgggtcagngttcactctcacatcagcagcctgcagtctgaagtatttgctagtttattactgtcagcagtatgatactgcctcgtactacgtttgggccggggtaccaagtctaggaaactcgaacgcgaactgtcggctgcaccatctgtcttcactttccc

SEQ ID NO: 326444 - DNA, 500 bp, Homo sapiens
  misc_feature: GZ8MTXP02FNV9O.10.17.B06.1.454.CMB.2.raw
  modified_base (195)..(195): a, c, t, g, unknown or other
  misc_feature (195)..(195): n is a, c, g, or t
tcagcatagtagtgcacgaccggtgctcgatttagtcgatagtgaaggggaggaactgctcagttaggacccagacggaaccatggaagccccagcgcagcttctcttcctcctgctactctggctcccagataccactggagaagtagtgatgacgcagtctccggccaccctgtctgtgtctccaggggaaanagtcaccctctcctgcagggccagtcagactattagtacaaacttggcctggtaccagcataaacctggccaggctcccaggctcctcatccatggtgcatcctccagggccactaatatcccagccaggttcagtggcagtgggtcggggtcagagttcactctcaccatcagcagcctgcagtctgaagattttgctagtttattactgtcagcagtatgatacctggcctcgtactcgtttggccggggtacagctaggaaatcaacgtcgaactcgtaggctgcacactctgtctcattcc

SEQ ID NO: 326445 - DNA, 525 bp, Homo sapiens
  misc_feature: GZ8MTXP02HDXQ5.10.17.B06.1.454.CMB.2.raw
  modified_base (293)..(293): a, c, t, g, unknown or other
  misc_feature (293)..(293): n is a, c, g, or t
tcagcatagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaagagtcaccctctcctgcagggccagtcagactattagtacaaacttggcctggtaccagcataaacctggccaggctccaggctcctcatccatggtncatcctcagggccactaatactcccagccaggttcaggtggcaggtggggtcggggtcaggtagttcactctcacatcagcagccctgcagtctagaagtattttgacttagtttattactgtcagctagtatgatacctggccctccgtactacgtttcgggccggggtaacaagcgtaggaaaactcaaagcgaaacgtcgtggactgcaccatctgtcttcacttcccg

SEQ ID NO: 326446 - DNA, 563 bp, Homo sapiens
  misc_feature: GZ8MTXP02HL0RG.10.17.B06.1.454.CMB.2.raw
  modified_base (295)..(295): a, c, t, g, unknown or other
  misc_feature (295)..(295): n is a, c, g, or t
tcagcatagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccgaggggaaagagtcaccctctcctgcagggccagtcagactattagtacaaacttggcctggtaccagcataaacctggccaggctcccaggctcctcatccatggtncatcctccagggccactaatactcccagccagttcagtggcagtggggtcggggtcagagttcactctcaccatcagcagccctgcagtctagaagtattttgacttagtttattactgtactagtcaagttatgattacctggcccttaccgtacttacgttttcggggcccgggggtaactaagcgtaggaaaacttcgaaacgtacgaaaccgttggtacggtctacggcaaccgtaacttcctgttccttactaactttccccg

SEQ ID NO: 326447 - DNA, 518 bp, Homo sapiens
  misc_feature: GZ8MTXP02F1YN4.10.17.B06.1.454.CMB.2.raw
tcagcatagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaagagtcaccctctcctgcagggccagtcagactattagtacaaacttggcctggtaccagcataaacctggccaggctcccaggctcctcatccatggtgcatccctccagggcccactaatactccccagccaggttcagtggcaggtggggtcggggtcaggtagttcacgttctcaccatcagcagcctgcagtctagaagtattttgctagtttattactgtcagctagtatgatactggtcctcgtactcgtttcgggccggggtacagcgtaggaactcaacgcgaactggtcgctgcaccatctgtctcactttccc

SEQ ID NO: 326448 - DNA, 504 bp, Homo sapiens
  misc_feature: GZ8MTXP02HNCFA.10.17.B06.1.454.CMB.2.raw
  modified_base (195)..(195): a, c, t, g, unknown or other
  misc_feature (195)..(195): n is a, c, g, or t
tcagcatagtagtgcacgaccggtgctcgatttagtcgatagtgaaggggaggaactgctcagttaggacccagacggaaccatggaagccccagcgcagcttctcttcctcctgctactctggctcccagataccactggagaagtagtgatgacgcagtctccggccaccctgtctgtgtctccaggggaaanagtcaccctctcctgcagggccagtcagactattagtacaaacttggcctggtaccagcataaacctggccaggctccaggctcctcatccatggtgcatcctccagggccactaatactcccagccaggttcagtggcaggtgggtcggggtcaggtagttcactctcacatcagcagccctgcagtctgaagtattttgctagtttatactgtcagcagtatgatactgcctccgtactacgtttggccggggacagcgtagaaactcaacgcgaactgtacgctagcacactctagtctctactcc

SEQ ID NO: 326449 - DNA, 520 bp, Homo sapiens
  misc_feature: GZ8MTXP02G37QZ.10.17.B06.1.454.CMB.2.raw
  modified_base (195)..(195): a, c, t, g, unknown or other
  misc_feature (195)..(195): n is a, c, g, or t
  modified_base (346)..(346): a, c, t, g, unknown or other
  misc_feature (346)..(346): n is a, c, g, or t
  modified_base (386)..(386): a, c, t, g, unknown or other
  misc_feature (386)..(386): n is a, c, g, or t
tcagcatagtagtgcacgaccggtgctcgatttagtcgatagtgaaggggaggaactgctcagttaggacccagacggaaccatggaagccccagcgcagcttctcttcctcctgctactctggctcccagataccactggagaagtagtgatgacgcagtctccggccaccctgtctgtgtctccaggggaaangtcaccctctcctgcagggccagtcagactattagtacaaacttggcctggtaccagcataaacctggccaggctccaggctcctcatccatggtgcatcctccagggccactaatactcccagccaggttcagtgcaggtgggtcgggtnagagttcactctcacatcagcagccctgcagtctgaagtnttttgctagtttatactgtcagctagtatgactaccgtgccttcgtactcgtttgggccggggtacagcgtaggaaatcgaaacgcgtaactggtacggctcggcgtacctactctcgttcttctactttcccg

SEQ ID NO: 326450 - DNA, 651 bp, Homo sapiens
  misc_feature: GZ8MTXP02HE5XS.10.17.B06.1.454.CMB.2.raw
  modified_base (292)..(292): a, c, t, g, unknown or other
  misc_feature (292)..(292): n is a, c, g, or t
  modified_base (320)..(320): a, c, t, g, unknown or other
  misc_feature (320)..(320): n is a, c, g, or t
tcagcatagtagtgcacgaccggtgctcgatttagtcgatagtgaaggggaggaactgctcagttaggacccagacggaaccatggaagccccagcgcagcttctcttcctcctgctactctggctccagataccactggagaagtagtgatgacgcagtctccggccaccctgtctgtgtctccgaaggggaaagagtcaccctctcctgcaggccagtcagactattagtacaaacttggctggtacagcataaactggccaggctcccaggctcctcatcccatggtcncactcctccgacggaccaactaaatacncccacgcgtagttcgagtggcgtagggtggggtcggggtcgagtacgttacacttctaccaacactacacgcacgtccgtgacaagttctaaggtaaagtttagtttttgacgttaaagttttaaacttaacgtcgtacaagtacgtaagtaagtagtacgtaccgtaccgtaccgttaccgttaccgttacggtttacggggttaccggggtaaccgggtaaacgtaacggtaacggtaaaacgtaaacgtaaacgtaacgtaaacgtacggtacggtacgtacgtaaccgaaccgtacctacgttacgttacttaccttacgttacccg

SEQ ID NO: 326451 - DNA, 501 bp, Homo sapiens
  misc_feature: GZ8MTXP02F2XJ0.10.17.B06.1.454.CMB.2.raw
  modified_base (196)..(196): a, c, t, g, unknown or other
  misc_feature (196)..(196): n is a, c, g, or t
  modified_base (349)..(349): a, c, t, g, unknown or other
  misc_feature (349)..(349): n is a, c, g, or t
tcagcatagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaangtcaccctctcctgcagggccagtcagactattagtacaaacttggcctggtaccagcataaacctggccaggctccaggctcctcatccatggtgcatcctccagggccactaatactcccagccaggttcagtgcagtgggtcgggtcagngttcactctcaccatcagcagcctgcagtctgaagtattttgctagtttattactgtcagcagtatgatactgcctcgtactacgtttcgggccggggacagtctaggaaatcaacgcgaacgtgtacggctgcacatctgtctcacttccc

SEQ ID NO: 326452 - DNA, 602 bp, Homo sapiens
  misc_feature: GZ8MTXP02HK3FK.10.17.B06.1.454.CMB.2.raw
  modified_base (196)..(196): a, c, t, g, unknown or other
  misc_feature (196)..(196): n is a, c, g, or t
tcagcatagtagtgcacgaccggtgctcgatttagtcgatagtgaaggggaggaactgctcagttaggacccagacggaaccatggaagccccagcgcagcttctcttcctcctgctactctggctcccagataccactggagaagtagtgatgacgcagtctccggccaccctgtctgtgtctccgaggggaaanagtcaccctctcctgcagggccagtcagactattagtacaaacttggcctggtaccagcataaacctggccaggctccaggctcctcatccatggtgcatccctccagggcccactaatactcccagccaggttcagtggcaggtggggtcggggtcaggtagttcactctcacatcagcagcctgcagtctagaagtatttgctagtttattactgtcagtctagtagtgataccgtgtcccttaccgttactaccggttttacgggggacccgggggtaaccctaaacggtccgtaacggggaaaacttaccggaaacggtacggtaaaccggttggtacggtccgttacgggaaccctacccgtaattcccgttacggtttccctttactaacctttcccccg

SEQ ID NO: 326453 - DNA, 646 bp, Homo sapiens
  misc_feature: GZ8MTXP02JMW1S.10.17.B06.1.454.CMB.2.raw
  modified_base (392)..(392): a, c, t, g, unknown or other
  misc_feature (392)..(392): n is a, c, g, or t
tcagcatagtagtgcacgaccggtgctcgatttagtcgatagtgaaggggaggaactgctcagttaggacccagacggaaccatggaagccccagcgcagcttctcttcctcctgctactctggctcccagataccactggagaagtagtgatgacgcagtctccggccacctgtctgtgtctccacgggaaaggaagtcaccctcctcctcgcacgggccgacgtcgtacgaacgtaatttagttaacgtaaaccttacggtccgtcggttaccgacgacgactaaaacctacggccgacgacgtccccacggcgtccctccactccactggtggtcactcctcccacgggaccgacctaaataatcccctacgacctacggttacgtagnggtcacgtggggtcggggtcagaggtctctcgtccaccaactcacgcgacgccgtcgcacgtcgtgaaaggtaatttttgtcgagtttttaatttacctgtcagctaagtattgattaccgtacggtcctccgttaaccgtacgtttttcggggcccgggggaacccgtaaatccggtacggtaaaagcctaaacggacgtaaacgttcggtggtccgtacgccaaccgacttcgtgttccttaccagtttccc

SEQ ID NO: 326454 - DNA, 518 bp, Homo sapiens
  misc_feature: GZ8MTXP02FJ0W9.10.17.B06.1.454.CMB.2.raw
tcagcatagtagtgcacgaccggtgctcgatttagtcgatagtgaaggggaggaactgctcagttaggacccagacggaaccatggaagccccagcgcagcttctcttcctcctgctactctggctcccagataccactggagaagtagtgatgacgcagtctccggccaccctgtctgtgtctccaggggaaagagtcaccctctcctgcagggccagtcagactattagtacaaacttggcctggtaccagcataaacctggccaggctcccaggctcctcatccatggtgcatccctccagggcccactaatactccccagccaggttcagtggcaggtggggtcggggtcagagttcactctcaccatcagcagcctgcagtctgaagtattttgctagtttattactgtcagcagtatgattaccgtgccctccgtactacgtttcgggccggggaccagctaggaaatcgaagcgaacgtgtacggctgcaccgatctgtcttcacttcccg

SEQ ID NO: 326455 - DNA, 529 bp, Homo sapiens
  misc_feature: GZ8MTXP02GMNJ2.10.17.B06.1.454.CMB.2.raw
  modified_base (376)..(378): a, c, t, g, unknown or other
  misc_feature (376)..(378): n is a, c, g, or t
  modified_base (380)..(380): a, c, t, g, unknown or other
  misc_feature (380)..(380): n is a, c, g, or t
  modified_base (390)..(390): a, c, t, g, unknown or other
  misc_feature (390)..(390): n is a, c, g, or t
  modified_base (392)..(392): a, c, t, g, unknown or other
  misc_feature (392)..(392): n is a, c, g, or t
  modified_base (408)..(408): a, c, t, g, unknown or other
  misc_feature (408)..(408): n is a, c, g, or t
tcagcatagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaagagtcaccctctcctgcagggccagtcagactattagtacaaacttggcctggtaccagcataaacctggccaggctcccaggctcctcatccatggtgcatcctccagggccactaatatcccagccaggttcagtggcagtgggtcggggtcagagttcactctcaccaatcagcagcnnntntagatatttntntattattatgtcaganagtatagatactcgtccgtccgtactacgtttcggtaccggggaccgaacgacgtacggtaaagtaacgaaacgaacgaacgtacgtcggcgtcgcgaccaactactcgttcttctactcc

SEQ ID NO: 326456 - DNA, 513 bp, Homo sapiens
  misc_feature: GZ8MTXP02GFB9C.10.17.B06.1.454.CMB.2.raw
  modified_base (196)..(196): a, c, t, g, unknown or other
  misc_feature (196)..(196): n is a, c, g, or t
  modified_base (205)..(205): a, c, t, g, unknown or other
  misc_feature (205)..(205): n is a, c, g, or t
tcagcatagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaangtcaccctntcctgcagggccagtcagactattagtacaaacttggcctggtaccagcataaacctggccaggctcccaggctcctcatccatggtgcatcctccagggccactaatatcccagccaggttcagtggcagtgggtcgggtcagagttcactctcaccatcagcagcctgcagtctagagtattttgctagtttattactgtcagcagtatgataccgtggcctcgtactacgttttgggccgggggtaccagcttagggaaactcgaaacgacgaacgtgtcggctgcacatctgtctcactttccc

SEQ ID NO: 326457 - DNA, 548 bp, Homo sapiens
  misc_feature: GZ8MTXP02H59I3.10.17.B06.1.454.CMB.2.raw
  modified_base (194)..(194): a, c, t, g, unknown or other
  misc_feature (194)..(194): n is a, c, g, or t
  modified_base (203)..(203): a, c, t, g, unknown or other
  misc_feature (203)..(203): n is a, c, g, or t
  modified_base (278)..(278): a, c, t, g, unknown or other
  misc_feature (278)..(278): n is a, c, g, or t
  modified_base (289)..(289): a, c, t, g, unknown or other
  misc_feature (289)..(289): n is a, c, g, or t
  modified_base (344)..(344): a, c, t, g, unknown or other
  misc_feature (344)..(344): n is a, c, g, or t
tcagcatagtagtgcacgaccggtgctcgatttagtcgatagtgaaggggaggaactgctcagttaggacccagacggaaccatggaagccccagcgcagcttctcttcctcctgctactctggctcccagataccactggagaagtagtgatgacgcagtctccggccaccctgtctgtgtctccaggggaangtcaccctntcctgcagggccagtcagactattagacaaacttggcctggtaccagcataaacctggccaggctccaggctccncatccatggtncatcctcagggccactaatctcccagccaggttcagtggcaggtgggtcggggtnagtgttcactctcacatcagcagcctgcagtctagaagtattttgctagttttatactgtcagtctagtatagactaccgtggcccttacgtacttacggtttcgggacccgggggtacaagtcgtaagggaaacttacgaaacgcgtaaacgtggtacggccgttagaaccacctatcgttcgttcctttctaactttccccg

SEQ ID NO: 326458 - DNA, 506 bp, Homo sapiens
  misc_feature: GZ8MTXP02GAWP2.10.17.B06.1.454.CMB.2.raw
  modified_base (196)..(196): a, c, t, g, unknown or other
  misc_feature (196)..(196): n is a, c, g, or t
  modified_base (352)..(352): a, c, t, g, unknown or other
  misc_feature (352)..(352): n is a, c, g, or t
  modified_base (355)..(355): a, c, t, g, unknown or other
  misc_feature (355)..(355): n is a, c, g, or t
tcagcatagtagtgcacgaccggtgctcgatttagtcgatagtgaaggggaggaactgctcagttaggacccagacggaaccatggaagccccagcgcagcttctcttcctcctgctactctggctcccagataccactggagaagtagtgatgacgcagtctccggccaccctgtctgtgtctccgaggggaaangtccaccctctcctgcagggccagtcagactattagtacaacttggcctggtaccagcataaacctggccaggctcccaggctcctcatccatggtgcatccctccagggcccactaatactcccagccaggttcagtggcaggtggggtcgggtnagngttcactctcacatcagcagcctgcagtctgaagtattttgctagtttatatgtcagcagtatgataccgtgcctccgtactcgtttgggccggggtacagtctaggaaatcaagcgaactgtacgctgcacgatctgtctcactttcccg

SEQ ID NO: 326459 - DNA, 518 bp, Homo sapiens
  misc_feature: GZ8MTXP02FU0AK.10.17.B06.1.454.CMB.2.raw
  modified_base (196)..(196): a, c, t, g, unknown or other
  misc_feature (196)..(196): n is a, c, g, or t
  modified_base (292)..(292): a, c, t, g, unknown or other
  misc_feature (292)..(292): n is a, c, g, or t
tcagcatagtagtgcacgaccggtgctcgatttagtcgatagtgaaggggaggaactgctcagttaggacccagacggaaccatggaagccccagcgcagcttctcttcctcctgctactctggctcccagataccactggagaagtagtgatgacgcagtctccggccaccctgtctgtgtctccaggggaaagngtcaccctctcctgcagggccagtcagactattagtacaaacttggcctggtaccagcataaacctggccaggctccaggctcctcatccatggtncatcctccagggcccactaatactcccagcctaggttcagtggcaggtggggtcgggtcagagttcactctcaccatccagcagccctgcagtctagaagtattttgctagtttattactgtcagcagtatgactacgtggtccctcgtactcgtttcgggccggggacagcgtaggaactacaagacgtaacgtcgtcgctgctaccagtctgttactcacttcc

SEQ ID NO: 326460 - DNA, 541 bp, Homo sapiens
  misc_feature: GZ8MTXP02H4S8O.10.17.B06.1.454.CMB.2.raw
  modified_base (258)..(258): a, c, t, g, unknown or other
  misc_feature (258)..(258): n is a, c, g, or t
  modified_base (278)..(278): a, c, t, g, unknown or other
  misc_feature (278)..(278): n is a, c, g, or t
  modified_base (402)..(402): a, c, t, g, unknown or other
  misc_feature (402)..(402): n is a, c, g, or t
tcagcatagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctcagggaagagtcaccctctcctgcagggccagtcagactattagtacaaacttggctggtaccagcataaccnggccaggctccaggcctccncatccatggtgcactccctccgagggccaactaatactcccagccaggttccagtcggcaggtggggtacggggtcaggtagttcgactctcaccatcagcagccctgcagtctaggtaaacgnttttgactagtttatactgtacagtctaagtatgtactaccgtggtccctacgtaactcgtttcggggacccggggtaccaaggtctaggaaaactcgaaagcgaactgtcggactgccacatctagtcttcacttccc

SEQ ID NO: 326461 - DNA, 510 bp, Homo sapiens
  misc_feature: GZ8MTXP02FT6G7.10.17.B06.1.454.CMB.2.raw
  modified_base (498)..(498): a, c, t, g, unknown or other
  misc_feature (498)..(498): n is a, c, g, or t
tcagcatagtagtgcacgaccggtgctcgatttagtcgatagtgaaggggaggaactgctcagttaggacccagacggaaccatggaagccccagcgcagcttctcttcctcctgctactctggctcccagataccactggagaagtagtgatgacgcagtctccggccaccctgtctgtgtctccaggggaagagtcaccctctcctgcagggccagtcagactattagtacaaacttggcctggtaccagcataaacctggccaggctcccaggctcctcatccatggtgcatcctccagggccactaatatcccagccaggttcagtggcaggtggggtcggggtcagacgttcactctcaccatcagcagcctgcagtctgaagtattttgctagtttattactgtctagctagtatgatacctggcctccgtactacgtttcgggccggggaccagcgtagaaatcaagcgaatcgtaggctgcaccatcgtntcttcacttccc

SEQ ID NO: 326462 - DNA, 521 bp, Homo sapiens
  misc_feature: GZ8MTXP02IPQMG.10.17.B06.1.454.CMB.2.raw
  modified_base (195)..(195): a, c, t, g, unknown or other
  misc_feature (195)..(195): n is a, c, g, or t
tcagcatagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaangtcaccctctcctgcagggccagtcagactattagtacaacttggcctggtaccagcaataacctggccaggctccaggctcctcatccatggtgcatccctccgagggcccataatctccccagccaggttcagtggcaggtggggtcggggtcaggtagttccactctcaccatcagcaggccctgcagtctagaagtatttgcttagtttatacgtgtcagtctagtatgactacgtcggcctcgtactacgtttcgggccgggacagcgtaggaatcgaacgcgaacgtcgtcggctgaacacgatctgtcttcacttcccg

SEQ ID NO: 326463 - DNA, 535 bp, Homo sapiens
  misc_feature: GZ8MTXP02IKPLF.10.17.B06.1.454.CMB.2.raw
  modified_base (196)..(196): a, c, t, g, unknown or other
  misc_feature (196)..(196): n is a, c, g, or t
  modified_base (292)..(292): a, c, t, g, unknown or other
  misc_feature (292)..(292): n is a, c, g, or t
  modified_base (354)..(354): a, c, t, g, unknown or other
  misc_feature (354)..(354): n is a, c, g, or t
tcagcatagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaangtcaccctctcctgcagggccagtcagactattagtacaaacttggcctggtaccagcataacctggccaggctcccaggctcctcatccatggtncatccctccagggcccactaatactcccagccaggttcagtggcaggtggggtcgggtcagngttcactctcacatcagcagcctgcactctagaagtattttgctagtttattactgtacagctagtatgattaccgtaggcctccgtactacgtttcgggaccgggggtacaagtctacggaaaactcgaaacgacgtaaacgtgtacgctgaacacactctagttcttactactttcccg

SEQ ID NO: 326464 - DNA, 502 bp, Homo sapiens
  misc_feature: GZ8MTXP02HB053.10.17.B06.1.454.CMB.2.raw
  modified_base (196)..(196): a, c, t, g, unknown or other
  misc_feature (196)..(196): n is a, c, g, or t
  modified_base (349)..(349): a, c, t, g, unknown or other
  misc_feature (349)..(349): n is a, c, g, or t
tcagcatagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaanagtcaccctctcctgcagggccagtcagactattagtacaaacttggcctggtaccagcataaacctggccaggctcccaggctcctcatccatggtgcatcctcagggccactaatatcccagccaggttcagtgcagtgggtcgggtcagngttcactctcacatcagcagcctgcagtctagaagtattttgctagtttattactgtcagctagtatgatacgtgcctcgtactacgtttggccgggtacagcgtacgaatcaacgacgaacgtcgtcgctcgcacatctgtcttcacttccc

SEQ ID NO: 326465 - DNA, 523 bp, Homo sapiens
  misc_feature: GZ8MTXP02F2MN5.10.17.B06.1.454.CMB.2.raw
  modified_base (196)..(196): a, c, t, g, unknown or other
  misc_feature (196)..(196): n is a, c, g, or t
  modified_base (262)..(262): a, c, t, g, unknown or other
  misc_feature (262)..(262): n is a, c, g, or t
  modified_base (292)..(292): a, c, t, g, unknown or other
  misc_feature (292)..(292): n is a, c, g, or t
  modified_base (353)..(353): a, c, t, g, unknown or other
  misc_feature (353)..(353): n is a, c, g, or t
  modified_base (366)..(366): a, c, t, g, unknown or other
  misc_feature (366)..(366): n is a, c, g, or t
tcagcatagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaangtcaccctctcctgcagggccagtcagactattagtacaaacttggcctggtaccagcataaaccnggccaggctccaggctcctcatccatggtncatccctccagggcccaactaatactcccagcctaggttcagtggcaggtggggtcgggtnagtagttcactcncacatcagcagcctgccagtctagaagtattttgcttagtttattactgtcagcagttatgtactaccgtgcccttccgtacttacgtttcgggacccggggacaagtcgtaggaatcaagacgaactgcgctgctacgactctgtcttcacttccc

SEQ ID NO: 326466 - DNA, 556 bp, Homo sapiens
  misc_feature: GZ8MTXP02IB5X0.10.17.B06.1.454.CMB.2.raw
  modified_base (196)..(196): a, c, t, g, unknown or other
  misc_feature (196)..(196): n is a, c, g, or t
  modified_base (294)..(294): a, c, t, g, unknown or other
  misc_feature (294)..(294): n is a, c, g, or t
  modified_base (356)..(356): a, c, t, g, unknown or other
  misc_feature (356)..(356): n is a, c, g, or t
  modified_base (392)..(392): a, c, t, g, unknown or other
  misc_feature (392)..(392): n is a, c, g, or t
tcagcatagtagtgcacgaccggtgctcgatttagtcgatagtgaaggggaggaactgctcagttaggacccagacggaaccatggaagccccagcgcagcttctcttcctcctgctactctggctcccagataccactggagaagtagtgatgacgcagtctccggccaccctgtctgtgtctccgaggggaaanagtcaccctctcctgcagggccagtcagactattagtacaaacttggcctggtaccagcataaacctggccaggctcccaggctcctcatccatggtncatcctccagggcccactaatactccccagccaggttcagtggcaggtggggtcgggtcagngttcactctcaccatcagcagcctgcagtctgaatntttgctagtttattactgtcagtctagtatgatacctggtccctccgtactcgtttcggggaccggggtacaaggtcgtagggaaaacttcgaaacggtacgtaaacgttggtacgggccttaggaaccgtaacctacgttcttcggttcctttacactttccc

SEQ ID NO: 326467 - DNA, 593 bp, Homo sapiens
  misc_feature: GZ8MTXP02FU6A3.10.17.B06.1.454.CMB.2.raw
  modified_base (195)..(195): a, c, t, g, unknown or other
  misc_feature (195)..(195): n is a, c, g, or t
  modified_base (286)..(286): a, c, t, g, unknown or other
  misc_feature (286)..(286): n is a, c, g, or t
  modified_base (338)..(338): a, c, t, g, unknown or other
  misc_feature (338)..(338): n is a, c, g, or t
tcagcatagtagtgcacgaccggtgctcgatttagtcgatagtgaaggggaggaactgctcagttaggacccagacggaaccatggaagccccagcgcagcttctcttcctcctgctactctggctcccagataccactggagaagtagtgatgacgcagtctccggccaccctgtctgtgtctccaggggaagngtcaccctctcctgcagggccagtcagactattagtacaaacttggcctggtaccagcataaacctgccagctccagctctcatccatggncatcctccaggccactaatactcccagccagttcagtgcagtgggtcgggtnagagtcactctcaccatcagacagcctgcagtctgtaagtattttgcttagtttatttactagtctagtactagtagtgtagtaccgtggtaccccgtccgttaaccgtaccgttttacggggtacccgggggtaaccgaacggtacgtacgggtaaaacttacgaacggaaccggtaacgtaccgttagggccgttacggaacctaacccgtaacttaccgttacggtttcctttaccgtaacgttttcccccg

SEQ ID NO: 326468 - DNA, 510 bp, Homo sapiens
  misc_feature: GZ8MTXP02IHXK7.10.17.B06.1.454.CMB.2.raw
  modified_base (194)..(194): a, c, t, g, unknown or other
  misc_feature (194)..(194): n is a, c, g, or t
  modified_base (204)..(204): a, c, t, g, unknown or other
  misc_feature (204)..(204): n is a, c, g, or t
  modified_base (270)..(270): a, c, t, g, unknown or other
  misc_feature (270)..(270): n is a, c, g, or t
  modified_base (280)..(280): a, c, t, g, unknown or other
  misc_feature (280)..(280): n is a, c, g, or t
tcagcatagtagtgcacgaccggtgctcgatttagtcgatagtgaaggggaggaactgctcagttaggacccagacggaaccatggaagccccagcgcagcttctcttcctcctgctactctggctcccagataccactggagaagtagtgatgacgcagtctccggccaccctgtctgtgtctccaggggaanagtcaccctntcctgcagggccagtcagactattagtacaattggcctggaccagcataactgcagctccagctcncatccatgtncatcctcagggccactaatatcccagccaggttcagtggcaggtgggtcgggtcagagttcactctcacatcagcagcctgcagtctagaagtattttgacttagtttattactgtcagctagtatgatacgtgtccctcgtactacgtttcgggccggggtaccaagcgtacggaatccaaagtcgaaactgtacggctaggcctaccattctagttcttcactttccc

SEQ ID NO: 326469 - DNA, 528 bp, Homo sapiens
  misc_feature: GZ8MTXP02F9YZR.10.17.B06.1.454.CMB.2.raw
  modified_base (195)..(195): a, c, t, g, unknown or other
  misc_feature (195)..(195): n is a, c, g, or t
tcagcatagtagtgcacgaccggtgctcgatttagtcgatagtgaaggggaggaactgctcagttaggacccagacggaaccatggaagccccagcgcagcttctcttcctcctgctactctggctcccagataccactggagaagtagtgatgacgcagtctccggccaccctgtctgtgtctccaggggaaangtcaccctctcctgcagggccagtcagactattagtacaaacttggcctggtaccagcataaacctggccaggctccaggctcctcatccatggtgcatcctccagggccactaatactcccagccaggttcagtggcaggtggggtcggggtcagagttcactctcaccatcagcagccctgcagtctgaacgtattttgctagttttattactttcagtctagtatgatacctggcctccgtactacgttttcgggccgggggtaccaaggctaggaaactcgaaagcgaaactgtacgctgcaacagtctcgtcttcactcgtttacccc

SEQ ID NO: 326470 - DNA, 599 bp, Homo sapiens
  misc_feature: GZ8MTXP02H1EUL.10.17.B06.1.454.CMB.2.raw
  modified_base (196)..(196): a, c, t, g, unknown or other
  misc_feature (196)..(196): n is a, c, g, or t
  modified_base (205)..(205): a, c, t, g, unknown or other
  misc_feature (205)..(205): n is a, c, g, or t
tcagcatagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccgaggggaangtcaccctntcctgcagggccagtcagactattagtaacaaacttggcctggtaccagcaataaacctggccaggctcccaggctcctcatccatggtgcatcctcacgggccaactaatactcccagccaggttcagtggcaggtggggtcggggtcaggagttcactctacacatcagcagccctgcagtctgtaacgtatttttagccttagttttattacgttgtactagtcagttatgtaacttacctcggtccttccgtacttaccgtttcggggaccgggggtaccaacggtacgtacggaaaagttaccgaaacgacggtaaaacgttcggtacgggtccgttacgaaccggtaaccgtacttccgttacgttcctttaccgtacttttcccccg

SEQ ID NO: 326471 - DNA, 499 bp, Homo sapiens
  misc_feature: GZ8MTXP02GCSMQ.10.17.B06.1.454.CMB.2.raw
  modified_base (195)..(195): a, c, t, g, unknown or other
  misc_feature (195)..(195): n is a, c, g, or t
  modified_base (433)..(433): a, c, t, g, unknown or other
  misc_feature (433)..(433): n is a, c, g, or t
tcagcatagtagtgcacgaccggtgctcgatttagtcgatagtgaaggggaggaactgctcagttaggacccagacggaaccatggaagccccagcgcagcttctcttcctcctgctactctggctcccagataccactggagaagtagtgatgacgcagtctccggccaccctgtctgtgtctccaggggaaanagtcaccctctcctgcagggccagtcagactattagtacaaacttggcctggtaccagcataaacctggccaggctcccaggctcctcatccatggtgcatcctccagggccactaatatcccagccaggttcagtggcagtggggtcggggtcagagttcactctcaccatcagcagcctgcagtctgaagtatttgctagtttattactgtcagcagtatgatactgcctcgtacncgtttggccggggtacaagctaggaaatcaagcgaacgtgtcgctgcaccatctgtcttcattccc

SEQ ID NO: 326472 - DNA, 530 bp, Homo sapiens
  misc_feature: GZ8MTXP02HRXYW.10.17.B06.1.454.CMB.2.raw
  modified_base (195)..(195): a, c, t, g, unknown or other
  misc_feature (195)..(195): n is a, c, g, or t
  modified_base (292)..(292): a, c, t, g, unknown or other
  misc_feature (292)..(292): n is a, c, g, or t
tcagcatagtagtgcacgaccggtgctcgatttagtcgatagtgaaggggaggaactgctcagttaggacccagacggaaccatggaagccccagcgcagcttctcttcctcctgctactctggctcccagataccactggagaagtagtgatgacgcagtctccggccaccctgtctgtgtctccaggggaaangtcaccctctcctgcagggccagtcagactattagtacaaacttggcctggtaccagcataaacctggccaggctcccaggctcctcatccatggtncatcctccgagggcccaactaatactcccagcctaggttcaggtggcaggtggggtcggggtcaggtagttcatctcaccatcagcagccctgcagtctagaagttattttgacttagtttattactgtcagtcagttatgattacctggtacctccgtactacgtttcgggccggggacaaggctacggaaatcgaagacgtaacgtgacgctgcacattctgtcttctacttcccg

SEQ ID NO: 326473 - DNA, 518 bp, Homo sapiens
  misc_feature: GZ8MTXP02GFS7T.10.17.B06.1.454.CMB.2.raw
  modified_base (195)..(195): a, c, t, g, unknown or other
  misc_feature (195)..(195): n is a, c, g, or t
tcagcatagtagtgcacgaccggtgctcgatttagtcgatagtgaaggggaggaactgctcagttaggacccagacggaaccatggaagccccagcgcagcttctcttcctcctgctactctggctcccagataccactggagaagtagtgatgacgcagtctccggccaccctgtctgtgtctccaggggaaangtcaccctctcctgcagggccagtcagactattagtacaaacttggcctggtaccagcataaacctggccaggctcccaggctcctcatccatggtgcatcctccagggcccaactaatactcccagccaggttcagtggcaggtggggtcgggtcagagttcactctcaccatcagcagccctgcagtctagaagtattttgctagtttattactgtcagcagtatgatacctggccctcgtactacgtttcgggccgggggtacagctaggaaactacgaacgcgaaacgtgtacggctgcacagtctgtcttcacttccc

SEQ ID NO: 326474 - DNA, 538 bp, Homo sapiens
  misc_feature: GZ8MTXP02GNR5M.10.17.B06.1.454.CMB.2.raw
  modified_base (195)..(195): a, c, t, g, unknown or other
  misc_feature (195)..(195): n is a, c, g, or t
  modified_base (289)..(289): a, c, t, g, unknown or other
  misc_feature (289)..(289): n is a, c, g, or t
  modified_base (345)..(345): a, c, t, g, unknown or other
  misc_feature (345)..(345): n is a, c, g, or t
  modified_base (348)..(348): a, c, t, g, unknown or other
  misc_feature (348)..(348): n is a, c, g, or t
  modified_base (357)..(357): a, c, t, g, unknown or other
  misc_feature (357)..(357): n is a, c, g, or t
tcagcatagtagtgcacgaccggtgctcgatttagtcgatagtgaaggggaggaactgctcagttaggacccagacggaaccatggaagccccagcgcagcttctcttcctcctgctactctggctcccagataccactggagaagtagtgatgacgcagtctccggccaccctgtctgtgtctccaggggaaangtcaccctctcctgcagggccagtcagactattagtacaacttggcctggtaccagcataacctggccaggctccaggctcctcatccatggtncatcctccgaggccactaatactcccagcctaggttcagtggcagtgggtcgggtnagngttcactcncacatcagcagcctgcagtctagaagtattttgacttagtttattactgtacagactagtatgtataccgtcggtaccctccgtacttacgtttcgggaccggggtaccaagcgtaggaaactcgaaacgtacgaaacgttgacggtctcgaacacctatctcgtcttcctactttccccg

SEQ ID NO: 326475 - DNA, 524 bp, Homo sapiens
  misc_feature: GZ8MTXP02HKRZC.10.17.B06.1.454.CMB.2.raw
tcagcatagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaagagtcaccctctcctgcagggccagtcagactattagtacaaacttggcctggtaccagcataaacctggccaggctcccaggctcctcatccatggtgcatccctccaggggccactaatactcccagccaggttcagtggcaggtggggtcggggtcagagttcactctcaccatcagcagcctgcagtctgaagtatttgctagtttattaactgtcagcagtatgataccgtggcctccgtactacgttttcgggccgggggtaccaagtcctaggaaaatcaaacgcgaacgtagtcggctgcgacactctgtcttcacttccc

SEQ ID NO: 326476 - DNA, 694 bp, Homo sapiens
  misc_feature: GZ8MTXP02JMPLS.10.17.B06.1.454.CMB.2.raw
  modified_base (196)..(196): a, c, t, g, unknown or other
  misc_feature (196)..(196): n is a, c, g, or t
  modified_base (278)..(278): a, c, t, g, unknown or other
  misc_feature (278)..(278): n is a, c, g, or t
  modified_base (288)..(288): a, c, t, g, unknown or other
  misc_feature (288)..(288): n is a, c, g, or t
  modified_base (349)..(349): a, c, t, g, unknown or other
  misc_feature (349)..(349): n is a, c, g, or t
tcagcatagtagtgcacgaccggtgctcgatttagtcgatagtgaagggggaggaactgctcagttaggacccagacggaaccatggaagccccagcgcagcttctcttcctcctgctactctggctccagataccactggagaagtagtgatgacgcagtctacggccaccctgtctgtgtctccgaggggaaangtcacctctcctgcagggccagtcagactattagtacaaacttggctggtaccagcataacctggccaggctccaggctccncatccatgtncatccctcgaggccaactaactacgtcccagccaggttcaggtgcgaggtgggtcggggtnagtgtcactctcacatcagcagcctgctagtctagaacgttagtttttgacttaaggttttatttacgtacgttacgtaacgcgttaaagttaacgtcgtaactttaacccgggttccggttaccccgtttacccgggttaaacccgtttaccgggtttttaccgggggaaccccggggggttaacccgtaaaacgggtccggtttaaacgggaaaaacgttaccggtaaaacgggtaaccggttaaaccggtacgggttaacgggtccgttacgggtaaccgtaacccccgttaagtttcccggtttaaggtttccccgtttaaccgttaccgttttccccccg

SEQ ID NO: 326477 - DNA, 531 bp, Homo sapiens
  misc_feature: GZ8MTXP02HO2DZ.10.17.B06.1.454.CMB.2.raw
  modified_base (195)..(195): a, c, t, g, unknown or other
  misc_feature (195)..(195): n is a, c, g, or t
  modified_base (282)..(282): a, c, t, g, unknown or other
  misc_feature (282)..(282): n is a, c, g, or t
  modified_base (293)..(293): a, c, t, g, unknown or other
  misc_feature (293)..(293): n is a, c, g, or t
  modified_base (397)..(397): a, c, t, g, unknown or other
  misc_feature (397)..(397): n is a, c, g, or t
tcagcatagtagtgcacgaccggtgctcgatttagtcgatagtgaaggggaggaactgctcagttaggacccagacggaaccatggaagccccagcgcagcttctcttcctcctgctactctggctcccagataccactggagaagtagtgatgacgcagtctccggccaccctgtctgtgtctccaggggaaangtcaccctctcctgcagggccagtcagactattagtacaaacttggcctggtaccagcataaacctggccaggctcccaggcctccncatccatggtncatccctccagggccactaatactcccagcctaggttcaggtggcaggtggggtcgggtcaggtagttccactctcaccatcagcagccctgcagtctgaagtntttgcttagtttatcgtgtcagcagtatgataccgtgcctcgtactcgtttcggccggggtacagcgtaggaaactcgaaacgcgtaacgtggtacgtctgaacctacacttcgtgtccttactactttccccg

SEQ ID NO: 326478 - DNA, 507 bp, Homo sapiens
  misc_feature: GZ8MTXP02FTOD9.10.17.B06.1.454.CMB.2.raw
  modified_base (196)..(196): a, c, t, g, unknown or other
  misc_feature (196)..(196): n is a, c, g, or t
tcagcatagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaangtcaccctctcctgcagggccagtcagactattagtacaaacttggcctggtaccagcataaactgcaggctccaggctcctcatccatggtgcatcctccagggccactaatactcccagccaggttcagtggcagtggggtcgggtcagagtcactctcaccatcagcagccctgcagtctagaagtattttgctagtttattactgtcagcagtatgatactgaccctcgtactacgtttcgggccggggaacctaagctaggaaactacaagacgaatcgtacgctgcacactctgtcttcattccc

SEQ ID NO: 326479 - DNA, 552 bp, Homo sapiens
  misc_feature: GZ8MTXP02GAL0F.10.17.B06.1.454.CMB.2.raw
  modified_base (263)..(263): a, c, t, g, unknown or other
  misc_feature (263)..(263): n is a, c, g, or t
  modified_base (293)..(293): a, c, t, g, unknown or other
  misc_feature (293)..(293): n is a, c, g, or t
  modified_base (352)..(352): a, c, t, g, unknown or other
  misc_feature (352)..(352): n is a, c, g, or t
tcagcatagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaagagtcaccctctcctgcagggccagtcagactattagtacaaacttggcctggtaccagcataaaccnggccaggctcccaggctctcatccatggtncatcctccagggcccaactaatactcccagccaggttcagtggcaggtgggtcggggtnaggtagttcactctcaccatcagcagcctgcagtctgaagtatttgctagtttattactgtcgtagctaagtactgtactacgtcgtccctaccgtactacgttttcgggacccgggggtacaacggcgtaggtaaaactacgaaacgacgtaaacgtcgtacggctacgaacacctactctacgtcttctactttcccg

SEQ ID NO: 326480 - DNA, 552 bp, Homo sapiens
  misc_feature: GZ8MTXP02FVNVV.10.17.B06.1.454.CMB.2.raw
  modified_base (403)..(403): a, c, t, g, unknown or other
  misc_feature (403)..(403): n is a, c, g, or t
tcagcatagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaagagtcaccctctcctgcagggccagtcagactattagtacaaacttggcctggtaccagcataaacctggccaggctccaggctcctcatccatggtgcatccctccagggcccaactaactactaccccagccctaggttccagtggcaggtggggtcggggtcagtagttcactctcaccatcagcagccctgcagtctagaagtnttttgcttagtttattactgtcagctagtatgactaccgtagccctcgttactacgttttcgggaccgggggtaccaaggtctagggaaatacgaaacgtacgaaacttggtacggctacgcctacactcgtgtcttactactttcccg

SEQ ID NO: 326481 - DNA, 503 bp, Homo sapiens
  misc_feature: GZ8MTXP02H7LIJ.10.17.B06.1.454.CMB.2.raw
  modified_base (196)..(196): a, c, t, g, unknown or other
  misc_feature (196)..(196): n is a, c, g, or t
  modified_base (375)..(375): a, c, t, g, unknown or other
  misc_feature (375)..(375): n is a, c, g, or t
tcagcatagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaanagtcaccctctcctgcagggccagtcagactattagtacaaacttggcctggtaccagcataaacctggccaggctccaggctcctcatccatggtgcatcctccagggccactaatactcccagccaggttcagtggcagtgggtcggggtcagagttcactctcacatcagcagccngtcagtctagaagtatttgctagtttattactgtcagcagtatgatacctgcctcgtactcgtttcggccggggacagcgtagaatacaagcgtaactgtggctgaacacatctcgtcttcacttccc

SEQ ID NO: 326482 - DNA, 498 bp, Homo sapiens
  misc_feature: GZ8MTXP02JEBNR.10.17.B06.1.454.CMB.2.raw
  modified_base (196)..(196): a, c, t, g, unknown or other
  misc_feature (196)..(196): n is a, c, g, or t
  modified_base (205)..(205): a, c, t, g, unknown or other
  misc_feature (205)..(205): n is a, c, g, or t
  modified_base (346)..(346): a, c, t, g, unknown or other
  misc_feature (346)..(346): n is a, c, g, or t
  modified_base (349)..(349): a, c, t, g, unknown or other
  misc_feature (349)..(349): n is a, c, g, or t
  modified_base (492)..(492): a, c, t, g, unknown or other
  misc_feature (492)..(492): n is a, c, g, or t
tcagcatagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaangtcaccctntcctgcagggccagtcagactatagtacaaacttggcctggtaccagcataaacctggccaggctcccaggctcctcatccatggtgcatcctccagggccactaatatcccagccaggttcagtggcagtgggtcgggtnagngttcactctcacatcagcagcctgcacgtctagagtattttgctagtttatactgtcagctagtatgactactgcctcgtactcgtttggccggggtacaagcgtagaatcaagcaacgtgtacggctgcacatctgtctacnttcccg

SEQ ID NO: 326483 - DNA, 529 bp, Homo sapiens
  misc_feature: GZ8MTXP02FU2F2.10.17.B06.1.454.CMB.2.raw
  modified_base (195)..(195): a, c, t, g, unknown or other
  misc_feature (195)..(195): n is a, c, g, or t
  modified_base (267)..(267): a, c, t, g, unknown or other
  misc_feature (267)..(267): n is a, c, g, or t
  modified_base (276)..(276): a, c, t, g, unknown or other
  misc_feature (276)..(276): n is a, c, g, or t
  modified_base (285)..(285): a, c, t, g, unknown or other
  misc_feature (285)..(285): n is a, c, g, or t
  modified_base (291)..(291): a, c, t, g, unknown or other
  misc_feature (291)..(291): n is a, c, g, or t
tcagcatagtagtgcacgaccggtgctcgatttagtcgatagtgaaggggaggaactgctcagttaggacccagacggaaccatggaagccccagcgcagcttctcttcctcctgctactctggctcccagataccactggagaagtagtgatgacgcagtctccggccaccctgtctgtgtctccaggggaaanagtcaccctctcctgcagggccagtcagactattagtacaaacttggcctggtaccagcataaactgcagcnccaggctcncatcatgtncatccncaggccactaatatcccagccaggttcagtggcagtggggtcggggtcagagttcactctcaccatcagcagcctgcagtctagaagtattttagctagtttattactgtcagcagtatgataccgtgcctaccgtactacgtttcgggccgggggaacaagtactagggaaaacttacgaaagtaccgaaacgtcgtaggctacgaacgaaccctagtcctgtcttactacttcccg

SEQ ID NO: 326484 - DNA, 532 bp, Homo sapiens
  misc_feature: GZ8MTXP02JOHEM.10.17.B06.1.454.CMB.2.raw
  modified_base (195)..(195): a, c, t, g, unknown or other
  misc_feature (195)..(195): n is a, c, g, or t
  modified_base (204)..(204): a, c, t, g, unknown or other
  misc_feature (204)..(204): n is a, c, g, or t
  modified_base (260)..(260): a, c, t, g, unknown or other
  misc_feature (260)..(260): n is a, c, g, or t
  modified_base (268)..(268): a, c, t, g, unknown or other
  misc_feature (268)..(268): n is a, c, g, or t
  modified_base (275)..(275): a, c, t, g, unknown or other
  misc_feature (275)..(275): n is a, c, g, or t
  modified_base (281)..(281): a, c, t, g, unknown or other
  misc_feature (281)..(281): n is a, c, g, or t
  modified_base (516)..(516): a, c, t, g, unknown or other
  misc_feature (516)..(516): n is a, c, g, or t
tcagcatagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccgagggaangtcaccctntcctgcagggccagtcagactatagacaatggctggtaccagcataactgcaggcnccagctcnatcatgncatccncgaggccatatctcccagtcaggttcagtgcacgtgggcggtcaggtacttcgactcgtccaactagtccgagcagtccgtgtacacggttcaggtaacgtgttttcgacttagtttactaactgtactagtctagtactgtaactcggtcgtaccgtccgtacgtcgttcgggaccggactacgcgtaggactcgaaacgtcgaacctggacgtctgaacctactagttaccgntaccgtcgacttcccg

SEQ ID NO: 326485 - DNA, 554 bp, Homo sapiens
  misc_feature: GZ8MTXP02GNP1L.10.17.B06.1.454.CMB.2.raw
tcagcatagtagtgcacgaccggtgctcgatttagtcgatagtgaaggggaggaactgctcagttaggacccagacggaaccatggaagccccagcgcagcttctcttcctcctgctactctggctaccagataccactggagaagtagtgatgacgcagtctccggccaccctgtctgtgtctccgaggggaaagagtcaccctctcctgcagggccagtcagactattagtacaaacttggcctggtaccagcataaacctggccaggctccaggctcctcatccatggtgcatcctccgagggcccaactaatactcccagcctaggtcaggtgcaggtggggtcgggtcagtgtcactctcaccatcagcacgcctgcagtctagaagtattttgacttagtttaacttactgttacagtctaagtagtgtacttaccgtcgtccctccgtaacttcggtttcggggaccgggtacaggctaacgggaaaacttacggaaagtaccgaaagtcgtacggctgaaccactatctgtcttacacgtttcccc

SEQ ID NO: 326486 - DNA, 535 bp, Homo sapiens
  misc_feature: GZ8MTXP02GG7L0.10.17.B06.1.454.CMB.2.raw
  modified_base (196)..(196): a, c, t, g, unknown or other
  misc_feature (196)..(196): n is a, c, g, or t
  modified_base (289)..(289): a, c, t, g, unknown or other
  misc_feature (289)..(289): n is a, c, g, or t
  modified_base (350)..(350): a, c, t, g, unknown or other
  misc_feature (350)..(350): n is a, c, g, or t
tcagcatagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaangtcaccctctcctgcagggccagtcagactattagtacaacttggcctggtaccagcataacctggccaggctccaggctcctcatccatggncatccctcgagggcccactaatactccccagcctaggttcagtggcaggtggggtcgggtnaggtagttcactctcaccatcagcagccctgcagtctaggaaagttattttgacttagtttattactgtcagtctagtatgataccgtgccctcgtactcgtttcgggaccgggaccagctaggtaaactacgaaacgacgtaacgtgtacggctgcctaccgattctgttcttctactttcccg

SEQ ID NO: 326487 - DNA, 501 bp, Homo sapiens
  misc_feature: GZ8MTXP02I8BKQ.10.17.B06.1.454.CMB.2.raw
  modified_base (273)..(273): a, c, t, g, unknown or other
  misc_feature (273)..(273): n is a, c, g, or t
  modified_base (404)..(404): a, c, t, g, unknown or other
  misc_feature (404)..(404): n is a, c, g, or t
  modified_base (454)..(454): a, c, t, g, unknown or other
  misc_feature (454)..(454): n is a, c, g, or t
tcagcatagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaagagtcaccctctcctgcagggccagtcagactattagtacaaacttggcctggtaccagcataactgcagctccagcnctcatccatgtgcatcctccaggccactaatatcccagccaggttcagtgcagtgggtcgggtcagagttcactctcaccatccagcagcctgcagtcagaagtatttgctagtttattctgtcagcagtntgatacgtggcctccgtactacgtttggccggggacagcgtacggaaacnctaacgacgaaactgtacggctgaactacactctgtcctcacttccc

SEQ ID NO: 326488 - DNA, 643 bp, Homo sapiens
  misc_feature: GZ8MTXP02HGYR9.10.17.B06.1.454.CMB.2.raw
  modified_base (197)..(197): a, c, t, g, unknown or other
  misc_feature (197)..(197): n is a, c, g, or t
  modified_base (301)..(301): a, c, t, g, unknown or other
  misc_feature (301)..(301): n is a, c, g, or t
tcagcatagtagtgcacgaccggtgctcgatttagtcgatagtgaagggggaggaactgctcagttaggacccagatggaaccatggaagccccagcgcagcttctcttcctcctgctactctggctcccagataccactggagaagtagtgatgacgcagtctccggccaccctgtctgtgtctccgaggggaaangtcaccctctcctgcagggccagtcagactattagacaaacttggcctggtaccagacaataaacctggccaggcctcccgaggcctcctcactccagtggtcnctactccctccgacgggcctaactaactactaccccagtcccgtaggtttccaggttggacccgtaggggtcggggtcggggtacaggtacgttcactcctacaccagtcacgcacgccctgactagtcgtagtaagttattttcgctttaagtttactacgtgttacgagtcgtaagttatcgtacgttacccgtcggtacccttccgttaacgttacgggttttccggggacccggggttaaacacggtacggtacgggaaaacttacggaaacggaccgtaaacgttcggtcggtaccgtcggacccaaccgttcgttccttcgttacctttactcccg

SEQ ID NO: 326489 - DNA, 500 bp, Homo sapiens
  misc_feature: GZ8MTXP02HURJ7.10.17.B06.1.454.CMB.2.raw
  modified_base (195)..(195): a, c, t, g, unknown or other
  misc_feature (195)..(195): n is a, c, g, or t
  modified_base (272)..(272): a, c, t, g, unknown or other
  misc_feature (272)..(272): n is a, c, g, or t
  modified_base (281)..(281): a, c, t, g, unknown or other
  misc_feature (281)..(281): n is a, c, g, or t
  modified_base (344)..(344): a, c, t, g, unknown or other
  misc_feature (344)..(344): n is a, c, g, or t
  modified_base (460)..(460): a, c, t, g, unknown or other
  misc_feature (460)..(460): n is a, c, g, or t
tcagcatagtagtgcacgaccggtgctcgatttagtcgatagtgaaggggaggaactgctcagttaggacccagacggaaccatggaagccccagcgcagcttctcttcctcctgctactctggctcccagataccactggagaagtagtgatgacgcagtctccggccaccctgtctgtgtctccaggggaaanagtcaccctctcctgcagggccagtcagactatagacaaactgcctggtacagcataaactggcagctccaggctcncatccatgncatcctcaggcccaataatactcccagccaggtcagtggcagtgggcgggtcagattcactcncaacatcagcagctgcagtctgaagtaattttgtctatttattaactgtgagatagtatagtatacgtcgtccgtccgtactacgttcggtacgggacgaacgacgtagtaaatanaacgacgacgtacgtcgtctgcacactctctcttctactc

SEQ ID NO: 326490 - DNA, 545 bp, Homo sapiens
  misc_feature: GZ8MTXP02F1B7X.10.17.B06.1.454.CMB.2.raw
  modified_base (195)..(195): a, c, t, g, unknown or other
  misc_feature (195)..(195): n is a, c, g, or t
tcagcatagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaanagtcaccctctcctgcagggccagtcagactattagtacaaacttggcctggtaccagcataaacctggccaggctcccaggctcctcatccatggtgcatccctccagggcccaactaatactccccagcccaggttccagtggcaggtggggtcggggtcaggtagttcacgtctcaccatccagcagccctgcagtctgaagtattttgcttagtttattactgtcagctagtatgtataccgtgtcctccgtacgtacgttttcgggcccggggtaaccacggtcgtaggaaattacgaacggacgtaacgtgtacggctgccacactctcgtctctactttcccg

SEQ ID NO: 326491 - DNA, 733 bp, Homo sapiens
  misc_feature: GZ8MTXP02JDNW5.10.17.B06.1.454.CMB.2.raw
tcagcatagtagtgcacgaccggtgctcgatttagtcgatagtgaagggggaggaactgctcagttaggacccagacggaaccatggaagccccagcgcagcttctcttcctcctgctactctggctcccagataccactggagaagtggtgatgacgcagtctccggccacctgtctgtgtctcgaagggaagagtccaccctctcctgcagggccagtcagactattagtacaacttggctggtaccagacaataaccgtggaccaggcctaccccgaggcctcctacactccagtcggtcgacctacttccccgtaccggaacggaccctaactaaactacctaccccgacgtaccgtaggttaccagggtcggacgtaggggttcggggtcggggtacaacggtacgttacctacgtccgtaccaactactacgacgtccaccggtccctagtaccgtagttacgtaaggttaaagtttacgtttagtaccgtttaaagttttacgttacgtacggttactaaggtacttaaaggttacgttacgtaaaccgtttcccggtaccgggtttaaccccttaccgggttaaccggttttaccggggtttaccgggggaaccccgggtaaaccgtaaggtacggtaaacggtaaacgtacggaaacggtaccgtaagttcggtacgtactacgaacctacgtacttacgttctaccttacgtaccctttcccg

SEQ ID NO: 326492 - DNA, 570 bp, Homo sapiens
  misc_feature: GZ8MTXP02JAUEK.10.17.B06.1.454.CMB.2.raw
  modified_base (195)..(195): a, c, t, g, unknown or other
  misc_feature (195)..(195): n is a, c, g, or t
  modified_base (438)..(438): a, c, t, g, unknown or other
  misc_feature (438)..(438): n is a, c, g, or t
tcagcatagtagtgcacgaccggtgctcgatttagtcgatagtgaaggggaggaactgctcagttaggacccagacggaaccatggaagccccagcgcagcttctcttcctcctgctactctggctcccagataccactggagaagtagtgatgacgcagtctccggccaccctgtctgtgtctccaggggaaanagtcaccctctcctgcagggccagtcagactattagtacaaacttggcctggtaccagcataaacctggccaggctcccaggcctcctcactccagtggtgcatccctcgaggccactaatactcccagccaggttcagtggcaggtcggggtcggggtcaggtgttcgacttctacacctatccgagcacgcctgctaagtctgaactattttgcttagtttattactgtacagtctaggtntagacttaccgtcggtcccttacgtacgttacgtttcggggccggggtaactacggcgttagggaaactcgaacggacgaacgttggtcgtcgtacgaacgaccttatcttagttccttacacgtttccccg

SEQ ID NO: 326493 - DNA, 664 bp, Homo sapiens
  misc_feature: GZ8MTXP02IR3NN.10.17.B06.1.454.CMB.2.raw
  modified_base (196)..(196): a, c, t, g, unknown or other
  misc_feature (196)..(196): n is a, c, g, or t
  modified_base (295)..(295): a, c, t, g, unknown or other
  misc_feature (295)..(295): n is a, c, g, or t
tcagcatagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaanagtcaccctctcctgcagggccagtcagactattagtacaaacttggcctggtaccagcataaacctggccaggctcccaggcctcctcatccatggtncatccctcagggcccataatatcccagccaggttcagtggcaggtggggtcggggtcaggtagttccacttccgtcacccgtactacgacgcgacgtccgtcgacgtacgtacgtagtaagtttagtttacgtacgtttaacgttttactttacgttacgttacgtaccgtagttaagttacgttagtaccttacggtacccgtcccgttaccgttaaccgtttaccgggtttaccggggtacccggggtaacgtacggtacggttaacggtaaacgtacggaaacgtacggtaaaacggttcgggtacgtaccgtacgtaacctaccgtacgttaccgttacgttaccttacgttacccttttccccg

SEQ ID NO: 326494 - DNA, 614 bp, Homo sapiens
  misc_feature: GZ8MTXP02JX9N8.10.17.B06.1.454.CMB.2.raw
  modified_base (196)..(196): a, c, t, g, unknown or other
  misc_feature (196)..(196): n is a, c, g, or t
  modified_base (279)..(279): a, c, t, g, unknown or other
  misc_feature (279)..(279): n is a, c, g, or t
  modified_base (290)..(290): a, c, t, g, unknown or other
  misc_feature (290)..(290): n is a, c, g, or t
tcagcatagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaangtcaccctctcctgcagggccagtcagactatagtacaaacttggcctggtaccagcataacctggccaggctccaggcctcncatccatggtncatccctcgaggccataactactcccagcctaggttcaggtggctaggtggggtcggggtcaggtagttccactcctcacctatcagcagccctagcagtctagtagtatttgcttagtttatctagttcagtctagtatgtacttaccgtcggtacccttaccggtacttacgggtttcggggacccgggggtaactaacgggtccgttaaaggggaaaacttaccggaaacggtaccggtaaacgttcggggtacggtccttacgggtaacccaaccggttacttacggttacgtttcctttaccgtaaccttttcccccgg

SEQ ID NO: 326495 - DNA, 527 bp, Homo sapiens
  misc_feature: GZ8MTXP02FNNOO.10.17.B06.1.454.CMB.2.raw
  modified_base (196)..(196): a, c, t, g, unknown or other
  misc_feature (196)..(196): n is a, c, g, or t
  modified_base (347)..(347): a, c, t, g, unknown or other
  misc_feature (347)..(347): n is a, c, g, or t
  modified_base (359)..(359): a, c, t, g, unknown or other
  misc_feature (359)..(359): n is a, c, g, or t
tcagcatagtagtgcacgaccggtgctcgatttagtcgatagtgaaggggaggaactgctcagttaggacccagacggaaccatggaagccccagcgcagcttctcttcctcctgctactctggctcccagataccactggagaagtagtgatgacgcagtctccggccaccctgtctgtgtctccgaggggaaangtcaccctctcctgcagggccagtcagactattagtacaaacttggcctggtaccagcataaacctggccaggctcccaggctcctcatccatggtgcatcctccgaggccactaactatcccagccagttcagtggcaggtgggtcggtnagagttcactcncacatcagcagcctgcagtctagaagtatttgctagtttattactgtacagctagtactgataccgtggtccctacgtactacgtttcgggccgggggtaaccaaggtctaggaaatccgaagacgaacgtgtacggctacgctaccgatctacgtcttacatttccc

SEQ ID NO: 326496 - DNA, 582 bp, Homo sapiens
  misc_feature: GZ8MTXP02H5JKT.10.17.B06.1.454.CMB.2.raw
  modified_base (196)..(196): a, c, t, g, unknown or other
  misc_feature (196)..(196): n is a, c, g, or t
  modified_base (257)..(257): a, c, t, g, unknown or other
  misc_feature (257)..(257): n is a, c, g, or t
  modified_base (266)..(266): a, c, t, g, unknown or other
  misc_feature (266)..(266): n is a, c, g, or t
  modified_base (271)..(271): a, c, t, g, unknown or other
  misc_feature (271)..(271): n is a, c, g, or t
  modified_base (280)..(280): a, c, t, g, unknown or other
  misc_feature (280)..(280): n is a, c, g, or t
  modified_base (354)..(354): a, c, t, g, unknown or other
  misc_feature (354)..(354): n is a, c, g, or t
  modified_base (387)..(387): a, c, t, g, unknown or other
  misc_feature (387)..(387): n is a, c, g, or t
tcagcatagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccgaggggaanagtccaccctctcctgcagggccagtcagactatagtacaacttgctggaccagcataacngcagctccngctcncatccatgngcatcctcgacggccactaatactcccagtccaggtcaggtcggcaggtggggtcgggtacagtacgtcactcncaccatcacgcagccctgcagtcgtagtaagtnttttacgcttaagtttaacttacgtgttcagtacgtagttacgtgtactaccggtcgtcccgttaccgtacgtttacggtttcgggacccgggggtaactacggtacgtaacggtaaaacgtcgaaacggtcgtaaacgttcggtcgtacgtcggaaccacgtaactccgtttacgtcctttctaactttccccg

SEQ ID NO: 326497 - DNA, 518 bp, Homo sapiens
  misc_feature: GZ8MTXP02JOMJ9.10.17.B06.1.454.CMB.2.raw
  modified_base (138)..(138): a, c, t, g, unknown or other
  misc_feature (138)..(138): n is a, c, g, or t
  modified_base (195)..(195): a, c, t, g, unknown or other
  misc_feature (195)..(195): n is a, c, g, or t
  modified_base (204)..(204): a, c, t, g, unknown or other
  misc_feature (204)..(204): n is a, c, g, or t
  modified_base (279)..(279): a, c, t, g, unknown or other
  misc_feature (279)..(279): n is a, c, g, or t
  modified_base (344)..(344): a, c, t, g, unknown or other
  misc_feature (344)..(344): n is a, c, g, or t
  modified_base (500)..(500): a, c, t, g, unknown or other
  misc_feature (500)..(500): n is a, c, g, or t
tcagcatagtagtgcacgaccggtgctcgatttagtcgatagtgaagggggaggaactgctcagttaggacccagacggaaccatggaagccccagcgcagcttctcttcctcctgctactctggctcccagataccnctggagaagtagtgatgacgcagtctccggccaccctgtctgtgtctcaggggaaangtcaccctntcctgcagggccagtcagactattagtacaacttggcctggtaccagcataaacctggccaggctccaggctccncatccatcgtgcatcctcagggccactaatactcccagccaggtcagtggcaggtggggtcgggnagagttcgactctcaccatcagcagctgcagtctgaagtatttgctagtttacgttactgtcagcagtatgtatacctgcctcgtacctacgttttcgggaccggggtacaacgacgttagaaacgtacaacgacggtacacgtcgctagcgaacnctctcgtctactctcccg

SEQ ID NO: 326498 - DNA, 578 bp, Homo sapiens
  misc_feature: GZ8MTXP02FKXBW.10.17.B06.1.454.CMB.2.raw
  modified_base (197)..(197): a, c, t, g, unknown or other
  misc_feature (197)..(197): n is a, c, g, or t
  modified_base (408)..(408): a, c, t, g, unknown or other
  misc_feature (408)..(408): n is a, c, g, or t
tcagcatagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccgaggggaaanagtcaccctctcctgcagggccagtcagactattagtacaaacttggcctggtaccagcaataaaccgtggccaggctcccaggcctcctcactccatggtgcactccctccgaggccaactaactactcccagcctaggttcagtggctaggtggggtcggggtcagagttccactctcaccatcagcacgcctgcagttctagtaagtnttttggcttagtttaattctgtcagctagtatgtactaccgtcgtcccttacgtactacggtttcgggaccggggtaactaacgcgtaacggaactacgaaacgacgtaaacgtcggtacgtctacggaacctaccgtacgtaccttacgttccttactacgtttccccg

SEQ ID NO: 326499 - DNA, 640 bp, Homo sapiens
  misc_feature: GZ8MTXP02FRRFC.10.17.B06.1.454.CMB.2.raw
tcagcatagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccacctgtctgtgtctccgaggggaagagtcaccctctcctgcagggccagtcagactattagtaacaaacttggcctggtaccagcaataaacctggccaggcctccaggcctcctcactccatggtgcactccctcgacgggcccaactaatactcccagtccgtaggttcaggtggcgacggtggggtcggggtgagtagttcgactcgccacctataccgagtcacgccgtcgacgtagtcgtagtaaagttagttttaggactttaagttttacttaccgttagtcctagtacgtaagttagtaggtactaccgtacgtcccgtaccgttacgttacggtttcggggacccggggtaacctaacggtcgtaacggtaaacgtacgaaacggacgtaaacggtcggtcgggcgttaccgaaccgtaacctacgtttcgttaccgttactttacctaacggtttccccg

SEQ ID NO: 326500 - DNA, 571 bp, Homo sapiens
  misc_feature: GZ8MTXP02GM7BL.10.17.B06.1.454.CMB.2.raw
  modified_base (196)..(196): a, c, t, g, unknown or other
  misc_feature (196)..(196): n is a, c, g, or t
  modified_base (290)..(290): a, c, t, g, unknown or other
  misc_feature (290)..(290): n is a, c, g, or t
  modified_base (352)..(352): a, c, t, g, unknown or other
  misc_feature (352)..(352): n is a, c, g, or t
tcagcatagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaanagtccaccctctcctgcagggccagtcagactatagtacaacttggcctggaccagcataaactggccaggctccaggctcctcatccatggtncatccctcgaggccactaatactcccagccgtaggttcaggtggcaggtggggtccggggtnaggtagttccactctcacatcgagcagcctgctacgtctaggtaagtattttcgacttagttttacttactgtctagctagtatagtataccgtcggtacccttccgtacgttacgtttcggggacccggggtacaacggtcgtacggaaacttacgaaacgtacgtaacgtcggtacgctcggaaccacgtattcgtcgttcctacgtactttccccg

SEQ ID NO: 326501 - DNA, 647 bp, Homo sapiens
  misc_feature: GZ8MTXP02FVKWS.10.17.B06.1.454.CMB.2.raw
  modified_base (195)..(195): a, c, t, g, unknown or other
  misc_feature (195)..(195): n is a, c, g, or t
  modified_base (279)..(279): a, c, t, g, unknown or other
  misc_feature (279)..(279): n is a, c, g, or t
  modified_base (289)..(289): a, c, t, g, unknown or other
  misc_feature (289)..(289): n is a, c, g, or t
  modified_base (333)..(333): a, c, t, g, unknown or other
  misc_feature (333)..(333): n is a, c, g, or t
  modified_base (348)..(348): a, c, t, g, unknown or other
  misc_feature (348)..(348): n is a, c, g, or t
  modified_base (637)..(637): a, c, t, g, unknown or other
  misc_feature (637)..(637): n is a, c, g, or t
tcagcatagtagtgcacgaccggtgctcgatttagtcgatagtgaaggggaggaactgctcagttaggacccagacggaaccatggaagccccagcgcagcttctcttcctcctgctactctggctcccagataccactggagaagtagtgatgacgcagtctccggccaccctgtctgtgtctccgaggggaangtcaccctctcctgcagggccagtcagactattagtacaaactggcctggtaccagcaataacctggccaggctccaggctccncatccatggngcactcctacgaggccactaatactcccagccaggtcagtggcnggtcggggtcggtanaggacgttccacgtctaccaccgatccgagacctacgccttgacgtacggtacgtaaggtaaagtttagtttttacgacgtttaaaggtttttaactttaaccgttgttacggaagtaccgttaagttaacgtacggtaaccttaacccggttccggtacccgttaccgttaaccgttaccgggttttaccgggggacccggggtaacgtaacggtacggtaaaacggtagtaacgaaacggtacgtaacgtcgggtcgtacgtcgaactactagtcgttctcttaccnctttaccccg

SEQ ID NO: 326502 - DNA, 538 bp, Homo sapiens
  misc_feature: GZ8MTXP02GC4PC.10.17.B06.1.454.CMB.2.raw
  modified_base (197)..(197): a, c, t, g, unknown or other
  misc_feature (197)..(197): n is a, c, g, or t
  modified_base (255)..(255): a, c, t, g, unknown or other
  misc_feature (255)..(255): n is a, c, g, or t
  modified_base (393)..(393): a, c, t, g, unknown or other
  misc_feature (393)..(393): n is a, c, g, or t
  modified_base (404)..(404): a, c, t, g, unknown or other
  misc_feature (404)..(404): n is a, c, g, or t
  modified_base (524)..(524): a, c, t, g, unknown or other
  misc_feature (524)..(524): n is a, c, g, or t
tcagcatagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccgaggggaaanagtcaccctctcctgcagggccagtcagactatagtacaacttggcctggaccagcanaaacctggccaggctcccaggctcctcatccatggtgcactccctccgagggcccaactaatactcccagccctaaggtcagtggcaggttcggggtcggggtcagtagttccacgtctcaccatcagcacgcctgcngtctagaagtntttgctagtttattactgtcagtcagttatagactaccgtggccctacgttactacgttttcggggaccggggacctaagtcgtaaggaaactcgaacgacgaacgtgacgctgcaactntctctctctctccg

SEQ ID NO: 326503 - DNA, 618 bp, Homo sapiens
  misc_feature: GZ8MTXP02ILJ1A.10.17.B06.1.454.CMB.2.raw
  modified_base (196)..(196): a, c, t, g, unknown or other
  misc_feature (196)..(196): n is a, c, g, or t
  modified_base (205)..(205): a, c, t, g, unknown or other
  misc_feature (205)..(205): n is a, c, g, or t
  modified_base (293)..(293): a, c, t, g, unknown or other
  misc_feature (293)..(293): n is a, c, g, or t
  modified_base (359)..(359): a, c, t, g, unknown or other
  misc_feature (359)..(359): n is a, c, g, or t
  modified_base (403)..(403): a, c, t, g, unknown or other
  misc_feature (403)..(403): n is a, c, g, or t
tcagcatagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccgaggggaangtcaccctntcctgcagggccagtcagacttattagtacaacttggcctggtaccagcaataaacctggccaggctcccaggctcctcatccatggncactcctccacggggcccactaactactcccagcctaggttcaggtggcagggtggggtcggggtnaggtgttcactctcacctatccagcagcctgcagtctgaagttnttttgacttagtttatactgtcaggtcagttatcgtacttaccgtcggtccttaccgttacgttaccggttttcgggggacccgggggtaacctaacggcgttaagggtaaaactggaaacggtacgtaaaccggttggtacggggtcccttacggaacccgtaaacctaccgtttccggttacgttacccttttaccgtaccgttttacccccg

SEQ ID NO: 326504 - DNA, 578 bp, Homo sapiens
  misc_feature: GZ8MTXP02HGYM9.10.17.B06.1.454.CMB.2.raw
  modified_base (195)..(195): a, c, t, g, unknown or other
  misc_feature (195)..(195): n is a, c, g, or t
  modified_base (278)..(278): a, c, t, g, unknown or other
  misc_feature (278)..(278): n is a, c, g, or t
  modified_base (285)..(285): a, c, t, g, unknown or other
  misc_feature (285)..(285): n is a, c, g, or t
  modified_base (287)..(287): a, c, t, g, unknown or other
  misc_feature (287)..(287): n is a, c, g, or t
  modified_base (304)..(304): a, c, t, g, unknown or other
  misc_feature (304)..(304): n is a, c, g, or t
  modified_base (351)..(351): a, c, t, g, unknown or other
  misc_feature (351)..(351): n is a, c, g, or t
  modified_base (355)..(355): a, c, t, g, unknown or other
  misc_feature (355)..(355): n is a, c, g, or t
  modified_base (365)..(365): a, c, t, g, unknown or other
  misc_feature (365)..(365): n is a, c, g, or t
tcagcatagtagtgcacgaccggtgctcgatttagtcgatagtgaaggggaggaactgctcagttaggacccagacggaaccatggaagccccagcgcagcttctcttcctcctgctactctggctcccagataccactggagaagtagtgatgacgcagtctccggccaccctgtctgtgtctccaggggaaangtccaccctctcctgcagggccagtcagactattagtacaacttggcctggtaccagcataaacctggccaggctccagctcnatcatgncntcctcgaggccactaanactcccagcaggtcagtgcgaggtgggtcgggtcagtagttcactcncacntcagcacgcngcagtcagtattatttgactaagtttatacgtgtacagctaagttatgtacttaccgtgacccttaccggttaacgttccggtttcgggggacccggggtaaacgaacgtcgtaaaacgggtaacgtacggaaacgtacccggtaaagtcgggtacgtccgttacggaacccgtactacgttcgttacggttcctttaacctctttacccccg

SEQ ID NO: 326505 - DNA, 666 bp, Homo sapiens
  misc_feature: GZ8MTXP02JREHI.10.17.B06.1.454.CMB.2.raw
  modified_base (195)..(195): a, c, t, g, unknown or other
  misc_feature (195)..(195): n is a, c, g, or t
  modified_base (276)..(276): a, c, t, g, unknown or other
  misc_feature (276)..(276): n is a, c, g, or t
tcagcatagtagtgcacgaccggtgctcgatttagtcgatagtgaaggggaggaactgctcagttaggacccagacggaaccatggaagccccagcgcagcttctcttcctcctgctactctggctcccagataccactggagaagtagtgatgacgcagtctccggccaccctgtctgtgtctccaggggaaangtccaccctctcctgcagggccagtcagactattagtacaaacttggctggtaccagcataacctgcaggctccagctctnatccatggtgcatcctccgaggccaacgtaatactcccagtcctagttccgaggtggcgagggtcggggtccggggtacaggtacgtactactccgtcaacctacgtcaacgcaacgtcccgtacgtaccgtacgttaccgtaggtaaagttacgtttttcggacctttaaggttttaacttacgttacgtaccgtaagggtaccttaagtaacggttacgtaacgttaacccggtcggttaccccgttaccgttaaccgttaccgggtttttaccggggacccggggtaaccgtaaggcccgttaaggaaacgttacgaaacggtacgtaacgtacgtacggtcgtacgaaccgtacctacgtcgtcgttacctacctacgtttccccg

SEQ ID NO: 326506 - DNA, 624 bp, Homo sapiens
  misc_feature: GZ8MTXP02HWER7.10.17.B06.1.454.CMB.2.raw
  modified_base (194)..(194): a, c, t, g, unknown or other
  misc_feature (194)..(194): n is a, c, g, or t
  modified_base (206)..(206): a, c, t, g, unknown or other
  misc_feature (206)..(206): n is a, c, g, or t
  modified_base (274)..(274): a, c, t, g, unknown or other
  misc_feature (274)..(274): n is a, c, g, or t
  modified_base (283)..(283): a, c, t, g, unknown or other
  misc_feature (283)..(283): n is a, c, g, or t
  modified_base (290)..(290): a, c, t, g, unknown or other
  misc_feature (290)..(290): n is a, c, g, or t
tcagcatagtagtgcacgaccggtgctcgatttagtcgatagtgaagggggaggaactgctcagttaggacccagacggaaccatggaagccccagcgcagcttctcttcctcctgctactctggctcccagataccatggagaagtagtgatgacgcagtctccggccacctgtctgtgtctccgaggggaangtcacctctccngcaggccagtcagacttatagtacaacttggcctggtaccagcaataacctggccaggctccagctcncatccatgngcatccncaggccataacactcccagccgagtcagtggctaggtggggtcggggtcaggtagttccactctcaacctatccaagcagcctgacagtacgtagaagtagtttttacgacttagtttagttacgtgtacgtaatcgtaagttacgttagtaacgtaccgtccggtaccgttacccgttaaccgttaccggttttcggggacccgggggtaaacccgtaagggttaacggtaacgtaaaacggtacgaacgtaaaccggtaacgttcgggtacgtcgtaccgaaccttacgtaacgtttccgtacggttacctttacgtaacccgtttcccccg

SEQ ID NO: 326507 - DNA, 604 bp, Homo sapiens
  misc_feature: GZ8MTXP02GE8J5.10.17.B06.1.454.CMB.2.raw
  modified_base (195)..(195): a, c, t, g, unknown or other
  misc_feature (195)..(195): n is a, c, g, or t
tcagcatagtagtgcacgaccggtgctcgatttagtcgatagtgaaggggaggaactgctcagttaggacccagacggaaccatggaagccccagcgcagcttctcttcctcctgctactctggctcccagataccactggagaagtagtgatgacgcagtctccggccaccctgtctgtgtctccaggggaaangtcaccctctcctgcagggccagtcagactattagtacaaacttggcctggtaccagcataaacctggccaggctcccaggcctcctcactccatggtgcatccctccagggccactaatactcccagccaggtcagtcggctaggtggggtcggggtcaggacgttcactcctacaccatcagcagccctgctagtctagaagttatttgacttagtttattactgtacgagtctaagttgttagaactaccgtcggtacccgttccgtaccgttacgttttcggggacccgggggtaacctaacggtccgttaagggtaaaaccgtagaaacggtacgtaacgttacgggtcggaccgttcggaacctaccgtacgttccggtagtttccttacttactttcccccg

SEQ ID NO: 326508 - DNA, 623 bp, Homo sapiens
  misc_feature: GZ8MTXP02HNG1J.10.17.B06.1.454.CMB.2.raw
  modified_base (193)..(193): a, c, t, g, unknown or other
  misc_feature (193)..(193): n is a, c, g, or t
  modified_base (464)..(464): a, c, t, g, unknown or other
  misc_feature (464)..(464): n is a, c, g, or t
tcagcatagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccgaccaccctgtctgtgtctcagggaangtcacctctcctgcagggccagtcagactattagtacaaacttcggcctggtaccagcaataacctggaccacggcctcccgaggtcctcctcacttccagtggtcgcactcccctccgacgggaccctaactaataccttaccccgaagtccgtacggtttaccgaggtcggaccgtagggttcggggtccgggttcgagtacgttccactcctccaacgtctaccagccgacgtcccgtgactaggttctaagtagtttattttacggntttaagtttacgttactgtacagtagtagttatggtactccgtacgtcccgttaaccgtacgttacggtttcggggaccgggaccgtagccgtaggtaaactgaaacgtcggtaacgtggcgttcgcgaacctaccgttcttctcgttctccttctccg

SEQ ID NO: 326509 - DNA, 805 bp, Homo sapiens
  misc_feature: GZ8MTXP02IZG65.10.17.B06.1.454.CMB.2.raw
  modified_base (196)..(196): a, c, t, g, unknown or other
  misc_feature (196)..(196): n is a, c, g, or t
  modified_base (280)..(280): a, c, t, g, unknown or other
  misc_feature (280)..(280): n is a, c, g, or t
tcagcatagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccacctgtctgtgtctccgaggggaaangtccaccctctcctgcagggccagtcagtactattagtaacaacttggcctggtacagcaataaccgtgcaggctccagctccncactccagtgtgcactccgtccgacgggaccctaacgtaactaccgtaccccgtaacggcccgtaacgggtttcctaaagggtccggggtacgtaacggggtttccgggggggttacccggggggtttaacgaaacggggttaaccggggttttacccctacccgttacccgttacccggaaaccccttaaacgttaccccgaaacggttacccgaaaccgggttacccccgtacgggtacccttaacggggttacgttaaccgggtaaaaggtttaagtttttacccggttagtttaaacgttttttaaacggtttaaccttcgggttacgtaaaccggtacggttaaaccggtaagtttacgtacgttaaccccggttacggtaccccgttacccgttacccgtttacggtttccgggggtaacccgggggtaacctaacggtaccgtaggtaaaacgtcgaaagtcgtaaacgttgacgtctcgaacctaacgtcttacgtcgttccttacgtctttccccg

SEQ ID NO: 326510 - DNA, 579 bp, Homo sapiens
  misc_feature: GZ8MTXP02H1R52.10.17.B06.1.454.CMB.2.raw
  modified_base (197)..(197): a, c, t, g, unknown or other
  misc_feature (197)..(197): n is a, c, g, or t
  modified_base (263)..(263): a, c, t, g, unknown or other
  misc_feature (263)..(263): n is a, c, g, or t
  modified_base (280)..(280): a, c, t, g, unknown or other
  misc_feature (280)..(280): n is a, c, g, or t
  modified_base (283)..(283): a, c, t, g, unknown or other
  misc_feature (283)..(283): n is a, c, g, or t
  modified_base (288)..(288): a, c, t, g, unknown or other
  misc_feature (288)..(288): n is a, c, g, or t
  modified_base (294)..(294): a, c, t, g, unknown or other
  misc_feature (294)..(294): n is a, c, g, or t
  modified_base (307)..(307): a, c, t, g, unknown or other
  misc_feature (307)..(307): n is a, c, g, or t
  modified_base (309)..(309): a, c, t, g, unknown or other
  misc_feature (309)..(309): n is a, c, g, or t
  modified_base (319)..(319): a, c, t, g, unknown or other
  misc_feature (319)..(319): n is a, c, g, or t
  modified_base (324)..(324): a, c, t, g, unknown or other
  misc_feature (324)..(324): n is a, c, g, or t
  modified_base (336)..(336): a, c, t, g, unknown or other
  misc_feature (336)..(336): n is a, c, g, or t
tcagcatagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccgaaggggaangtccaccctctcctgcagggccagtcagtactattagtacaaattggctggtaccagcaataaccnggcaggctccagctccncancatgncatccncgaggccactaancnccagctagtnagtgntaggtggtcggnagtgtcactctcacatcagcagccctgctagtcgtagaacgttagttttagtacttagttttatacgtttgtacaacgtactagttagtacgtaactaccggttcgtacccgttacgtactttaccgggtttacgggacccgggggtaacaacggacgttaacggaaacttacgaaacgtaccggaagttcggacgtcgtcgaaccgtactaacttccgttattaccttcctacgtttccccg

SEQ ID NO: 326511 - DNA, 751 bp, Homo sapiens
  misc_feature: GZ8MTXP02I9ZBQ.10.17.B06.1.454.CMB.2.raw
  modified_base (193)..(193): a, c, t, g, unknown or other
  misc_feature (193)..(193): n is a, c, g, or t
  modified_base (202)..(202): a, c, t, g, unknown or other
  misc_feature (202)..(202): n is a, c, g, or t
tcagcatagtagtgcacgaccggtgctcgatttagtcgatagtgaagggggaggaactgctcagttaggacccagacggaaccatggaagccccagcgcagcttctcttcctcctgctactctggctccagataccactggagaagtagtgatgacgcagtctccggccacctgtctgtgtctcgaggggaangtccacctntctgcgaggccagtcagtactattagtactaaacgttggacctggtaaccagactaataaccgtggccaggcctcccgagcctcctcatcccagtcggtgcctactcccgtaccgacgggaccctaacgttaaactactaccccgacgtacccgtaggttaccgaggtcggacgtaccggggttgggggtccggggtacaagggtacgttaccgacttcgtaccaaccgtataccgacgtactaacggtccgttggaccttaaacggttacgtaaggtaaagtttacgtttttacggaaccgtttaaggtttttaaacctttacggacggtttaacctaaaaggtccgtttaaaggtaacgttaccggtaacctttacccggtcggttaccccgtacccggttaccggtttaaccggtttacgggggaccccggggtaaacgtaaacggtcggttaaaacggtaaacgtacgtaaacggtaccgtaaaggtcggtacggacgtaacgccgaacttacgtccgtacgttaccttaccgactttacccccg

SEQ ID NO: 326512 - DNA, 569 bp, Homo sapiens
  misc_feature: GZ8MTXP02IBR0E.10.17.B06.1.454.CMB.2.raw
  modified_base (398)..(398): a, c, t, g, unknown or other
  misc_feature (398)..(398): n is a, c, g, or t
  modified_base (445)..(445): a, c, t, g, unknown or other
  misc_feature (445)..(445): n is a, c, g, or t
  modified_base (527)..(527): a, c, t, g, unknown or other
  misc_feature (527)..(527): n is a, c, g, or t
  modified_base (541)..(541): a, c, t, g, unknown or other
  misc_feature (541)..(541): n is a, c, g, or t
tcagcatagtagtgcacgaccggtgctcgatttagtcgatagtgaaggggaggaactgctcagttaggacccagacggaaccatggaagccccagcgcagcttctcttcctcctgctactctggctcccagataccactggagaagtagtgatgacgcagtctccggccaccctgtctgtgtctccgagggaagagtcaccctctcctgcagggccagtcagactattagtacaacttggcctggtacagacaataaacctggcaggctccaggcctctcatccatcggtacactcctccgaggcccaactaatactccccagcctaggttcaaggtcgggctagggtacggggtcggggtcagtaggttcaccgtctcaccctatccagcacgcctnctagtctgtaacgtatttgacttagtttattactgtcagtctagttntacgtataccgtgggacccttcggtaacttcggtttcggggacccgggtacaagtcgaaggtaaactcgaagtacgtaacgnggtacgcgtcgacncgtatactcgttctcgacttcctacccg

SEQ ID NO: 326513 - DNA, 554 bp, Homo sapiens
  misc_feature: GZ8MTXP02JVSYY.10.17.B06.1.454.CMB.2.raw
  modified_base (196)..(196): a, c, t, g, unknown or other
  misc_feature (196)..(196): n is a, c, g, or t
  modified_base (348)..(348): a, c, t, g, unknown or other
  misc_feature (348)..(348): n is a, c, g, or t
  modified_base (363)..(363): a, c, t, g, unknown or other
  misc_feature (363)..(363): n is a, c, g, or t
  modified_base (371)..(371): a, c, t, g, unknown or other
  misc_feature (371)..(371): n is a, c, g, or t
  modified_base (422)..(422): a, c, t, g, unknown or other
  misc_feature (422)..(422): n is a, c, g, or t
tcagcatagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccgaggggaanagtcacctctcctgcagggccagtcagactatagtacaacttggcctggtaccagcataaacctggccaggctccaggctctcatccatggtgcatcctcagggccactaatactcccagccaggttcaggtggcacggtggggtcggggtnaggagttcacgtccncacatcancagcctgcagtctagaagtatttgactagtttattactgtcaagctaagtntgactaccgtgtcctaccgtactacggttttacgggccggggtacaaagcgttacggaaatcgaacggtacgtaaacgtcggtcggtactcggtaaccgtactagttccttcgtcctttacactttcccccg

SEQ ID NO: 326514 - DNA, 507 bp, Homo sapiens
  misc_feature: GZ8MTXP02HT66R.10.17.B06.1.454.CMB.2.raw
  modified_base (193)..(193): a, c, t, g, unknown or other
  misc_feature (193)..(193): n is a, c, g, or t
  modified_base (202)..(202): a, c, t, g, unknown or other
  misc_feature (202)..(202): n is a, c, g, or t
  modified_base (249)..(249): a, c, t, g, unknown or other
  misc_feature (249)..(249): n is a, c, g, or t
  modified_base (253)..(253): a, c, t, g, unknown or other
  misc_feature (253)..(253): n is a, c, g, or t
  modified_base (259)..(259): a, c, t, g, unknown or other
  misc_feature (259)..(259): n is a, c, g, or t
  modified_base (267)..(267): a, c, t, g, unknown or other
  misc_feature (267)..(267): n is a, c, g, or t
  modified_base (272)..(272): a, c, t, g, unknown or other
  misc_feature (272)..(272): n is a, c, g, or t
  modified_base (275)..(275): a, c, t, g, unknown or other
  misc_feature (275)..(275): n is a, c, g, or t
  modified_base (283)..(283): a, c, t, g, unknown or other
  misc_feature (283)..(283): n is a, c, g, or t
  modified_base (293)..(293): a, c, t, g, unknown or other
  misc_feature (293)..(293): n is a, c, g, or t
  modified_base (321)..(321): a, c, t, g, unknown or other
  misc_feature (321)..(321): n is a, c, g, or t
  modified_base (351)..(351): a, c, t, g, unknown or other
  misc_feature (351)..(351): n is a, c, g, or t
  modified_base (361)..(361): a, c, t, g, unknown or other
  misc_feature (361)..(361): n is a, c, g, or t
  modified_base (384)..(384): a, c, t, g, unknown or other
  misc_feature (384)..(384): n is a, c, g, or t
  modified_base (387)..(387): a, c, t, g, unknown or other
  misc_feature (387)..(387): n is a, c, g, or t
  modified_base (389)..(389): a, c, t, g, unknown or other
  misc_feature (389)..(389): n is a, c, g, or t
tcagcatagtagtgcacgaccggtgctcgatttagtcgatagtgaagggggaggaactgctcagttaggacccagacggaaccatggaagccccagcgcagcttctcttcctcctgctactctggctccagataccactggagaagtagtgatgacgcagtctccggccacctgtctgtgtctcgaggggaangtcaccctntcctgcagggccagtcagtactattagacaacttggctggacagcanaacngcagcnccagctcnatcangtncatctcgnggcataatcncccagccagtcagtgcagtggtacggtnagtagttcatctcacagtccagcagttccngctagtctanaagtacttttgatatttacttantananatagtatagtactacgtcgtcgtacgtacgtacgttacggtacggacgtacgtacgtacgtaacgtacgacgacgtacgtacgtacgtcgacgaacgtactactctctctactactcg

SEQ ID NO: 326515 - DNA, 570 bp, Homo sapiens
  misc_feature: GZ8MTXP02IXPD8.10.17.B06.1.454.CMB.2.raw
  modified_base (195)..(195): a, c, t, g, unknown or other
  misc_feature (195)..(195): n is a, c, g, or t
  modified_base (255)..(255): a, c, t, g, unknown or other
  misc_feature (255)..(255): n is a, c, g, or t
  modified_base (268)..(268): a, c, t, g, unknown or other
  misc_feature (268)..(268): n is a, c, g, or t
  modified_base (270)..(271): a, c, t, g, unknown or other
  misc_feature (270)..(271): n is a, c, g, or t
  modified_base (276)..(276): a, c, t, g, unknown or other
  misc_feature (276)..(276): n is a, c, g, or t
  modified_base (278)..(278): a, c, t, g, unknown or other
  misc_feature (278)..(278): n is a, c, g, or t
  modified_base (283)..(283): a, c, t, g, unknown or other
  misc_feature (283)..(283): n is a, c, g, or t
  modified_base (312)..(312): a, c, t, g, unknown or other
  misc_feature (312)..(312): n is a, c, g, or t
  modified_base (353)..(353): a, c, t, g, unknown or other
  misc_feature (353)..(353): n is a, c, g, or t
tcagcatagtagtgcacgaccggtgctcgatttagtcgatagtgaaggggaggaactgctcagttaggacccagacggaaccatggaagccccagcgcagcttctcttcctcctgctactctggctccagataccactggagaagtagtgatgacgcagtctccggccacctgtctgtgtctccgaaggggaaangtcacctctctgcagggccagtcagactattagtacaacttggcttggaccagcataacngcagctcagctcncnncatgncnctccncgaggccataatctacccagcctgtcagnggcaggtggggtcgggtcaaggtgttccaactcgtacactntacagctcgactcgcagtcaggaatttagtttcgacgtttaagtttacgttacctagttaccgagtacgtaaacgtattcggaacttcgtcggtccctaaccggtcttacggtttcggggaccgggtaactgggacgttaaggaaaactcgaaacggactaacgtcggtacgacttacgcccaaagttaccgtcttctcccttaacgactttccccg

SEQ ID NO: 326516 - DNA, 523 bp, Homo sapiens
  misc_feature: GZ8MTXP01CEPH1.44.53.E09.1.454.CMB.2.raw
  modified_base (298)..(298): a, c, t, g, unknown or other
  misc_feature (298)..(298): n is a, c, g, or t
tcagacagtatatacacgaccggtgctcgatttagagagagtgtgttgggtttgggggtcacaagaggcagcgctctcgggacgtctccaccatggcctgggctctgctgctcctcactctcctcacccaggacacagggtcctgggcccagtctgccctgactcagcctgcctccgtgtctgggtcgactggacagtcggtcaccatctcctgcactggaaaccaacagtgacgtcggtcgtttgaccgtgtctctggtaccagcagaccccagaaacagccccaaatcattattangcgtcaatgtcgccttcggtgtccctgagcgcttctctgggtccccaagtctggcaacaacggccctccctgaccatctctgggctccaggctggaggacgaggctgattatactgcagctcatataacaagtggaactactttactattcggcgtcagggaccaaggctgaccgtccttaggtcagcccgaggcctgcccctggtccacttctcgttccccgcc

SEQ ID NO: 326517 - DNA, 650 bp, Homo sapiens
  misc_feature: GZ8MTXP01EFYZH.44.53.E09.1.454.CMB.2.raw
  modified_base (273)..(273): a, c, t, g, unknown or other
  misc_feature (273)..(273): n is a, c, g, or t
  modified_base (482)..(483): a, c, t, g, unknown or other
  misc_feature (482)..(483): n is a, c, g, or t
tcagacagtatatacacgaccggtgctcgatttagagagagtgtgttgggtttgggggaagcacctgtggttcttcctcctgctggtggcggctcccagatgggtcctgtctcagccgcagctgcgggagtcgggcccaggactggtgaagccttcggagaccctgtccctcacgtgcacggtctctggtgcctccatcgacagaagtaattctactgggctggatccgccagccccaggagagggctgcagtggattgggagtctcgttaantagtagtacggaactacctacctacctaacccgtacccgtacgaacgtacgacgtacacctactacgtaccgtacggacgacgtacgacgacgtacgtacgtttaccgtacgtaagtagtagtcgtcgtacggcccgcccgaccgaccgtacgtcgtacgtactactactcgtgtacgacgtacgtacgtacggtaccgtaccgtacgnngcgtcgtcgtcgtacgtactacgtacgtacgtacgtcggtcggtacggtacggtaccggtaccggtaccggtaccgtaccgtccgtccgttcctccttccgtacctccttccgccgaccgtaacccgaccgtaaccgtccgtcccgttcccgtcccgttcccgtccg

SEQ ID NO: 326518 - DNA, 584 bp, Homo sapiens
  misc_feature: GZ8MTXP01BN6EK.44.53.E09.1.454.CMB.2.raw
  modified_base (277)..(277): a, c, t, g, unknown or other
  misc_feature (277)..(277): n is a, c, g, or t
  modified_base (427)..(427): a, c, t, g, unknown or other
  misc_feature (427)..(427): n is a, c, g, or t
tcagacagtatatacacgaccggtgctcgatttagagagagtgtgttgggtttgggggaagcacctgtggttcttcctcctgctggtggcggctcccagatgggtcctgtctcagccgcagctgcgggagtcgggcccaggactggtgaagccttcggagaccctgtccctcacgtgcacggtctctggtgcctccatcgacagaagtaattctactggggctggatccgccacgcccccaggagaggggctgcagtggattgggagtctctattanagtgggaacacctactacaacccgtccctacaacggtcgagtcaccatatccgtggacacgtcgaggacactagtttcccagaaacgtgagttcgtgtcggcccgccgccgacacgggctgtctactactgtgtcagacagtcgggtccncctatggcaggtcgtctactaacttcgtaactacgtctttggggaccgttcgtcggggaccaaaggggccctacgggtccaccgtctcctcactccttcgacgcccttccgaccaacgggccccagtcccggtccttccccgttggcccgcccgtcg

SEQ ID NO: 326519 - DNA, 603 bp, Homo sapiens
  misc_feature: GZ8MTXP01EVEMY.44.53.E09.1.454.CMB.2.raw
tcagacagtatatacacgaccggtgctcgatttagagagagtgtgttgagctctgggagaggagccccagccttgggattcccaggtgttttcattcagtgatcaggactgaacacagaggactcaccatggagtttgggctgagctggattttccttgctgctattttaaaaggtgtccagtgtgaggtgcagttggtggagtcgtgggggaggtttggtaaagccgtggggagtcccttagactctcctgtgcagcctctggattcactttcagtaacgcctggatgacctgggtcccgcaggctccgagggagggctggagtgggtgccgtatagaaccaagctgacggtggacagcagactaacgctgccaccgtagaaaggcagacttacacctatctacaagagatagaattaacaaaagtatacggtgtactcgtgggactaaggatacggaaacacgaccgtagaaaccgaccggacggaacacgacggtccgtactttactacgttgtacgtggggttagttcggtttcaacgggtttccggggaacccgtaacggggtaaccccgttcgggtaacccgttaacccggttcccg

SEQ ID NO: 326520 - DNA, 599 bp, Homo sapiens
  misc_feature: GZ8MTXP01D97T0.44.53.E09.1.454.CMB.2.raw
  modified_base (419)..(419): a, c, t, g, unknown or other
  misc_feature (419)..(419): n is a, c, g, or t
  modified_base (427)..(427): a, c, t, g, unknown or other
  misc_feature (427)..(427): n is a, c, g, or t
  modified_base (433)..(433): a, c, t, g, unknown or other
  misc_feature (433)..(433): n is a, c, g, or t
tcagacagtatatacacgaccggtgctcgatttagagagagtgtgttgagctctgggagaggagccccagccttgggattcccaggtgttttcattcagtgatcaggactgaacacagaggactcaccatggagtttgggctgagctggattttccttgctgctattttaaaaggtgtccagtgtgaggtgcagttggtggagtcgtgggggaggtttggtaaagccgtggggatcccttagactctcctgtgcagcctctggattcactttcagtaacgcctggatgacctgggccgcaggctccgagggagggctggagtgggtgcgtatagaacaagctgacggtggacagcagactaacgctggcacccgtgaaacggcagacttcaccatcacaagagatagaattacaaaagntaacggtntctcgngacagatacgaacacgacctagaaaccgaccggaagaaccaacgacgtcccgttacttaacgtttacgttggtacgtaggggttagtttcgggtttacctaacgggtttccggggaacccggtaaccgggggtaaccccgttcgggtccccgttaacccggttccg

SEQ ID NO: 326521 - DNA, 561 bp, Homo sapiens
  misc_feature: GZ8MTXP01DR7B5.44.53.E09.1.454.CMB.2.raw
  modified_base (176)..(176): a, c, t, g, unknown or other
  misc_feature (176)..(176): n is a, c, g, or t
  modified_base (300)..(300): a, c, t, g, unknown or other
  misc_feature (300)..(300): n is a, c, g, or t
  modified_base (398)..(398): a, c, t, g, unknown or other
  misc_feature (398)..(398): n is a, c, g, or t
  modified_base (418)..(418): a, c, t, g, unknown or other
  misc_feature (418)..(418): n is a, c, g, or t
  modified_base (425)..(425): a, c, t, g, unknown or other
  misc_feature (425)..(425): n is a, c, g, or t
  modified_base (430)..(430): a, c, t, g, unknown or other
  misc_feature (430)..(430): n is a, c, g, or t
  modified_base (438)..(438): a, c, t, g, unknown or other
  misc_feature (438)..(438): n is a, c, g, or t
  modified_base (444)..(444): a, c, t, g, unknown or other
  misc_feature (444)..(444): n is a, c, g, or t
tcagacagtatatacacgaccggtgctcgatttagagagagtgtgttgagctctgggagaggagccccagccttgggattcccaggtgttttcattcagtgatcaggactgaacacagaggactcaccatggagtttgggctgagctggattttccttgctgctattttaaaaggngtccagtgtgaggtgcagttggtggagtcgtgggggaggtttggtaaagccgtggggagtcccttagactctcctgtgcagcctctggattcactttcagtaacgcctggatgacctgggtccncaggctccgagggagggctggagtgggtgcgtatagaacaagctgacggtggacagcagactaacgctgcacccgtagaaaggcagattcaccatcanaagagatagattacaaaagntacggtntctcnggacaganagaacncgcgagaaaccgacgaagaccacgcgtaaccttacttacgtttacttggtacgtgggttacgttcgttacgtaacggttcgggaaccgacgggtacccgttggtcccgttaaccgtc

SEQ ID NO: 326522 - DNA, 541 bp, Homo sapiens
  misc_feature: GZ8MTXP01DJVRJ.44.53.E09.1.454.CMB.2.raw
  modified_base (486)..(486): a, c, t, g, unknown or other
  misc_feature (486)..(486): n is a, c, g, or t
  modified_base (505)..(505): a, c, t, g, unknown or other
  misc_feature (505)..(505): n is a, c, g, or t
  modified_base (534)..(534): a, c, t, g, unknown or other
  misc_feature (534)..(534): n is a, c, g, or t
tcagacagtatatacacgaccggtgctcgatttagagagagtgtgttgagctctgggagaggagccccagccttgggattcccaggtgttttcattcagtgatcaggactgaacacagaggactcaccatggagtttgggctgagctggattttccttgctgctatttaaaaggtgtccagtgtgaggtgcagttggtggagtcgtggggggaggtttggaaagccgtggggagtcccttagactctcctgtgcagcctctggattcactttcagtaacgcctggatgacctgggtccgcaggctccgagggaggggctggagtgggtgcgtatagaaccaagctgacggtggacagcagactaacgctgcacccgtagaaaggcagatcaccatctacaagagatagtaattacaaaagataacggtgtctctgggcaagatagaacagcctagaaaccaccgagacacacgccgtattattacngtcgtgggttagttgttcngttcggccgtaagggaccccttgggtccnccgttcc

SEQ ID NO: 326523 - DNA, 565 bp, Homo sapiens
  misc_feature: GZ8MTXP01EEO91.44.53.E09.1.454.CMB.2.raw
  modified_base (353)..(353): a, c, t, g, unknown or other
  misc_feature (353)..(353): n is a, c, g, or t
  modified_base (418)..(418): a, c, t, g, unknown or other
  misc_feature (418)..(418): n is a, c, g, or t
tcagacagtatatacacgaccggtgctcgatttagagagagtgtgttgggtttgggggaagcacctgtggttcttcctcctgctggtggcggctcccagatgggtcctgtctcagccgcagctgcgggagtcgggcccaggactggtgaagccttcggagaccctgtccctcacgtgcacggtctctggtgcctccatcgacagaagtaatttctactggggctggatccgccagcccccaggagagggctgcagtggattgggagtctctattatagtgggaacacctactacaacccgtccctcaacggtcagtcacatatcgtggacacgtcgaggacactagtttcccngaaacgtgagttctgtggcccgccgccgacacgggctgtctactactgtgtcagacatgggtccncctatggcaggtcgtctcaattctactacgcttgggacgtcgtggggaccaaggggcccacgggtcaccgtctcctcatcccttgacgcccttaccgccgaacgggccccagtcccgggtcccttcccccgttggcccgccccgtcg

SEQ ID NO: 326524 - DNA, 683 bp, Homo sapiens
  misc_feature: GZ8MTXP01CD7JL.44.53.E09.1.454.CMB.2.raw
  modified_base (595)..(595): a, c, t, g, unknown or other
  misc_feature (595)..(595): n is a, c, g, or t
tcagacagtatatacacgaccggtgctcgatttagagagagtgtgttgggtttgggggaagcacctgtggttcttcctcctgctggtggcggctcccagatgggtcctgtctcagccgcagctgcgggagtcgggcccaggactggtgaagccttcggacgaccctgtccctcacgtgcacggtctctggtcgcctccatcgacagtaagttaattctacgtgggctggactccgccacgcccccgaggaggagggctgcaggtggtagttgggagtctactattagtaggtacggaacctacctaactaaccgtaaccccgtccctacgaaccggtcgacgtccaccatactccgtaggacacgtcgacggacacgttacgtttccagtaaacgtgtagttcgtggtcggcccgccgccgacgacggtctcgtctactactgtcgtacagtactaggtccgggtcccgacgttaggtcggaccgtacgggttcctaccttactaacgtttccgtaacgttacggtcggttacggggaccgttcggtcggggaccgaacgggcccgtaaccggtcctacccggttcctccctacncttcccgacgtacccgtcccttacccgacccggttaccggcccctacggtccccgttcccgttccccgttcggccccgttccgtcccg

SEQ ID NO: 326525 - DNA, 536 bp, Homo sapiens
  misc_feature: GZ8MTXP01BN1SV.44.53.E09.1.454.CMB.2.raw
  modified_base (419)..(419): a, c, t, g, unknown or other
  misc_feature (419)..(419): n is a, c, g, or t
  modified_base (426)..(426): a, c, t, g, unknown or other
  misc_feature (426)..(426): n is a, c, g, or t
  modified_base (451)..(451): a, c, t, g, unknown or other
  misc_feature (451)..(451): n is a, c, g, or t
  modified_base (462)..(462): a, c, t, g, unknown or other
  misc_feature (462)..(462): n is a, c, g, or t
  modified_base (468)..(468): a, c, t, g, unknown or other
  misc_feature (468)..(468): n is a, c, g, or t
tcagacagtatatacacgaccggtgctcgatttagagagagtgtgttgagctctgggagaggagccccagccttgggattcccaggtgttttcattcagtgatcaggactgaacacagaggactcaccatggagtttgggctgagctggattttccttgctgctattttaaaaggtgtccagtgtgaggtgcagttggtggagtcgtgggggaggtttggtaaagccgtggggagtcccttagactctcctgtgcagcctctggattcactttcagtaacgcctggatgacctgggtccgccaggctccgagggagggctggagtgggtgccgtatagaccaagctgacggtggacagcagactaacgctgcacccgtgaaaggcagattcaccatcacaagagatagattacaaaagntacggtntctctggcagatgaacagcagaacnccgagaccacngccgtnttattacgttgtcgtgggacttggttcaagttccgggctacggggaccccttgggtccaacccggtcc

SEQ ID NO: 326526 - DNA, 552 bp, Homo sapiens
  misc_feature: GZ8MTXP01BT5H3.44.53.E09.1.454.CMB.2.raw
  modified_base (264)..(264): a, c, t, g, unknown or other
  misc_feature (264)..(264): n is a, c, g, or t
  modified_base (301)..(301): a, c, t, g, unknown or other
  misc_feature (301)..(301): n is a, c, g, or t
  modified_base (320)..(320): a, c, t, g, unknown or other
  misc_feature (320)..(320): n is a, c, g, or t
  modified_base (445)..(445): a, c, t, g, unknown or other
  misc_feature (445)..(445): n is a, c, g, or t
  modified_base (452)..(452): a, c, t, g, unknown or other
  misc_feature (452)..(452): n is a, c, g, or t
  modified_base (547)..(547): a, c, t, g, unknown or other
  misc_feature (547)..(547): n is a, c, g, or t
tcagacagtatatacacgaccggtgctcgatttagagagagtgtgttgagctctgggagaggagccccagccttgggattcccaggtgttttcattcagtgatcaggactgaacacagaggactcaccatggagtttgggctgagctggtattttccttgctgcttaattttaaaaggtgtccagtgtgaggtgcagttggtggagtcgtgggggaggtttggtaaagccgtggggagtccttagactctcctgtgcagcctcnggtattcacttcagtaacgcctggatgacctgggccncaggctccgagggagggcnggagtgggtgcgtatagaacaagctgacggtggacagcagactaacgctggcacccgtgaaagcagacttcaccatctacaagagatagaattacaaaagataccgtgtactctggacaagtaanacgaacngaccagaaaccacgtacgacacgacgtctacttacttcgttggtcgtggttagttggttacgtaaggttccggaacgacgggtaccttcggtccnccgtc

SEQ ID NO: 326527 - DNA, 617 bp, Homo sapiens
  misc_feature: GZ8MTXP01C7NGA.44.53.E09.1.454.CMB.2.raw
  modified_base (283)..(283): a, c, t, g, unknown or other
  misc_feature (283)..(283): n is a, c, g, or t
  modified_base (415)..(415): a, c, t, g, unknown or other
  misc_feature (415)..(415): n is a, c, g, or t
  modified_base (432)..(432): a, c, t, g, unknown or other
  misc_feature (432)..(432): n is a, c, g, or t
tcagacagtatatacacgaccggtgctcgatttagagagagtgtgttgggtttggggggaagcacctgtggttcttcctcctgctggtggcggctcccagatgggtcctgtctcagccgcagctgcgggagtcgggcccaggactggtgaagccttcggagaccctgtccctcacgtgcacggtctctggtgcctccatcgacagaagtaatttctacgtggggctggactccgccacgccccgaggagaggggctgcaggtggagttgggagtctctattanagtaggaacacctactaccacccgtcctcaacggtcgagtcaccatactccgtggacacgtcgaggacactacgtttccagtaaacgtgtagttctgtcgcccgccgccgacacgggctgtctactactgtntcagacagtcgggtccnccgtagtggcgaggttcgtctacgtaactttctacgttacggtcgttaggggaccgttcggtcgggggaccaaacgggggccctacgggtcctacccgtctcctcactcccttcgaccgtcccttacccgaccgaacgggtccccagttcccgggttcccttccccgttcggcccgcccgttccg

SEQ ID NO: 326528 - DNA, 594 bp, Homo sapiens
  misc_feature: GZ8MTXP01DN9PL.44.53.E09.1.454.CMB.2.raw
  modified_base (188)..(188): a, c, t, g, unknown or other
  misc_feature (188)..(188): n is a, c, g, or t
  modified_base (222)..(222): a, c, t, g, unknown or other
  misc_feature (222)..(222): n is a, c, g, or t
  modified_base (280)..(280): a, c, t, g, unknown or other
  misc_feature (280)..(280): n is a, c, g, or t
tcagacagtatatacacgaccggtgctcgatttagagagagtgtgttgggtttgggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactgganccagcgtaatattcttagtcttaactttgtctctggtatcaacatcatccagtaaacncccccaaactcatcatctatgagcctataagacggccctcgtagggtttctaaatcgcttccactgcctccaagtcccggacaacgaccggccctccctagacaatctctgggctcaggctgaggacagggctagattattattcgttgctcagtattcgttcgcgtcattctaactttagtcgttcttcgggaaagttcggggaaacctaaacgggttcctaaacccggttccgttaacggggttccaaccggtaacccccgaaaaacggcccctaaaaaccccccgtcgttaccgtcccttaaccgttcccg

SEQ ID NO: 326529 - DNA, 601 bp, Homo sapiens
  misc_feature: GZ8MTXP01DPOJM.44.53.E09.1.454.CMB.2.raw
  modified_base (430)..(430): a, c, t, g, unknown or other
  misc_feature (430)..(430): n is a, c, g, or t
  modified_base (461)..(461): a, c, t, g, unknown or other
  misc_feature (461)..(461): n is a, c, g, or t
tcagacagtatatacacgaccggtgctcgatttagagagagtgtgttgagctctgggagaggagccccagccttgggattcccaggtgttttcattcagtgatcaggactgaacacagaggactcaccatggagtttgggctgagctggattttccttgctgctattttaaaaggtgtccagtgtgaggtgcagttggtggagtcgtgggggaggtttggtaaagcgtggggagtccttagactctcctgtgcagcctctggattcactttcagtaacgcctggatgaccgtgggtccgcaggctccgaggggaggggctgggagtggggttggccgtaatacgaaccaaagctggacggtggacagcagactaacgctgcacccgtagaaaggcagattcaccatctacaagagatagattacaaaagntaacggtgtactctggacagaatacgaaacngcctagaaacccaccggaggaaccacacgccgttacttacgttacgttgttacgtgggggttactttcggggtttaccaaggtttccggggcccgtaacgggggtaaccccttggggtaaccccttaacccggtttcccc

SEQ ID NO: 326530 - DNA, 565 bp, Homo sapiens
  misc_feature: GZ8MTXP01C3GP4.44.53.E09.1.454.CMB.2.raw
  modified_base (279)..(279): a, c, t, g, unknown or other
  misc_feature (279)..(279): n is a, c, g, or t
  modified_base (359)..(359): a, c, t, g, unknown or other
  misc_feature (359)..(359): n is a, c, g, or t
  modified_base (403)..(403): a, c, t, g, unknown or other
  misc_feature (403)..(403): n is a, c, g, or t
  modified_base (406)..(406): a, c, t, g, unknown or other
  misc_feature (406)..(406): n is a, c, g, or t
  modified_base (505)..(505): a, c, t, g, unknown or other
  misc_feature (505)..(505): n is a, c, g, or t
  modified_base (511)..(511): a, c, t, g, unknown or other
  misc_feature (511)..(511): n is a, c, g, or t
tcagacagtatatacacgaccggtgctcgatttagagagagtgtgttgggtttgggggaagcacctgtggttcttcctcctgctggtggcggctcccagatgggtcctgtctcagccgcagctgcgggagtcgggcccaggactggtgaagccttcggagaccctgtccctcacgtgcacggtctctggtgcctccatcgacagaagtaatttctacgtggggctggatccgccacgccccaggagaggggctgcaggtggattgggagtctctattanagtgggaacacctactacaaccccgtccctacaacggtcgagtcaccatatccgtggacacgtcgaggacacagtttccngaaacgtgagttctgtgccgcgccgacacgggctgtctactacngtntcagacagtcggtccgctagtggcagggtcgtctcaatttcgtactacgcttggggactcgtggggccaaaggggcctaaccggtcacccgtctccctnactccncgacgccttcccgaccacgggcccagtccgtccttccccgttggcccgccgtcg

SEQ ID NO: 326531 - DNA, 608 bp, Homo sapiens
  misc_feature: GZ8MTXP01B0A6A.44.53.E09.1.454.CMB.2.raw
  modified_base (299)..(299): a, c, t, g, unknown or other
  misc_feature (299)..(299): n is a, c, g, or t
  modified_base (400)..(400): a, c, t, g, unknown or other
  misc_feature (400)..(400): n is a, c, g, or t
  modified_base (404)..(404): a, c, t, g, unknown or other
  misc_feature (404)..(404): n is a, c, g, or t
  modified_base (420)..(420): a, c, t, g, unknown or other
  misc_feature (420)..(420): n is a, c, g, or t
  modified_base (427)..(427): a, c, t, g, unknown or other
  misc_feature (427)..(427): n is a, c, g, or t
  modified_base (453)..(453): a, c, t, g, unknown or other
  misc_feature (453)..(453): n is a, c, g, or t
tcagacagtatatacacgaccggtgctcgatttagagagagtgtgttgagctctgggagaggagccccagccttgggattcccaggtgttttcattcagtgatcaggactgaacacagaggactcaccatggagtttgggctgagctggattttccttgctgctattttaaaaggtgtccagtgtgaggtgcagttggtggagtcgtgggggaggtttggtaaagccgtggggatcccttagactctcctgtgcagcctctggattcactttcagtaacgcctggatgacctgggtccnccaggcctccgagggagggctggagtgggtgccgtatagaaccaagctgacggtggacagcagactaacgctcgcacccgtgaaagcagatcaccatccanaagngatagattacaaaagntacggtntctcgtgggctaaggatacggaaacncggaccctaggaaacccgaccgaggaaccaacgacggtccccttattattaaccgttggttaccgtagggggttactttcggggtttacctaaggtttccccgggggaaccgtaacgggggtaccccttggggtaaccccttaacccggtttccc

SEQ ID NO: 326532 - DNA, 608 bp, Homo sapiens
  misc_feature: GZ8MTXP01CD8NQ.44.53.E09.1.454.CMB.2.raw
  modified_base (284)..(284): a, c, t, g, unknown or other
  misc_feature (284)..(284): n is a, c, g, or t
  modified_base (595)..(595): a, c, t, g, unknown or other
  misc_feature (595)..(595): n is a, c, g, or t
tcagacagtatatacacgaccggtgctcgattttagagagagtgtgttgggtttggggggaagcacctgtggttcttcctcctgctggtggcggctcccagatgggtcctgtctcagccgcagctgcgggagtcgggcccaggactggtgaagccttcggagaccctgtccctcacgtgcacggtctctggtgcctccatcgacagaagtaatttctacgtggggctggactccgccacgcccccaggagaggggctgcaggtggagttgggagtctctattanaggtaggaacacctactaccaaccccgtcctacgaacggtcgacgtcaccatactccgtggacacgtcgaggacactacgtttccagtaaacgtgtagttcgtgtcggcccgccgccgacacggctcgtctactctgtcgtcagacagtcggtccgctagcggcaggtcgtctactaactttcgtacgttacgtcgttcggggacgtcggtcggggaccgaaacgggcccgtacgggtccacccggtcctcccgtcttacgtcccttcgaccgcccttaccgaccgacggccctacgtccgtcctccccgngtcccgcccgtcg

SEQ ID NO: 326533 - DNA, 569 bp, Homo sapiens
  misc_feature: GZ8MTXP01BBDNE.44.53.E09.1.454.CMB.2.raw
  modified_base (422)..(422): a, c, t, g, unknown or other
  misc_feature (422)..(422): n is a, c, g, or t
  modified_base (520)..(520): a, c, t, g, unknown or other
  misc_feature (520)..(520): n is a, c, g, or t
tcagacagtatatacacgaccggtgctcgatttagagagagtgtgttgggtttgggggaagcacctgtggttcttcctcctgctggtggcggctcccagatgggtcctgtctcagccgcagctgcgggagtcgggcccaggactggtgaagccttcggagaccctgtccctcacgtgcacggtctctggtgcctccatcgacagaagtaatttctactggggctggatccgccagcccccaggagaggggctgcagtggattgggagtctctattatagtgggaacacctactacaacccgtccctcaacggtcgagtcaccatatccgtggacacgtcgaggacacagttttccctgaaacgtgagttctgtggcccgccgccgacacgggctgtctactactgtgtcagacatgggtccncctagtggcaggtcgtctctaattctactacgcttggggacgtcgtggggccaaggggccacgggtcaccgtctcctcatcccttcacgcccttaccnccgaacgggccccagtcccgggtcttccccccgttggcccgccccgtcg

SEQ ID NO: 326534 - DNA, 622 bp, Homo sapiens
  misc_feature: GZ8MTXP01D2NPD.44.53.E09.1.454.CMB.2.raw
  modified_base (301)..(301): a, c, t, g, unknown or other
  misc_feature (301)..(301): n is a, c, g, or t
  modified_base (349)..(349): a, c, t, g, unknown or other
  misc_feature (349)..(349): n is a, c, g, or t
tcagacagtatatacacgaccggtgctcgatttagagagagtgtgttgagctctgggagaggagccccagccttgggattcccaggtgttttcattcagtgatcaggactgaacacagaggactcaccatggagtttgggctgagctggattttccttgctgctattttaaaaggtgtccagtgtgaggtgcaggttggtggagtcgtgggggaggtttggtaaagccgtggggagtcccttagactctcctgtgcagcctctggattcactttcagtaacgcctggatcgacctgggccnccaggcctccgagggagggctggagtgggtgccgtatagaaccaagcngacggtggacagcagactaacgctgcacccgtgaaacgcagattcacatcacaagagatgaattacaaaagatacgtgtactcgtaggacaagatagaaacgacgccgtaacgaaccgaaacccggacgggaaccaaacgaccggtaacccgttacttaaactttaccgttgggtaccgttagggggaaccgtttggggttttaccaaacgggttttccggggaacccgtaacgggggtaaccccttcggggtccccttaacccgggttcccg

SEQ ID NO: 326535 - DNA, 614 bp, Homo sapiens
  misc_feature: GZ8MTXP01DY8YJ.44.53.E09.1.454.CMB.2.raw
  modified_base (301)..(301): a, c, t, g, unknown or other
  misc_feature (301)..(301): n is a, c, g, or t
  modified_base (433)..(433): a, c, t, g, unknown or other
  misc_feature (433)..(433): n is a, c, g, or t
  modified_base (450)..(450): a, c, t, g, unknown or other
  misc_feature (450)..(450): n is a, c, g, or t
  modified_base (457)..(457): a, c, t, g, unknown or other
  misc_feature (457)..(457): n is a, c, g, or t
  modified_base (471)..(471): a, c, t, g, unknown or other
  misc_feature (471)..(471): n is a, c, g, or t
  modified_base (478)..(478): a, c, t, g, unknown or other
  misc_feature (478)..(478): n is a, c, g, or t
tcagacagtatatacacgaccggtgctcgatttagagagagtgtgttgagctctgggagaggagccccagccttgggattcccaggtgttttcattcagtgatcaggactgaacacagaggactcaccatggagtttgggctgagcgtggattttccttgctgcttaattttaaaaggtgtccagtgtgaggtgcaggttggtggagtcgtgggggaggtttggtaaagccgtggggatccctagactctcctgtgcagcctctggattcacttcagtaacgctggatgacctgggtcccncaggcctaccggagggaaggggctaggaggtggggttgccgtaatacgaaccaaaggcgtaggacggtggacaggtcagactaacgctcgacacccggtagaaacggcagtacttcaccataccagaagganatagaattaacaaagtntacggtntctagagactaganacgaacncgaccgaagaaaccgacgtaagacacgacgtaaccttacttacgttacgttggttacggtagggttacgtttcggttacgtaacgggttacccgggaaccgtaaccggggtacccttcgggtaaccccttccgtcc

SEQ ID NO: 326536 - DNA, 661 bp, Homo sapiens
  misc_feature: GZ8MTXP01ENBO9.44.53.E09.1.454.CMB.2.raw
  modified_base (475)..(475): a, c, t, g, unknown or other
  misc_feature (475)..(475): n is a, c, g, or t
tcagacagtatatacacgaccggtgctcgatttagagagagtgtgttgagctctgggagaggagccccagccttgggattcccaggtgttttcattcagtgatcaggactgaacacagaggactcaccatggagtttgggctgagcgtggtattttccttgctgacttaattttaaaaggtgtccagtgtgaggtgcaggttggtggagtcgtgggggtaggtttggtaaagccgtggggatcccttagactctcctgtgcagcctctggattcactttcagtaacgcctggatcgaccgtgggtcccgccgaggccgtaccggaaggggaggggtcgtaggggtaggttcgggggttacggaccggtttaaagttaacggaaaccgtaaaggcgttacgggacgggtagggaacaggacaagtaccgtaacgctgacccgtaacccgggagaaacggcaagtacttaccacctntacagaagagtatagtaattaaacgaaagtagttacgggtctacttcaggggacagtagacgaacgaacgacgtacgaaaccgaaccgaacggaacacgacgtaacgtacttacttaacgttcgtcgtggttagttgttacgtaacgtcggtaacggacggtaccgttacgtccgttccgttcccg

SEQ ID NO: 326537 - DNA, 578 bp, Homo sapiens
  misc_feature: GZ8MTXP01BFY3Z.44.53.E09.1.454.CMB.2.raw
  modified_base (267)..(267): a, c, t, g, unknown or other
  misc_feature (267)..(267): n is a, c, g, or t
  modified_base (273)..(273): a, c, t, g, unknown or other
  misc_feature (273)..(273): n is a, c, g, or t
  modified_base (355)..(355): a, c, t, g, unknown or other
  misc_feature (355)..(355): n is a, c, g, or t
  modified_base (369)..(369): a, c, t, g, unknown or other
  misc_feature (369)..(369): n is a, c, g, or t
  modified_base (376)..(376): a, c, t, g, unknown or other
  misc_feature (376)..(376): n is a, c, g, or t
  modified_base (384)..(384): a, c, t, g, unknown or other
  misc_feature (384)..(384): n is a, c, g, or t
  modified_base (409)..(409): a, c, t, g, unknown or other
  misc_feature (409)..(409): n is a, c, g, or t
  modified_base (416)..(416): a, c, t, g, unknown or other
  misc_feature (416)..(416): n is a, c, g, or t
tcagacagtatatacacgaccggtgctcgatttagagagagtgtgttgggtttgggggaagcacctgtggttcttcctcctgctggtggcggctcccagatgggtcctgtctcagccgcagctgcgggagtcgggccaggactggtgaagccttcggagaccctgtccctcacgtgcacggtctctggtgcctccatcgacagaagtaattctactgggctggatccgcagcccccaggagaggggctgcagtggattgggagtctntattanagtgggaacacctactacaaacccgtcctcaacggtcaagtcacctatatcccgtggacacgtcgaggacacagttttcccngaaacgtgagttcngtggccncgccgacncggctgtctactactgtgcaggacngtcggcnctagtcgcagtcgtctactacttacgtacgtacgtcgtcggtacgtcgtcggaccggacggaccgtaccgtacgtccgtctcctcttactccttcgacgtccttccgaccgaccggaacccgtaccgtccgtcccgttccccgttccgtccgttcccgtccg

SEQ ID NO: 326538 - DNA, 690 bp, Homo sapiens
  misc_feature: GZ8MTXP01C620P.44.53.E09.1.454.CMB.2.raw
  modified_base (579)..(579): a, c, t, g, unknown or other
  misc_feature (579)..(579): n is a, c, g, or t
tcagacagtatatacacgaccggtgctcgatttagagagagtgtgttgagctctgggagaggagccccagccttgggattcccaggtgttttcattcagtgatcaggactgaacacagaggactcaccatggagtttgggctgagctggattttccttgctgctattttaaaaggtgtccagtgtgaggtgcagttggtggagtcgtgggggaggtttggaaagcgtggggatcccttagactctcctgtgcagcctctggattcactttcagtaacgccgtggatcgaccgtcggggtcccgccaggcctccggaaggggaagggggtcgtaggggaggttgggggtttcggacccgtttaagtaacgaaaccgaaagccgtaggacgggtacgggacagcaagacctaacgctggaccacccggtagaaacggcagtactcacctatactacaagagatagtaattaacaaaaggtacttacggtgtactcgtagacgtagaactacgaaacacgacctacggaaaaccgaccggaacggaaccacgtaaccggtcccgttacttaacgtttaccgnggtttaccggtaggggttaaagtttcgggttttaccgaaacgggtttcccgggggaacccgtaacgggggtaaacccccgttcgggtaaccccgttaacccggtttccccg

SEQ ID NO: 326539 - DNA, 694 bp, Homo sapiens
  misc_feature: GZ8MTXP01DIROD.44.53.E09.1.454.CMB.2.raw
  modified_base (178)..(178): a, c, t, g, unknown or other
  misc_feature (178)..(178): n is a, c, g, or t
tcagacagtatatacacgaccggtgctcgatttagagagagtgtgttgagctctgggagaggagccccagccttgggattcccaggtgttttcattcagtgatcaggactgaacacagaggactcaccatggagtttgggctgagctggtattttccttgctgctaattttaaaaggngtccagtgtgaggtgcaggttggtggagtcgtgggggtaggtttaggtaaagccgtggggacgtcccttagactctcctgtgcagccttcgtggattctactttacagtaacgctggatcgaccgtcgggtcccgcgaggcctaccggaggggaagggggcgtagggtaggtgggggttcggacccggttaagtaacggaaaccgaaagtcgtaggacggggtaggacaggacagacctaaaccgctcggaccgtaacccggtaggaaaacgggccaagtacttaccgaaccctaagttaccacgaaagagtaatagtaacttaacaaaaggtattacgggtgttactcgtaggacgaagtatacggaaaccagtacccaggaaaacccgaccgaaggaaccacgtacgtcccgttattaacgtttcgttggttacgtggggttacgtttcggtttacgaaccgggttccgggaaccgttaacgggggacccccttgggtccccttaaccgttccc

SEQ ID NO: 326540 - DNA, 647 bp, Homo sapiens
  misc_feature: GZ8MTXP01A9PB0.44.53.E09.1.454.CMB.2.raw
  modified_base (249)..(249): a, c, t, g, unknown or other
  misc_feature (249)..(249): n is a, c, g, or t
  modified_base (384)..(384): a, c, t, g, unknown or other
  misc_feature (384)..(384): n is a, c, g, or t
tcagacagtatatacacgaccggtgctcgatttagagagagtgtgttgggtttgggggaggcgtggtccagcccgggaggtccctgagactctcctgtgtagcctctgggttctcattcgatagtattttggtttgcactgggtccgccaggctccaggcaaggggccggagtgggtggcagtcatctccgacgatggaagtgagaagtattactcagactccgtgaagggccattcaccatctcaganacaattcaagatatgctgtattgacaaatgaacagcgtagagagttgacgacacgttctgtttattactgtggcggagggggacctacgaaaggtaaacggttcgggaatcaactaaactatactattgaatggntgtgtggggcgagggggacgtcggtcaccgtctccgtcacgccttacccgaaccgaacgggtcccctaacgttcccggttcccttcccccgtgggccccgtcccggttcgcccgttcccgagggaccgtcccgtaccgttcggtaccgggggccaaccggcggcccgggcccggttgggccttcgggtcccgttgggtaccgaaacgggttaccttacgtttaccctaagtactaacgtcggtcttggaacggttcgggtccg

SEQ ID NO: 326541 - DNA, 634 bp, Homo sapiens
  misc_feature: GZ8MTXP01A8UZN.44.53.E09.1.454.CMB.2.raw
  modified_base (263)..(263): a, c, t, g, unknown or other
  misc_feature (263)..(263): n is a, c, g, or t
tcagacagtatatacacgaccggtgctcgatttagagagagtgtgttgagctctgggagaggagccccagccttgggattcccaggtgttttcattcagtgatcaggactgaacacagaggactcaccatggagtttgggctgagctggattttccttgctgctattttaaaaggtgtccagtgtgaggtgcagttggtggagtcgtgggggaggtttaggtaaagccgtggggagtcccttagactctcctgtgcagcctcnggtattcactttcagtaacgcctggatgaccgtgggtcccgccgaggcctccgaagggggaacgggggctggggaggttgggggttacggcccggttaagttaacggaaaccctaaagcgtaggacgggtcgggacaggcagactaacgctcgccacccggtagaaacggcaagacttcacctatctacgaaagagatagaacttaacgaaaagtctacgggtctactcgtgggacagatacggaacacgacctagaaacccaccggaaggaccaacgcggtaaccctattacttacgttgtacgtgggttatttcgggttactaaggttccgggccgtaacggggacccttgggtcccttaaccggtccc

SEQ ID NO: 326542 - DNA, 601 bp, Homo sapiens
  misc_feature: GZ8MTXP01DYKN9.44.53.E09.1.454.CMB.2.raw
  modified_base (302)..(302): a, c, t, g, unknown or other
  misc_feature (302)..(302): n is a, c, g, or t
  modified_base (463)..(463): a, c, t, g, unknown or other
  misc_feature (463)..(463): n is a, c, g, or t
  modified_base (476)..(476): a, c, t, g, unknown or other
  misc_feature (476)..(476): n is a, c, g, or t
tcagacagtatatacacgaccggtgctcgatttagagagagtgtgttgagctctgggagaggagccccagccttgggattcccaggtgttttcattcagtgatcaggactgaacacagaggactcaccatggagtttgggctgagctggattttccttgctgctattttaaaaggtgtccagtgtgaggtgcagttggtggagtcgtgggggaggtttggtaaagccgtggggagtcccttagactctcctgtgcagcctctggattcactttcagtaacgcctggatgaccgtgggtcccnccgaggcctccgagggaggggctgggagtgggtggccgtatagaaccaaagctgacggtggacagcagactaacgctgcacccgtagaaaggcagattcaccatctacaagagatagaattacaaaagtatacggtgtctctaggacagtaatggaaaccngccctagaaaccnccggaaggaccacgacgtccgttacttattaccgttgtaccggttggggttacgtttgggtttaccaaggtttcccggggaaccgtaacgggggaaccccttggggttcccaacccggtttcccc

SEQ ID NO: 326543 - DNA, 535 bp, Homo sapiens
  misc_feature: GZ8MTXP01CWTOU.44.53.E09.1.454.CMB.2.raw
  modified_base (190)..(190): a, c, t, g, unknown or other
  misc_feature (190)..(190): n is a, c, g, or t
  modified_base (225)..(225): a, c, t, g, unknown or other
  misc_feature (225)..(225): n is a, c, g, or t
  modified_base (237)..(237): a, c, t, g, unknown or other
  misc_feature (237)..(237): n is a, c, g, or t
  modified_base (283)..(283): a, c, t, g, unknown or other
  misc_feature (283)..(283): n is a, c, g, or t
  modified_base (308)..(308): a, c, t, g, unknown or other
  misc_feature (308)..(308): n is a, c, g, or t
  modified_base (431)..(431): a, c, t, g, unknown or other
  misc_feature (431)..(431): n is a, c, g, or t
tcagacagtatatacacgaccggtgctcgatttagagagagtgtgttgggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactggacnccagcgtaaatnttctagtcttaacttgtctcctgtatcaacatcatcaaggtaaacnccccaaatcatcatctatgagctanaagacgtccctcgtagggtttcaatcgcttccactcgcctcaacgtccgacaacgacgcctcctagacatctcgtggtctcgagctgacggacgagctagtattattattgttgcttcaagtnttgttcgtcgctattcacttatgttcgttcgggaagttcgggacctaaggcctaccggtcttacggttcacgcccaacggcccaacccattcgtcaacgttccc

SEQ ID NO: 326544 - DNA, 645 bp, Homo sapiens
  misc_feature: GZ8MTXP01EPXLC.44.53.E09.1.454.CMB.2.raw
  modified_base (465)..(465): a, c, t, g, unknown or other
  misc_feature (465)..(465): n is a, c, g, or t
tcagacagtatatacacgaccggtgctcgatttagagagagtgtgttgagctctgggagaggagccccagccttgggattcccaggtgttttcattcagtgatcaggactgaacacagaggactcaccatggagtttgggctgagctggattttccttgctgctaattttaaaaggtgtccagtgtgaggtgcagttggtggagtcgtgggggaggtttggtaaagccgtggggagtcccttagactctcctgtgcagcctctggattctactttcagtaacgcctggatcgaccgtgggtccgccaggctccgaggggaaggggcgtggaggtgggttggccgttaatacgaacaaagctaggacggtggacagcagactaacgctcgcaacccggtagaaacggcaagacttacaccatacctacaaagagtaatagaaattaacaaaaagtattacgggttntactactagggacaaggtataacgaaacgacgacccgtaagaaaccgaccggtaacgaacctacgaacgtcccgtttacttaacgttacgttgggttcgtaagggttagtttcgggttacctaagggttcccggggaacccgtaaccggggtacccttcgggtaaccccttcccgttccg

SEQ ID NO: 326545 - DNA, 585 bp, Homo sapiens
  misc_feature: GZ8MTXP01BLAHN.44.53.E09.1.454.CMB.2.raw
  modified_base (415)..(415): a, c, t, g, unknown or other
  misc_feature (415)..(415): n is a, c, g, or t
  modified_base (430)..(430): a, c, t, g, unknown or other
  misc_feature (430)..(430): n is a, c, g, or t
  modified_base (437)..(437): a, c, t, g, unknown or other
  misc_feature (437)..(437): n is a, c, g, or t
  modified_base (537)..(537): a, c, t, g, unknown or other
  misc_feature (537)..(537): n is a, c, g, or t
tcagacagtatatacacgaccggtgctcgatttagagagagtgtgttgagctctgggagaggagccccagccttgggattcccaggtgttttcattcagtgatcaggactgaacacagaggactcaccatggagtttgggctgagctggattttccttgctgctattttaaaaggtgtccagtgtgaggtgcagttggtggagtcgtgggggtaggtttggtaaagccgtggggagtcccttagactctcctgtgcagcctctggtattctactttcagtacgcctggatgaccgtcgggtccgccaggcctccggaggggagggcgtgggagtggggtgccgtatacgaacaagctggacggtggacagcagacaacgctgcacccgtagaacgcagacttcacatcacaaganatagattaacaaagngtacgtntactcgtacggacagtatacgaacacgacctaacgaaaccgaccgaaggacacgcgtcccgtacttacttacttggtcgttgggttacgttggtttacgnggttccgggccgtaacggggtacccttcgggtccttaacccggttccc

SEQ ID NO: 326546 - DNA, 594 bp, Homo sapiens
  misc_feature: GZ8MTXP01AJP2O.44.53.E09.1.454.CMB.2.raw
  modified_base (276)..(276): a, c, t, g, unknown or other
  misc_feature (276)..(276): n is a, c, g, or t
tcagacagtatatacacgaccggtgctcgatttagagagagtgtgttgggtttgggggaagcacctgtggttcttcctcctgctggtggcggctcccagatgggtcctgtctcagccgcagctgcgggagtcgggcccaggactggtgaagccttcggagaccctgtccctcacgtgcacggtctctggtgcctccatcgacagaagtaatttcactggggctggatccgccagcccccaggagaggggctgcagtggattgggagtctctattanagtggaacacctactacacccgtcctcaacggtcgagtcacatatccgtggacacgtcgaggacactagttttcccagaaacgtgagttctgtcggcccgcgccgacacgggctgtctactactgtgtcagacagtcgggtccgaccgtatggcaggtcgtctctaacttcgtactacggcgtttacggggacgttcgtcgggggaccaaacggggcccacgggtccacccgtctccctcactcccttcgacgtcccttaccgacccgttaacggggcccctagtcccggtcccttcccccgttggcccgcccgtccg

SEQ ID NO: 326547 - DNA, 602 bp, Homo sapiens
  misc_feature: GZ8MTXP01A8J6W.44.53.E09.1.454.CMB.2.raw
  modified_base (277)..(277): a, c, t, g, unknown or other
  misc_feature (277)..(277): n is a, c, g, or t
tcagacagtatatacacgaccggtgctcgatttagagagagtgtgttgggtttggggggaagcacctgtggttcttcctcctgctggtggcggctcccagatgggtcctgtctcagccgcagctgcgggagtcgggcccaggactggtgaagccttcggagaccctgtccctcacgtgcacggtctctggtgcctccatcgacagaagtaatttctactggggctggatccgccacgccccaggagagggctgcagtggattgggagtctctattanagtggaacacctactacaacccgtcctcaacggtcgagtcaccatactccgtggacacgtcgaggacactagtttcccagaaacgtgagttctgtcggcccgccgccgacacgggctgtctactactgtgtcagacagtcgggtcccacctagtcggctaggttcgtctactacttcgtacgtacggtcgttggggaccttcgtcggggccaaacggggtcctacgggtcctaccggtcctaacctcaactcccttcacgtcccttaccgaccgaacggggccccagttcccggttccctccccgttgggcccttcccgtaaccg

SEQ ID NO: 326548 - DNA, 742 bp, Homo sapiens
  misc_feature: GZ8MTXP01CGMIS.44.53.E09.1.454.CMB.2.raw
  modified_base (223)..(223): a, c, t, g, unknown or other
  misc_feature (223)..(223): n is a, c, g, or t
  modified_base (283)..(283): a, c, t, g, unknown or other
  misc_feature (283)..(283): n is a, c, g, or t
tcagacagtatatacacgaccggtgctcgatttagagagagtgtgttgggtttggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactgganccagcgtaatattcttagtcttaactttgtctctggtatcaacatcatccaaggtaaacncccccaaatcatcatctatgacgctaataagacggcctcgtagggtttcaatcgtcttccactgcctaccaagtcccggacaaccgaccggtacccttccctacgaacctaaacttccttccgtcggggtcccttaccgaacgggtccgttagggaacgggaaccggtaagggtcttaggtaattttaacgtttaagtttcggttttacgccgtttacgtaaggttaacgtttcgggtttccgttccggaccttaagtttacccgttaaccttttaagtttccgggttccgttttaacccgggggaaagggtttccgggggaaacccgttaaaacggggttcccgtaaaccccgggttcccgtttaaacggggttcccttaacccggaacccccggtaaaacgggaacccccccgtaaaaccccctacgttaccggtcccgttaacccttttcccccgg

SEQ ID NO: 326549 - DNA, 637 bp, Homo sapiens
  misc_feature: GZ8MTXP01C1FXT.44.53.E09.1.454.CMB.2.raw
  modified_base (431)..(431): a, c, t, g, unknown or other
  misc_feature (431)..(431): n is a, c, g, or t
  modified_base (453)..(453): a, c, t, g, unknown or other
  misc_feature (453)..(453): n is a, c, g, or t
  modified_base (462)..(462): a, c, t, g, unknown or other
  misc_feature (462)..(462): n is a, c, g, or t
  modified_base (537)..(537): a, c, t, g, unknown or other
  misc_feature (537)..(537): n is a, c, g, or t
tcagacagtatatacacgaccggtgctcgatttagagagagtgtgttgagctctgggagaggagccccagccttgggattcccaggtgttttcattcagtgatcaggactgaacacagaggactcaccatggagtttgggctgagctggattttccttgctgctaattttaaaaggtgtccagtgtgaggtgcagttggtggagtcgtgggggaggtttggtaaagccgtggggagtccctagactctcctgtgcagcctctggattcactttcagtaacgcctggatcgaccgtggtcccgcaggctccggaaggggaggggctgggagtgggtgccgtatacgaaaccaaagctggacggtcggacagcagactaacgctgaccaacccggtagaaacggcaagacttaccaccatacctacgaaaganaatagtaattaacgaaaaagtntaacgggtntactctaggacaagatagaaacacgacctagaaaccacggaacggaccaacgcgtaacccgtcttaatttaccgnggttacgtggggttaacgtttcgggtttacgtaacggttcccggggtaaccgtaacgggggtaaccccttcggggttaacccttaaccccggtttccccg

SEQ ID NO: 326550 - DNA, 567 bp, Homo sapiens
  misc_feature: GZ8MTXP01D57TQ.44.53.E09.1.454.CMB.2.raw
  modified_base (397)..(397): a, c, t, g, unknown or other
  misc_feature (397)..(397): n is a, c, g, or t
  modified_base (420)..(420): a, c, t, g, unknown or other
  misc_feature (420)..(420): n is a, c, g, or t
  modified_base (426)..(426): a, c, t, g, unknown or other
  misc_feature (426)..(426): n is a, c, g, or t
  modified_base (450)..(450): a, c, t, g, unknown or other
  misc_feature (450)..(450): n is a, c, g, or t
tcagacagtatatacacgaccggtgctcgatttagagagagtgtgttgagctctgggagaggagccccagccttgggattcccaggtgttttcattcagtgatcaggactgaacacagaggactcaccatggagtttgggctgagctggattttccttgctgctattttaaaaggtgtccagtgtgaggtgcagttggtggagtcgtgggggtaggtttggtaaagccgtggggatcccttagactctcctgtgcagcctctggattcactttcagtaaccgcctggatgaccgtgggtcccgccaggcctccggagggaggggctggagtgggtgccgtatagacaagctgacggtggacagcagactaacgctgcaccgtagaagcagatcaccntcacagagatagattaacaaagntacgtntacgtctaggacagatacgaaacncgacctagaaaccaccggaacggacacgacgccgttacttacttacttgtcgtgggttagtttcggtttacaaggtttccgggccgtacggggacccttggtccgaacccgtttccc

SEQ ID NO: 326551 - DNA, 659 bp, Homo sapiens
  misc_feature: GZ8MTXP01D4JRT.44.53.E09.1.454.CMB.2.raw
tcagacagtatatacacgaccggtgctcgatttagagagagtgtgttgggtttggggggaagcacctgtggttcttcctcctgctggtggcggctcccagatgggtcctgtctcagccgcagctgcgggagtcgggcccaggactggtgaagccttcggagaccctgtccctcacgtgcacggtctctggtcgcctccatcgacagtaagtaatttctacgtggggctggatccgccacgcccccaggagagggctgcagtggagttgggagtctctattagtagtaggaactacctaactaccaaccccgtccctacaacggtcgagtcacatactcgtggacacgtcgaggactactacgtttcctagtaaacgtcgtagttcgtgtcggcccgcccgcgacacggctgtctactactgtactcagtacagtcgggtccgtactagtgcgaggttctcgtactaacttctaacgtacggtcgttcggggaccgttccggtcggggtacccgaaacggggtacccgtaccgggttcccgtaccgttccgtccccttacttacttccccgttaccgtacgtccccttacccgacccgttaaaccggggcccctacgtcccggttcccctccccccggttcgggtcccttccccgttcgg

SEQ ID NO: 326552 - DNA, 633 bp, Homo sapiens
  misc_feature: GZ8MTXP01DT7CJ.44.53.E09.1.454.CMB.2.raw
tcagacagtatatacacgaccggtgctcgatttagagagagtgtgttgggtttggggggaagcacctgtggttcttcctcctgctggtggcggctcccagatgggtcctgtctcagccgcagctgcgggagtcgggcccaggactggtgaagccttcggagaccctgtccctcacgtgcacggtctctggtgcctcatcgacagaagtaatttctacgtgggctggactccgccacgcccccgaggaggacggggctgcgaggtggtagttgggagtctactattagtaggtacggaactacctaactaccaaaccccgtccctacgaaccggtcgacgtaccacctatactccgtggacacgtacgacggacactacgtttccagtaaacgtgtagttcgtgtacggcccgccgccgacgcggctcgtctacgtactgtatcagacagtcgggtcccgtcctagtcggacgacggtcgtctactaacttcgtacttacgtcgttgggaccggtgtcggggaccgtaacgggccgtaaccggtccacccgtcctccgtcttactcccttcgaccgtcccaccgaccgacgggccctacgttccgtccccgttccccgcgcccgttccctaacg

SEQ ID NO: 326553 - DNA, 562 bp, Homo sapiens
  misc_feature: GZ8MTXP01AFL6N.44.53.E09.1.454.CMB.2.raw
  modified_base (224)..(224): a, c, t, g, unknown or other
  misc_feature (224)..(224): n is a, c, g, or t
  modified_base (301)..(301): a, c, t, g, unknown or other
  misc_feature (301)..(301): n is a, c, g, or t
tcagacagtatatacacgaccggtgctcgatttagagagagtgtgttgggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactgganccagcgtaatattcttagtcttaacttgtctcctggtatcaacatcatccaggtaaacgccccaaatcatcatctangaggcctaataagaggccctgaggggtttcaatcgcttccactgcctcaagtccggacaacacggcctcctgacatctctgggctccaggctgaggacgaggtctgattattattgttgctcagtactgttcgcgcattccaactttatcgttcgttacgggaaggtcgggaaccctaagggttcccgtaaaccggtccgttaaggttccacggaaccccgaaacgggcccctaaaaccccctcgttcgtccttcgtcccg

SEQ ID NO: 326554 - DNA, 729 bp, Homo sapiens
  misc_feature: GZ8MTXP01BT5BU.44.53.E09.1.454.CMB.2.raw
tcagacagtatatacacgaccggtgctcgatttagagagagtgtgttgggtttgggggaggcgtggtccagcccgggaggtccctgagactctcctgtgtagcctctgggttctcattcgatagattttggtttgcactgggtccgccaggctccaggcaaggggccggagtgggtggcagtcatctccgacgatggaagtgagaagtattactcagactccgtagaagggccattcacatctcagagacaattcaagatatgctgtattgacaaatgaacagcgtgagagttagacgacacgttctgtttatactgtggacggacgggggacctacgaaagggtaaccggttacggggaatacgtaacgtaaaactacttaactatttgaattggtaagttgtcgggtaggggacggtagggggtacgtcgggtacacccgttctccgtacgacgtacccttacccgaaccggtaaacggggtcccctacgttcccggttcccctttaccccccggtgggccccgttacccggtcggtcccgttacccggaaacgggtccgtaccccgtaccccgttggggtaccggggggacctaaccgggaccgggtccccgggtcccggtcgggggtccttccggggacccgttggggtaaaccaacgggttaaccttccgttacccttaagtacgttaacgtcgttccgttagggaaccgggttcgggtaacgg

SEQ ID NO: 326555 - DNA, 548 bp, Homo sapiens
  misc_feature: GZ8MTXP01EH1Z1.44.53.E09.1.454.CMB.2.raw
  modified_base (191)..(191): a, c, t, g, unknown or other
  misc_feature (191)..(191): n is a, c, g, or t
  modified_base (225)..(225): a, c, t, g, unknown or other
  misc_feature (225)..(225): n is a, c, g, or t
  modified_base (286)..(286): a, c, t, g, unknown or other
  misc_feature (286)..(286): n is a, c, g, or t
  modified_base (433)..(433): a, c, t, g, unknown or other
  misc_feature (433)..(433): n is a, c, g, or t
  modified_base (532)..(532): a, c, t, g, unknown or other
  misc_feature (532)..(532): n is a, c, g, or t
tcagacagtatatacacgaccggtgctcgatttagagagagtgtgttggggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactgganccagcgtaatattcttagtcttaactttgtctcctggtatcaacatcatccaaggtaaacncccccaaatcatcatctatgagctataagaggccctcgtagggtttctaatcgcttccactgcctccaacgtcccggacaacgcggcctccctagacaatctctggctcgaggctgaggacgaggctgattatattgttgctcagtntgttcgcgctatcctatttattcgttcgttacgggaagttcgggactaacgggttccaccggttcttagggttcacgaacccaaggcccaaaccccgtnttcgtccaacttcccg

SEQ ID NO: 326556 - DNA, 609 bp, Homo sapiens
  misc_feature: GZ8MTXP01ER7YI.44.53.E09.1.454.CMB.2.raw
  modified_base (281)..(281): a, c, t, g, unknown or other
  misc_feature (281)..(281): n is a, c, g, or t
  modified_base (539)..(539): a, c, t, g, unknown or other
  misc_feature (539)..(539): n is a, c, g, or t
  modified_base (547)..(547): a, c, t, g, unknown or other
  misc_feature (547)..(547): n is a, c, g, or t
tcagacagtatatacacgaccggtgctcgatttagagagagtgtgttgggtttggggggaagcacctgtggttcttcctcctgctggtggcggctcccagatgggtcctgtctcagccgcagctgcgggagtcgggcccaggactggtgaagccttcggagaccctgtccctcacgtgcacggtctctggtgcctccatcgacagaagtaatttctactggggctggactccgccacgcccccgaggagaggggctgcagtggattgggagtctctattanagtggaacacctactacaaccccgtccctacaacggtcgagtcaccatacgtccgtggacacgtcgaggactactacgtttccagaaacgtgtagttcgtgtcggcccgccgccgacgacgggctgtctactactgtgtcagacagtcggtccactagtcggcgagtcgtctactaactttcgtaacgttacgtcgtttagggaccgttcggtcggggaccgaaacggggaccctacgggtccacccgtctccctacncgttcccncgacgtccccttaccgcgttacgggccctagtccggtccctccccgttggcccgttccgtcg

SEQ ID NO: 326557 - DNA, 525 bp, Homo sapiens
  misc_feature: GZ8MTXP01EZWHG.44.53.E09.1.454.CMB.2.raw
  modified_base (256)..(265): a, c, t, g, unknown or other
  misc_feature (256)..(265): n is a, c, g, or t
  modified_base (268)..(268): a, c, t, g, unknown or other
  misc_feature (268)..(268): n is a, c, g, or t
  modified_base (312)..(312): a, c, t, g, unknown or other
  misc_feature (312)..(312): n is a, c, g, or t
  modified_base (319)..(319): a, c, t, g, unknown or other
  misc_feature (319)..(319): n is a, c, g, or t
  modified_base (351)..(351): a, c, t, g, unknown or other
  misc_feature (351)..(351): n is a, c, g, or t
  modified_base (401)..(401): a, c, t, g, unknown or other
  misc_feature (401)..(401): n is a, c, g, or t
tcagacagtatatacacgaccggtgctcgatttagagagagtgtgttgagctctgggagaggagccccagccttgggattcccaggtgttttcattcagtgatcaggactgaacacagaggactcaccatggagtttgggctgagctggattttccttgctgctattttaaaaggtgtccagtgtgaggtgcagttggtggagtcgtgggggagtttggaaagccgtggggatccttagactctcctgtgcagtcnnnnnnnnnntcncacgtacgacgtacgtcgcgcgtcgcgcgcgcgacggaggaggnggtcggnggtgtcgtacgtagaacgacgcgacgagacgngacgacgacacacacgacgacgacgacgacgacgacacacacacacacanagagagtagtaacgtaacgtaacgtacgtacgtacgtacgtacgacgacgagaacgaacgacgacgacgaacgaacgacgacgacgaacgacgtaacgtacgtacgttacgttaacgttcggtg

SEQ ID NO: 326558 - DNA, 614 bp, Homo sapiens
  misc_feature: GZ8MTXP01BBNNG.44.53.E09.1.454.CMB.2.raw
  modified_base (481)..(481): a, c, t, g, unknown or other
  misc_feature (481)..(481): n is a, c, g, or t
  modified_base (518)..(518): a, c, t, g, unknown or other
  misc_feature (518)..(518): n is a, c, g, or t
  modified_base (531)..(531): a, c, t, g, unknown or other
  misc_feature (531)..(531): n is a, c, g, or t
  modified_base (606)..(606): a, c, t, g, unknown or other
  misc_feature (606)..(606): n is a, c, g, or t
tcagacagtatatacacgaccggtgctcgatttagagagagtgtgttgagctctgggagaggagccccagccttgggattcccaggtgttttcattcagtgatcaggactgaacacagaggactcaccatggagtttgggctgagctggattttccttgctgctattttaaaaggtgtccagtgtgaggtgcagttggtggagtcgtgggggtaggtttggtaaagccgtggggagtcccttagactctcctgtgcagcctctggattcactttcagtaaccgcctaggagtcgacccgtgggtccgccaggcctccggaggggaacgggggctggggaggtgggggtgaccgttattaacggaaccaaagctggacggtgggacagcagacctaacgctcgaccacccgtaggaaacggcaagtacttacacctatctacgaaggagtataggtaaatttaacgaaaagtagttacggtntcctcgtggacaggtatacgaacacgtccagaaaccncggaagaccacgngcccgtattacgttacttggtcgtgggttacgttgtttccgaagttcccgggcaacggggtaccttcggtaaccnccgttccc

SEQ ID NO: 326559 - DNA, 658 bp, Homo sapiens
  misc_feature: GZ8MTXP01BFQ0V.44.53.E09.1.454.CMB.2.raw
  modified_base (274)..(274): a, c, t, g, unknown or other
  misc_feature (274)..(274): n is a, c, g, or t
  modified_base (302)..(302): a, c, t, g, unknown or other
  misc_feature (302)..(302): n is a, c, g, or t
  modified_base (635)..(635): a, c, t, g, unknown or other
  misc_feature (635)..(635): n is a, c, g, or t
tcagacagtatatacacgaccggtgctcgatttagagagagtgtgttgggtttgggggaagcacctgtggttcttcctcctgctggtggcggctcccagatgggtcctgtctcagccgcagctgcgggagtcgggcccaggactggtgaagccttcggagaccctgtccctcacgtgcacggtctctggtgcctccatcgacagaagtaatttctactgggctggatccgccagcccccaggagagggctgcagtggattgggagtctctatanagtgggaacacctactacaacccgtccncaacggtcgagtcaccatatccgtgacacgtcgaggacactagttttcccagtaaacgtggagtttcgtgtacggcccgccgccgacacgggctcgtctactactgtcgtcagacagtcgggtccgacctatcgggacaggttcgtctactaaatttcgtaactaccggtcgtttacggggaaccgttcggttacgggggacccaaacgggggtaccctacgggggttacccaacccggttccttccccgttcaacgttccccgttcaacggtccccttaccccaaccgaaaccgggggtccccagttccccgggttcccgtttcccccccgnggggtccccgcccccgttccggg

SEQ ID NO: 326560 - DNA, 560 bp, Homo sapiens
  misc_feature: GZ8MTXP01CZY5A.44.53.E09.1.454.CMB.2.raw
  modified_base (274)..(274): a, c, t, g, unknown or other
  misc_feature (274)..(274): n is a, c, g, or t
  modified_base (351)..(351): a, c, t, g, unknown or other
  misc_feature (351)..(351): n is a, c, g, or t
  modified_base (497)..(497): a, c, t, g, unknown or other
  misc_feature (497)..(497): n is a, c, g, or t
  modified_base (503)..(503): a, c, t, g, unknown or other
  misc_feature (503)..(503): n is a, c, g, or t
tcagacagtatatacacgaccggtgctcgatttagagagagtgtgttgggtttgggggaagcacctgtggttcttcctcctgctggtggcggctcccagatgggtcctgtctcagccgcagctgcgggagtcgggcccaggactggtgaagccttcggagaccctgtccctcacgtgcacggtctctggtgcctcatcgacagaagtaatttctactggggctggatccgccagccccaggagaggggctgcagtggattgggatctctattanagtgggaacacctactacaacccgtccctcaacggtcgagtcaccatactcgtggacacgtcgagacacagtttccngaaagtgagttctgtcggcccgccgccgacaccgggctcgtctactactgtgtcagacagtcgggccgctagtggcaggtcgtctctaacttcgtactacgcttgggacgtcgtcggggccaaggggcctacggtcaccgtctccncatccncgacgcccttaccgaccttacgggcccagtccgtccttccccttggcccgttcctcg

SEQ ID NO: 326561 - DNA, 615 bp, Homo sapiens
  misc_feature: GZ8MTXP01A7LDF.44.53.E09.1.454.CMB.2.raw
  modified_base (283)..(283): a, c, t, g, unknown or other
  misc_feature (283)..(283): n is a, c, g, or t
  modified_base (599)..(599): a, c, t, g, unknown or other
  misc_feature (599)..(599): n is a, c, g, or t
tcagacagtatatacacgaccggtgctcgatttagagagagtgtgttgggtttggggggaagcacctgtggttcttcctcctgctggtggcggctcccagatgggtcctgtctcagccgcagctgcgggagtcgggcccaggactggtgaagccttcggagaccctgtccctcacgtgcacggtctctggtgcctccatcgacagaagtaatttctacgtggggctggactccgccacgcccccaggagaggggctgcaggtggagttgggagtctctattanagtagggaacacctactaccaaccccgtccctcaacggtcgagtcaccatactccgtggacacgtcgagacactacgtttcccagaaacgtgtagttcgtgtcggcccgcccgccgacgaccgctcgtcctactactgtcgtcagacagttcgggccctccgtagtcggctaggtccgtctactacttcgtactacggtcttacggggacgttcgcggggaccaacggggacctaccgggtccacccgtccgtcctcgactcccttcgacggcccttcccgacgaccgggccctacgtcccggttccctcccccgnggtcccgcccgtccgg

SEQ ID NO: 326562 - DNA, 588 bp, Homo sapiens
  misc_feature: GZ8MTXP01EN3IN.44.53.E09.1.454.CMB.2.raw
  modified_base (428)..(428): a, c, t, g, unknown or other
  misc_feature (428)..(428): n is a, c, g, or t
  modified_base (491)..(491): a, c, t, g, unknown or other
  misc_feature (491)..(491): n is a, c, g, or t
  modified_base (575)..(575): a, c, t, g, unknown or other
  misc_feature (575)..(575): n is a, c, g, or t
tcagacagtatatacacgaccggtgctcgatttagagagagtgtgttgggtttggggggaagcacctgtggttcttcctcctgctggtggcggctcccagatgggtcctgtctcagccgcagctgcgggagtcgggcccaggactggtgaagccttcggagaccctgtccctcacgtgcacggtctctggtgcctccatcgacagaagtaatttctactggggctggatccgccacgccccaggagagggctgcagtggagttgggagtctctattagtagtggaacacctactacacccgtcctacaacggtcgagtcaaccatactccgtggacacgtcgaggactactacgtttcccagtaaacgtgagttcgtgtcggcccgccgccgacaccggtctcgtacttactactgtcgtacagaacngtcgggtcctccttagtggcgtaggttctctactaacttctactacggtcttcgggagttcgngggaccaaagggtccaggtcaccgtctcctcactccttcgacgcccttaccgccaacgggccctacgtccggttccttccccgngcccgttcgtccg

SEQ ID NO: 326563 - DNA, 629 bp, Homo sapiens
  misc_feature: GZ8MTXP01DYFE8.44.53.E09.1.454.CMB.2.raw
  modified_base (614)..(614): a, c, t, g, unknown or other
  misc_feature (614)..(614): n is a, c, g, or t
tcagacagtatatacacgaccggtgctcgatttagagagagtgtgttgggtttggggggaagcacctgtggttcttcctcctgctggtggcggctcccagatgggtcctgtctcagccgcagctgcgggagtcgggcccaggactggtgaagccttcggagaccctgtccctcacgtgcacggtctctggtgcctccatcgacagaaagttaatttctacgtggggctggactccgccacgcccccgaggagaggggctgcgaggtggagttgggagtctctattagagtaggaacacctaactaccaaccccgtccctacgaaccggtcgacgtacaacctatactccgtaggacacgtacgaaggactacgtacgtttccagtaaagtgtagttcgtggtcgcccgccgccgacacggtctcgtctactactgtcgtacagacgtagtcgggtcccgtccgtagtcggcgtacggttcgtctactaacttcgtacgtacgtcgttcgggacgttcggtcggggaccgaaacgggcccgtacgggtccacccgtcctcctcactccttcgacgtcccttaccgaccgacggccctacgtccgtccctccccgnggtcccttccgtccg

SEQ ID NO: 326564 - DNA, 699 bp, Homo sapiens
  misc_feature: GZ8MTXP01ECH9Z.44.53.E09.1.454.CMB.2.raw
  modified_base (281)..(281): a, c, t, g, unknown or other
  misc_feature (281)..(281): n is a, c, g, or t
tcagacagtatatacacgaccggtgctcgatttagagagagtgtgttgagctctgggagaggagccccagccttgggattcccaggtgttttcattcagtgatcaggactgaacacagaggactcaccatggagtttgggctgagctggattttccttgctgctattttaaaaggtgtccagtgtgaggtgcagttggtggagtcgtgggggaggtttggtaaagccgtggggagtcccttagactctcctgtgcagcctctggattcactttcagtaacncctggatcgaccgtgggtcccgcaggcctccgagggagggctggagtgggtgcgtatagacaagctgacggtggacagcagactaacgctcgacacccgtagaaacgcagacttacactatctacgaaagagtatagtaatttaacgaaaagtacgtaacgggttcgttctaccgttaggggactaagggtaacttacgggaaaaccacgggtaaccccttaacggaaaacccgaaccgggaaacgggtaaccaaaccggtaaccgggtaaccctttaccgttaaacgtttaaccgttcgggttacggtagggggttaagtttcgggttttaccggaaccggttttacccgggggaacccggttaacccgggggtaaaccccggttcgggttaaaccccgttcccgggtttaaccccg

SEQ ID NO: 326565 - DNA, 601 bp, Homo sapiens
  misc_feature: GZ8MTXP01B1QI3.44.53.E09.1.454.CMB.2.raw
  modified_base (277)..(277): a, c, t, g, unknown or other
  misc_feature (277)..(277): n is a, c, g, or t
  modified_base (352)..(352): a, c, t, g, unknown or other
  misc_feature (352)..(352): n is a, c, g, or t
  modified_base (586)..(586): a, c, t, g, unknown or other
  misc_feature (586)..(586): n is a, c, g, or t
tcagacagtatatacacgaccggtgctcgatttagagagagtgtgttgggtttgggggaagcacctgtggttcttcctcctgctggtggcggctcccagatgggtcctgtctcagccgcagctgcgggagtcgggcccaggactggtgaagccttcggagaccctgtccctcacgtgcacggtctctggtgcctccatcgacagaagtaatttctactggggctggatccgccagcccccaggagaggggctgcagtggattgggagtctctattanagtggaacactactacacccgtcctcaacggtcgagtcaccatactcgtgacacgtcgaggacactagtttcccngaaacgtgtagttctggtggcccgccgccgacacgggctgtctactactgtgtcagacagtcggggtcccaccgttagtcgggctagggtcttcttacaactttcgtacttacggtcgtttcggggaccgtcgtcgggggaccaaaggggccctacgggtcacccgtctcctcactcccttcgacgccttacccgccgttaacgggcccctacgtccgggttcccttcccccgnggtcccgccccgtcg

SEQ ID NO: 326566 - DNA, 692 bp, Homo sapiens
  misc_feature: GZ8MTXP01A6YGB.44.53.E09.1.454.CMB.2.raw
tcagacagtatatacacgaccggtgctcgatttagagagagtgtgttgagctctgggagaggagccccagccttgggattcccaggtgttttcattcagtgatcaggactgaacacagaggactcaccatggagtttgggctgagctggtattttccttgctgcttattttaaaaggtgtccagtgtgaggtgctaggttggtggagtcgtgggggtaggtttggtaaagccgtggggatccttagactctcctgtgcagcctctggtattcactttcagtaacgcctggatcgaccgtgggtcccgccaggcctaccggaggggaacgggggctggggaggtgggggttcggaccgttaagttaacggaaacctaaaggcgtaggaccgggtggacagcagacctaacgctggccaacccgtagaaacgcagtactcacatcacaagagatagtaattaacgaaaagtagtaacggtgttactcgttacggacgtaaggtaacttacggaaaccgacgtacccgtaacggaaaacccgaccggaaacgggaactaacccgaacggtcccgttaacttacgtttaacgcggttaccgtaggggttacgtttcgggtttaccaaggggttttcccgggaacccgttaaacgggggtaacccctttcgggtaaccccgttaacccggtttcccc

SEQ ID NO: 326567 - DNA, 621 bp, Homo sapiens
  misc_feature: GZ8MTXP01BZM58.44.53.E09.1.454.CMB.2.raw
  modified_base (452)..(452): a, c, t, g, unknown or other
  misc_feature (452)..(452): n is a, c, g, or t
  modified_base (477)..(477): a, c, t, g, unknown or other
  misc_feature (477)..(477): n is a, c, g, or t
tcagacagtatatacacgaccggtgctcgatttagagagagtgtgttgagctctgggagaggagccccagccttgggattcccaggtgttttcattcagtgatcaggactgaacacagaggactcaccatggagtttgggctgagctggattttccttgctgctattttaaaaggtgtccagtgtgaggtgcagttggtggagtcgtgggggtaggtttggtaaagccgtggggagtcccttagactctcctgtgcagcctctggattctactttcagtaacgcctggatcgaccgtgggtcccgccgaggcctccggaggggaaggggctgggagtggggttggccgttaattacgaaccaaagcgtggacggtggacagcagactacgctgcacccgtgaacgcagacttcactatctacaaagagatagaattacaaaagtatacggtntactctggactaagactacgaaacncgacctagaaaccaccggaacggaccacgcgaacccgttacttacgttaccttggttaccgtgggttacgtttcgggtttctaacggtttccgggaacccgtaacggggtaaccccgttgggtaaccccgttaacccggttccc

SEQ ID NO: 326568 - DNA, 610 bp, Homo sapiens
  misc_feature: GZ8MTXP01D9WG4.44.53.E09.1.454.CMB.2.raw
  modified_base (441)..(441): a, c, t, g, unknown or other
  misc_feature (441)..(441): n is a, c, g, or t
  modified_base (450)..(450): a, c, t, g, unknown or other
  misc_feature (450)..(450): n is a, c, g, or t
tcagacagtatatacacgaccggtgctcgatttagagagagtgtgttgagctctgggagaggagccccagccttgggattcccaggtgttttcattcagtgatcaggactgaacacagaggactcaccatggagtttgggctgagctggattttcctgctgctattttaaaaggtgtccagtgtgaggtgcagttggtggagtcgtgggggtaggtttggtaagcgtggggatccttagactctctgtgcagcctctggattcacttttcagtaacgcctggatacgaccgtgggtcccgccaggcctccggaaggggagggggcgtgggtaggtggggttggcccgttaattaacgaaccaaagcgtaggacggtggacagcagactaacgctgcacccgtagaagcagattcacatcacaagagatagattaacaaagntacgggttntactcaggacagatacgaacacgaccgtaacgaaaccgaccggaagaccaccgtacgtaaccgttacttagttacgttggtcggttagggttacgtttcgggttaccgaacgggttaccgggaaccggtaacgggtacccttcgggtaacccttcccgtc

SEQ ID NO: 326569 - DNA, 565 bp, Homo sapiens
  misc_feature: GZ8MTXP01EYK9D.44.53.E09.1.454.CMB.2.raw
  modified_base (190)..(190): a, c, t, g, unknown or other
  misc_feature (190)..(190): n is a, c, g, or t
  modified_base (223)..(223): a, c, t, g, unknown or other
  misc_feature (223)..(223): n is a, c, g, or t
  modified_base (268)..(268): a, c, t, g, unknown or other
  misc_feature (268)..(268): n is a, c, g, or t
  modified_base (285)..(285): a, c, t, g, unknown or other
  misc_feature (285)..(285): n is a, c, g, or t
  modified_base (396)..(396): a, c, t, g, unknown or other
  misc_feature (396)..(396): n is a, c, g, or t
  modified_base (415)..(415): a, c, t, g, unknown or other
  misc_feature (415)..(415): n is a, c, g, or t
  modified_base (436)..(436): a, c, t, g, unknown or other
  misc_feature (436)..(436): n is a, c, g, or t
tcagacagtatatacacgaccggtgctcgatttagagagagtgtgttgggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcgcaccatcctcctgcactgganccagcggtaatattcttagtcttaactttgtctcctggtatcaanatcatccaaggtaaacnccccaaactcatcatctatgagcctatagacgtcctgtaggttctaatcgcttccactgcctacagtccgacaacgcgcctcctgactatctctggctcgagctgagacgngctgtattacgtatgttcncgtcgtagtattcggtcgtcnctattcgtaactttatcgtacgtttacgggaaagtcggggaactaaacgggttcccgtaaccggtcgttaacgggcttacgttcggttaccgaagttaccgaaaggttaaactcggaaccgtaaggggg

SEQ ID NO: 326570 - DNA, 637 bp, Homo sapiens
  misc_feature: GZ8MTXP01AG787.44.53.E09.1.454.CMB.2.raw
  modified_base (557)..(557): a, c, t, g, unknown or other
  misc_feature (557)..(557): n is a, c, g, or t
tcagacagtatatacacgaccggtgctcgatttagagagagtgtgttgggtttgggggaagcacctgtggttcttcctcctgctggtggcggctcccagatgggtcctgtctcagccgcagctgcgggagtcgggcccaggactggtgaagccttcggagaccctgtccctcacgtgcacggtctctggtgcctccatcgacagaagtaatttctacgtgggctggactccgccacgccccaggagaggggctgcaggtggagttgggagtctctattataggtaggaacacctactaccaaccccgtccctacaacggtcgagtcaccatactcgtggacacgtcgaggacactacgtttcctagtaaacgtgtagttcgtggtcggcccgccgccgacgaccggctcgtacctactactgtcgtcagacagttcgggtcccaccgtagtcggcgtaggtccgtctactattccgtacgtacggtcgttacgggaccgtcgtcggggacccaacggggccctacgggtccacccgttcctcccgtcaccgttcccncgaccgtccccttaccgaacccgaccggggtcccctacggttcccggttccccttcccccgttgggccccgttcccgtcg

SEQ ID NO: 326571 - DNA, 720 bp, Homo sapiens
  misc_feature: GZ8MTXP01ES2CR.44.53.E09.1.454.CMB.2.raw
  modified_base (278)..(278): a, c, t, g, unknown or other
  misc_feature (278)..(278): n is a, c, g, or t
tcagacagtatatacacgaccggtgctcgatttagagagagtgtgttgggtttggggggaagcacctgtggttcttcctcctgctggtggcggctcccagatgggtcctgtctcagccgcagctgcgggagtcgggcccaggactggtgaagccttcggagaccctgtccctcacgtgcacggtctctggtgcctcatcgacagaagtaattctacgtgggctggactccgccacgccccgaggagagggctgcaggtggagttgggatctctattanagtgggaacaccgtaactaccaacccgtccctacgaacggtcgacgtccaccatactcgtagacacgtcgaggacactacgtttccagaaacgtgtagttcgtgtcggcccgccgccgacacggacttgtactacctagtgtgtccagactagtcgggtcccgactagttcggcgtagggtcctctactaactttccgtaacgttaaccggtcgtttacggggtaccgttccggttagggggaccccgtaaaacgggggtaaccccgtacccgggtaccgtaaaccccggtttcccgtaacccttacgttacccttaccccttccgtaaccggtacccccttccccgaaaccccggaaacccgggggtcccctaaccggtttcccccgggtttacccccgttcccccccggtttacggggccccccgttccccgttccccgg

SEQ ID NO: 326572 - DNA, 611 bp, Homo sapiens
  misc_feature: GZ8MTXP01ELS6W.44.53.E09.1.454.CMB.2.raw
  modified_base (177)..(177): a, c, t, g, unknown or other
  misc_feature (177)..(177): n is a, c, g, or t
  modified_base (421)..(421): a, c, t, g, unknown or other
  misc_feature (421)..(421): n is a, c, g, or t
tcagacagtatatacacgaccggtgctcgatttagagagagtgtgttgagctctgggagaggagccccagccttgggattcccaggtgttttcattcagtgatcaggactgaacacagaggactcaccatggagtttgggctgagctggattttccttgctgctattttaaaaggtntccagtgtgaggtgcagttggtggagtcgtgggggaggtttggaaagccgtgggagtcccttagactctcctgtgcagcctctggattcactttcagtaacgctggatgaccgtgggtccgcaggctccgagggaggctggagtgggtgcgtatagacaagctgacgtggacagcagactaacgctgccaccgtagaaacggcagacttacacatctacaagagatagaacttaacgaaaagtntaacgggttctactacgtaggacaaggtaactaacgaaacgaccgtaccgtaaacggaaacccgaccggaacgtaaccaaccgtaaccggtaaccgttacttaacgttacgttcggtcggttagggttacgtttcggttacgaacggttccgggaaccgtaacgggtacccttcggtcccgttccgtccg

SEQ ID NO: 326573 - DNA, 630 bp, Homo sapiens
  misc_feature: GZ8MTXP01B2ZCE.44.53.E09.1.454.CMB.2.raw
  modified_base (449)..(449): a, c, t, g, unknown or other
  misc_feature (449)..(449): n is a, c, g, or t
  modified_base (474)..(474): a, c, t, g, unknown or other
  misc_feature (474)..(474): n is a, c, g, or t
  modified_base (548)..(548): a, c, t, g, unknown or other
  misc_feature (548)..(548): n is a, c, g, or t
tcagacagtatatacacgaccggtgctcgatttagagagagtgtgttgagctctgggagaggagccccagccttgggattcccaggtgttttcattcagtgatcaggactgaacacagaggactcaccatggagtttgggctgagctggattttccttgctgctattttaaaaggtgtccagtgtgaggtgcagttggtggagtcgtgggggaggtttggtaaagccgtggggagtcccttagactctcctgtgcagcctcgtggattcactttcagtaacgcctggactgacccgtgggtcccgccgaggctccggaggggaaggggcgtgggtaggttgggggttggcccgttaagttacggaaaccgaaaggccgtaggacgggtgggacaggcagacctaacgctgaccacccgtagaaacggcagactccaccatctacaaganatagattaacaaagagttaacggtntctacgtcggacagtactaggaaactacgccctacggaaaccaaccggtacgggaacctaacgcgtaacccgtnttacgttacttggtacgtggttacgttcgggtttcaacggttcgggaaccgtacgggacccttgggtccttaacccgttccc

SEQ ID NO: 326574 - DNA, 647 bp, Homo sapiens
  misc_feature: GZ8MTXP01AGEU8.44.53.E09.1.454.CMB.2.raw
tcagacagtatatacacgaccggtgctcgatttagagagagtgtgttgggtttggggggaagcacctgtggttcttcctcctgctggtggcggctcccagatgggtcctgtctcagccgcagctgcgggagtcgggcccaggactggtgaagccttcggagaccctgtccctcacgtgcacggtctctggtgcctccatcgaacagaagttaatttctacgtggggctggactccgccacgcccccgagggaggaggggctggcgaggtggagttgggagttctctattagtagtacgggaacacctactaaccaccccgtccctcgaacggtcgacgtcaccatacgtcgtcggacacgtcgaacggacacgtacgtttcccagtaaacgtgtacgttctggtcggcccgcgccgacacgggctgtctactactgtgtcagacgtagtcgggtaccctccgtagtcggactaggttcgtctactaacgttctaactccggtcgttacggggtacgttcggtcggggaccgaaacggggtccctaccggtcctaccggttcctaacctcgacctccgttaccgcgtcccttacccgaccgcgggaacccctagtcccggttccctccccgttggtcccgcccgtccg

SEQ ID NO: 326575 - DNA, 754 bp, Homo sapiens
  misc_feature: GZ8MTXP01BJ96K.44.53.E09.1.454.CMB.2.raw
  modified_base (286)..(286): a, c, t, g, unknown or other
  misc_feature (286)..(286): n is a, c, g, or t
tcagacagtatatacacgaccggtgctcgatttagagagagtgtgttgggtttggggggaagcacctgtggttcttcctcctgctggtggcggctcccagatgggtcctgtctcagccgcagctgcgggagtcgggcccaggactggtgaagccttcggagaccctgtccctcacgtgcacggtctctggtgcctccatcgacagaagtaatttctacgtggggctggactccgccacgccccccgaggaggaggggctgcaggtggagttgggagtctctattanagtggaacacctactaccacccgtcctcaacggtcgacgtcaccatacgtccgtggaccacgtcgaggacactacgtttcccagaacgtgtacgttcgtgtcggccgcccgccgacgacggctgtctactacgtgtcgttcgagtacgtagttcggggtcccgtacccgttagtcgggaccgtacgggttccgttacttactaaacgtttccggttaaaccgtacggttccggtttcgggggtaaccgttccggggttccggggggaacccgtaaaccgggggtaccccgtaacccgggggttaccctaaccccgggtttcccgttccccttacgttaaccgttccccttacccgaccggtacccccttacccggaaaccccgaaaccgggggtccccctaacccggttccccgggtttccccctttcccccccggttaccggggtcccccgttcccccgttcccggg

SEQ ID NO: 326576 - DNA, 687 bp, Homo sapiens
  misc_feature: GZ8MTXP01C3WAB.44.53.E09.1.454.CMB.2.raw
  modified_base (191)..(191): a, c, t, g, unknown or other
  misc_feature (191)..(191): n is a, c, g, or t
  modified_base (199)..(199): a, c, t, g, unknown or other
  misc_feature (199)..(199): n is a, c, g, or t
  modified_base (485)..(485): a, c, t, g, unknown or other
  misc_feature (485)..(485): n is a, c, g, or t
  modified_base (565)..(565): a, c, t, g, unknown or other
  misc_feature (565)..(565): n is a, c, g, or t
tcagacagtatatacacgaccggtgctcgatttagagagagtgtgttggggtttggggggggtcacaagaggcagcgctctcgggacgtctccaccatggcctgggctctgctgctcctcactctcctcacccaggacacagggtcctgggccagtctgccctgactcagcctgcctccgtgtctgggtcncctggacngtcggtcaccatctcctgcacgtggacgccaggtcgttaaattatttcttagttacctttaactttcgtccttccgttggtactacaaacatcacttaccgaacggttaaaaccgcccccccaaaacttcaacctactactatagacgtaccgtaactaaagtacgacccgtaccgtacgggttacgttaactacgtcgtaccttacctacgtcctacctaaccggtaccggtaacccaacgtaaccgcccgtccctacgtacgacctactcgtcgacgtcacggntcggagacggacgagttatagttatttagtgttcgtactcgtacgtaagtttcgtcgttcgtactacttacgtacctttnttaggttccttagggtaaacgggtcgggtaaacgacccgggttacaccggttaacccgtgttaaccggcaacccgaacgaaccgaacccctaatcggttacctaacgttcccgttaaccccg

SEQ ID NO: 326577 - DNA, 600 bp, Homo sapiens
  misc_feature: GZ8MTXP01DFVWN.44.53.E09.1.454.CMB.2.raw
  modified_base (180)..(180): a, c, t, g, unknown or other
  misc_feature (180)..(180): n is a, c, g, or t
  modified_base (277)..(277): a, c, t, g, unknown or other
  misc_feature (277)..(277): n is a, c, g, or t
  modified_base (296)..(296): a, c, t, g, unknown or other
  misc_feature (296)..(296): n is a, c, g, or t
  modified_base (428)..(428): a, c, t, g, unknown or other
  misc_feature (428)..(428): n is a, c, g, or t
  modified_base (457)..(457): a, c, t, g, unknown or other
  misc_feature (457)..(457): n is a, c, g, or t
tcagacagtatatacacgaccggtgctcgatttagagagagtgtgttgagctctgggagaggagccccagccttgggattcccaggtgtttcattcagtgatcaggactgaacacagaggactcaccatggagtttgggctgagcttggtattttccttgctgtactatttttaaaaggngtccagtgtgaggtgcagttggtggagtcgtgggggtagtttggtaagcgtgggatccttagctctctgtgcagcctctggtattcacttcagtacnctggatcgaccgtggtccncgaggctacggagggaggggctgggaggtggggttacggccgttagtaacggaaactaaaggcgtacggacgggtggacagacagacctacgactcgacgacccggtagaacggcagacttacacatccaanaagatatacgaattacaaagtacttacgngtctacgtggactagatacgaacctgaccgtagaaaccgacggaagaccacacggccttattaacgtcgttgtcgggttaggttacgtttcggttactcgggccggtaacgtacgggtacccgttcgtaacccgttccgtccc

SEQ ID NO: 326578 - DNA, 652 bp, Homo sapiens
  misc_feature: GZ8MTXP01AKT90.44.53.E09.1.454.CMB.2.raw
  modified_base (237)..(237): a, c, t, g, unknown or other
  misc_feature (237)..(237): n is a, c, g, or t
  modified_base (486)..(486): a, c, t, g, unknown or other
  misc_feature (486)..(486): n is a, c, g, or t
  modified_base (507)..(507): a, c, t, g, unknown or other
  misc_feature (507)..(507): n is a, c, g, or t
  modified_base (530)..(530): a, c, t, g, unknown or other
  misc_feature (530)..(530): n is a, c, g, or t
tcagacagtatatacacgaccggtgctcgatttagagagagtgtgttgggtttggggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacaggtcggtcaccatctcctgcactggagccagcgtaatnttcttagtcttaacttgtctctgtatcaacatcatcaaggtaaacacccccaaatcatcatctatgaggtacctaagtaacgacggtcccgttacggtagggggttttactaaacgtccgtacctttacccacctcgtcccgtacccaacggtacccggaacctaacccgacccgggtaccccttcccgtacgaacctaacttccgtcgtcggggcctaccggaggtccgtaggacgggacggacggtntaggtatttaattagttgttncgttctagttagttcgttcgtcnctatctatttgtcgttcgtacgggtaaggtcgggttaccgtaaacggttccgtaacccgttcgacgggttccaccggaacccaacggaaccccaacccacgttccgtccttaaccgttcccg

SEQ ID NO: 326579 - DNA, 570 bp, Homo sapiens
  misc_feature: GZ8MTXP01BICSK.44.53.E09.1.454.CMB.2.raw
  modified_base (277)..(277): a, c, t, g, unknown or other
  misc_feature (277)..(277): n is a, c, g, or t
  modified_base (358)..(358): a, c, t, g, unknown or other
  misc_feature (358)..(358): n is a, c, g, or t
  modified_base (391)..(391): a, c, t, g, unknown or other
  misc_feature (391)..(391): n is a, c, g, or t
  modified_base (428)..(428): a, c, t, g, unknown or other
  misc_feature (428)..(428): n is a, c, g, or t
  modified_base (520)..(520): a, c, t, g, unknown or other
  misc_feature (520)..(520): n is a, c, g, or t
  modified_base (524)..(524): a, c, t, g, unknown or other
  misc_feature (524)..(524): n is a, c, g, or t
  modified_base (527)..(527): a, c, t, g, unknown or other
  misc_feature (527)..(527): n is a, c, g, or t
  modified_base (542)..(542): a, c, t, g, unknown or other
  misc_feature (542)..(542): n is a, c, g, or t
tcagacagtatatacacgaccggtgctcgatttagagagagtgtgttgggtttgggggaagcacctgtggttcttcctcctgctggtggcggctcccagatgggtcctgtctcagccgcagctgcgggagtcgggcccaggactggtgaagccttcggagaccctgtccctcacgtgcacggtctctggtgccgccatcgacagaagtaatttctactggggctggatccgccagcccccaggagaggggctgcagtggattgggagtctctattanagtgggaacacctactacaacccgtccctcaacggtcgagtcaccatatccgtggacacgtcgaggacactagttttcccngtaaacgtgagttctgtggcccgccgccgaacncgggctgtctactactgtgtcagacagtggggtcccncctagtggcaggtcgtctcaatttcactacgctttggggacctcgtgggggaccaaggggccctacgggtccacccggtctcctcactcccncgcnccnccgaccgaccggccncgtccgtccctcccgccgtccgccgtcg

SEQ ID NO: 326580 - DNA, 611 bp, Homo sapiens
  misc_feature: GZ8MTXP01EGI18.44.53.E09.1.454.CMB.2.raw
  modified_base (280)..(280): a, c, t, g, unknown or other
  misc_feature (280)..(280): n is a, c, g, or t
  modified_base (544)..(544): a, c, t, g, unknown or other
  misc_feature (544)..(544): n is a, c, g, or t
tcagacagtatatacacgaccggtgctcgatttagagagagtgtgttgggtttgggggggaagcacctgtggttcttcctcctgctggtggcggctcccagatgggtcctgtctcagccgcagctgcgggagtcgggcccaggactggtgaagccttcggagaccctgtccctcacgtgcacggtctctggtcgcctccatcgacagaagtaatttctactggggctggatccgccacgcccccaggagaggggctgcagtgattgggagtctctattanagtggaacactacacaacccgtcctacaacggtcagtcacatatccgtgacacgtacgaggacactacgttttcccagaaaacgtgagttccgtagtcggacccgccgccgaacgacgggcttgtcctaactacttgtgacaagacgtacgtcggtccgtacgtacgtacgcgacgtcgtactactaacttacgtacgtacgtcgtacggtacgtcggtcgggacgaacggaccgtaccgtaccgtacctcctcctcttactcncgtaccgtccaccgaccgaccggaaccgtacgtccgttcccgttcccgttccgtccgttcccgtccg

SEQ ID NO: 326581 - DNA, 628 bp, Homo sapiens
  misc_feature: GZ8MTXP01A5GI3.44.53.E09.1.454.CMB.2.raw
  modified_base (271)..(271): a, c, t, g, unknown or other
  misc_feature (271)..(271): n is a, c, g, or t
  modified_base (277)..(277): a, c, t, g, unknown or other
  misc_feature (277)..(277): n is a, c, g, or t
  modified_base (407)..(407): a, c, t, g, unknown or other
  misc_feature (407)..(407): n is a, c, g, or t
tcagacagtatatacacgaccggtgctcgatttagagagagtgtgttgggtttgggggaagcacctgtggttcttcctcctgctggtggcggctcccagatgggtcctgtctcagccgcagctgcgggagtcgggcccaggactggtgaagccttcggagaccctgtccctcacgtgcacggtctctggtgcctccatcgacagaagtaatttctactggggctggactccgccacgccccaggagagggctgcagtggattgggagtctntattanagtggaacacctactaccacccgtcctacgaacggtcgatcaccatactccgtgacacgtcgaggactactagtttccctagaaagtgagttctgtcgcccgccgccgacacggcctgtctactactgtntcagacagtcgggtccactagtcggctagggtcctctacgtaaactttcctaacgttaccggtccgtttagggggaaccgttcggtagggggaccccaaagggggacccctacggggttcccaacccgggttcttaacccgtcacttccccttcgaccgtcccttacccgaccgaaccgggcccctagtccggtcccttcccccgttggcccgcccgtccg

SEQ ID NO: 326582 - DNA, 807 bp, Homo sapiens
  misc_feature: GZ8MTXP01ADU9T.44.53.E09.1.454.CMB.2.raw
  modified_base (191)..(191): a, c, t, g, unknown or other
  misc_feature (191)..(191): n is a, c, g, or t
  modified_base (224)..(224): a, c, t, g, unknown or other
  misc_feature (224)..(224): n is a, c, g, or t
  modified_base (236)..(236): a, c, t, g, unknown or other
  misc_feature (236)..(236): n is a, c, g, or t
tcagacagtatatacacgaccggtgctcgatttagagagagtgtgttgggtttggggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcgcaccatctcctgcactggacnccagtcgtaatnttctagtcttaacttgtctctgtatcaacatacataccgaaggtaaaccaccccaaactcatcatctagtgacggacctaagtaacggacggtcccttacggtacgggggttttactaaacgttcggtacctttcccaaccttcggaccctacccgaacggttaccccgggacaacccgtaccgggtccccgttacccttacggaaacctaacttccgttaccggttcggggtcccttacccggacgggtacccgttagggaacggggaacccgggtaaggggtccttaagggttaaactttttaaagttttacgtttagggtttacggtccccgttaacggtaaacgggtttagtttaccgggtttaccgggttcccgtacgttaacgtttaccctaaacgttttagttcggttaccgtttaacgggggtaaacggttacggggttaaacccgtaacgggttacccgttaacccggttaccgttacgggttcccaaaccggtaaccccctaaacgggaacccccctaaaaccccgtcggttaccgtaacccgttaacccgttttcccccg

SEQ ID NO: 326583 - DNA, 651 bp, Homo sapiens
  misc_feature: GZ8MTXP01AEWPE.44.53.E09.1.454.CMB.2.raw
  modified_base (280)..(280): a, c, t, g, unknown or other
  misc_feature (280)..(280): n is a, c, g, or t
tcagacagtatatacacgaccggtgctcgatttagagagagtgtgttgggtttggggggaagcacctgtggttcttcctcctgctggtggcggctcccagatgggtcctgtctcagccgcagctgcgggagtcgggcccaggactggtgaagccttcggagaccctgtccctcacgtgcacggtctctggtgcctccatcgacagaagttattctacgtggggctggactccgccacgcccccgaggaggaggggctggcaggtggagttgggagtcctntattataggtacggaacacctactaccaaccccgtccctacaacggtcgagtcaccatatccgtggacacgtcgaggaccactacgtttccagtaaacgtgtagttcgtgtcggcccgcccgcccgacgaccgggtctcgttacctactacgtgtacgtcagactacgtcgggtccgaccgtagtggcgtagggttcctcgtactaacttccgtacgttaccggtcgttacggggtacccgttcggtacgggggaccgaacggggaccctaccgggtccacccggttcctaaccctcacctccttaccgacgtccccttccacccggaacgccctagtcccggtccctccccgttcgcccgccccgtaacg

SEQ ID NO: 326584 - DNA, 572 bp, Homo sapiens
  misc_feature: GZ8MTXP01CITK9.44.53.E09.1.454.CMB.2.raw
  modified_base (271)..(271): a, c, t, g, unknown or other
  misc_feature (271)..(271): n is a, c, g, or t
  modified_base (277)..(277): a, c, t, g, unknown or other
  misc_feature (277)..(277): n is a, c, g, or t
  modified_base (432)..(432): a, c, t, g, unknown or other
  misc_feature (432)..(432): n is a, c, g, or t
  modified_base (525)..(525): a, c, t, g, unknown or other
  misc_feature (525)..(525): n is a, c, g, or t
tcagacagtatatacacgaccggtgctcgatttagagagagtgtgttgggtttggggggaagcacctgtggttcttcctcctgctggtggcggctcccagatgggtcctgtctcagccgcagctgcgggagtcgggcccaggactggtgaagccttcggagaccctgtccctcacgtgcacggtctctggtgcctccatcgacagaagtaatttctactggggctggatccgccacgccccgaggagagggctgcagtggattgggatctntattanagtaggaacacctactaccaacccgtccctacaacggtcgacgtcaccatactccgtagacgacgtcgaggacacgtacgtttcccagtaaacgtgagttctgtcggccgccgccgacgacgctgtctactactgtgtcagacgagtcgggtccncctagtgcgagtcgtctctaattcgtactacgtcgttcgggacgtcgtcggggaccgaaacgggcctacggtccaccgtcctccctcactccncgacgccttcccgcgacggcccagtccgtctccccgttgccgcctcg

SEQ ID NO: 326585 - DNA, 722 bp, Homo sapiens
  misc_feature: GZ8MTXP01DCLBN.44.53.E09.1.454.CMB.2.raw
tcagacagtatatacacgaccggtgctcgatttagagagagtgtgttgggtttggggggaagcacctgtggttcttcctcctgctggtggcggctcccagatgggtcctgtctcagccgcagctgcgggagtcgggcccaggactggtgaagccttcggagaccctgtccctcacgtgcacggtctctggtgcctcatcgacagaagttaatttctacgtgggctggactccgccacgccccgaggaggaggggctgcaggtggtagttgggatcgtctattagtagtacgggaacacctactaccaccccgtccctacgacggtcgagtcactatactccgaggacacgtacgacggacactacgtttccagtaaacgtgtagttcgtgtcggcccgcccgccgacgaccggtctcgtactactactcgtgtacacgactacggtcgggtacccgtactacgtggtcgagggttcctactacgtaacttcgttaacgttacggtcggttacgggtacgtccggtacgggggacccgtaaacggggacccgtaccgggttaccaccccggtttcctaacccttcccgttaacgttccccttcgtaaaccccgggtccccttaaccccggaaccccgggttaaacccggggccccctaacgggtttcccccgggttcccccttttccccccggggacgggtcccccgttccccgttccccggg

SEQ ID NO: 326586 - DNA, 636 bp, Homo sapiens
  misc_feature: GZ8MTXP01AGK3F.44.53.E09.1.454.CMB.2.raw
  modified_base (277)..(277): a, c, t, g, unknown or other
  misc_feature (277)..(277): n is a, c, g, or t
  modified_base (442)..(442): a, c, t, g, unknown or other
  misc_feature (442)..(442): n is a, c, g, or t
tcagacagtatatacacgaccggtgctcgatttagagagagtgtgttgggtttggggggaagcacctgtggttcttcctcctgctggtggcggctcccagatgggtcctgtctcagccgcagctgcgggagtcgggcccaggactggtgaagccttcggagaccctgtccctcacgtgcacggtctctggtgcctcatcgacagaagtaatttctactgggctggatccgccacgcccccaggagagggctgcaggtggagttgggagtctctatanagtggaacacctactaccaacccgtccctacaacggtcgagtcaccatactccgtggacacgtcgaggacactagtttcccagaaacgtgagttcgtggtcggcccgccgtccgacgaccggtctcgtcttactacttgtcgttcgaagacagttcggggtcccnccgtagttggacgacggttcgtctacgtaacttcgtactacggtcgttcggggacgtcgtcggggacctaacggggaccctaaccgggtcctaaccggtcctccgtcactcccttcgtacgccccttccgacccgacgggtccccaagttcccgggttcccttcccccggttcgggtccccgttcccgtcccgg

SEQ ID NO: 326587 - DNA, 653 bp, Homo sapiens
  misc_feature: GZ8MTXP01CRDEG.44.53.E09.1.454.CMB.2.raw
  modified_base (282)..(282): a, c, t, g, unknown or other
  misc_feature (282)..(282): n is a, c, g, or t
tcagacagtatatacacgaccggtgctcgatttagagagagtgtgttgggtttggggggaagcacctgtggttcttcctcctgctggtggcggctcccagatgggtcctgtctcagccgcagctgcgggagtcgggcccaggactggtgaagccttcggagaccctgtccctcacgtgcacggtctctggtgcctccatcgacagaagtaatttctacgtggggctggactccgccacgcccccgaggagaggggctgcagtggagttgggatctctattanagtaggaacacctactaccaacccgtccctacaacggtcgagtcacatactcgtggacacgtcgagacactacgtttccagaaacgtgtagttcgtgtcggcccgccgccgacgaccggtctgtactactactgtctcagacagtcgggtccgacttagtcggcgaggttcgtactactaacttcgtacttacggtcgttacggggacttcggtcggggaccgtaacggggccctaccgggtcctacccggtccttccctcgttacttccccgttactacccgtccccttacccgacccgaacccggggtcccctaacggttccccgggttcccctttccccccggttcgggtccccgttccccgttccgg

SEQ ID NO: 326588 - DNA, 672 bp, Homo sapiens
  misc_feature: GZ8MTXP01DS04K.44.53.E09.1.454.CMB.2.raw
  modified_base (270)..(270): a, c, t, g, unknown or other
  misc_feature (270)..(270): n is a, c, g, or t
  modified_base (276)..(276): a, c, t, g, unknown or other
  misc_feature (276)..(276): n is a, c, g, or t
tcagacagtatatacacgaccggtgctcgatttagagagagtgtgttgggtttgggggaagcacctgtggttcttcctcctgctggtggcggctcccagatgggtcctgtctcagccgcagctgcgggagtcgggcccaggactggtgaagccttcggagaccctgtccctcacgtgcacggtctctggtgcctccatcgacagaagtaatttctacgtggggctggatccgccacgccccaggagaggggctgcagtggattggatctntattanagtggaacacctactacacccgtcctcacggtcgagtcacatactcgtgacacgtcgaggacactacgtttccctagaaacgtgtagttcgtgtcggcccgcccgccgacgaccggtctcgtcctactactgtgtcagactagtcggtccgtctagtcggcgtaggtccgtctactaactttcgtacgttacggtcgtttacggggtaccgttccggtacggggacccgaaacggggacccgtaccgggttacctaccccggttcctaacccttcttaacttccccgttacgaaaccggtccccttaccccgacccggttaaaccggggtccccctaacggtttccccggggttcccctttccccccggttcgggtccccgttcccccgttcccgg

SEQ ID NO: 326589 - DNA, 716 bp, Homo sapiens
  misc_feature: GZ8MTXP01AXZW6.44.53.E09.1.454.CMB.2.raw
  modified_base (638)..(638): a, c, t, g, unknown or other
  misc_feature (638)..(638): n is a, c, g, or t
tcagacagtatatacacgaccggtgctcgatttagagagagtgtgttgggtttgggggaagcacctgtggttcttcctcctgctggtggcggctcccagatgggtcctgtctcagccgcagctgcgggagtcgggcccaggactggtgaagccttcggagaccctgtccctcacgtgcacggtctctggtcgcctccatcgacagaagttaatttctacgtggggctggactccgccacgccccgaggagagggctgcaggtggagttgggagtctactattagaggtacggaactacctactaccaaacccgtcccctacgaacggtccgacgtccaacctatacgtccggtaggaccaccggtacgaacggacctaccgttacgttttccccgtagtaaaagttcgaacgtttcgtacggtcggccccggcccggcccggaccgtaccggggtaccttcgggtaccttaccgttacgtcggttacgtacgacggtacgacgttcggggtcccgtaccctagtcggacgtaggtcgttactactaacttcgtacgtcggtcgttaggggtaccgtcggtcggggaccgtaacggggaccctacgggtacctaccggttcctccctacaccgttcccnccgtaccgtcccttaccgacccggttaccgggcccctacggtcccggttcccctccccggttcgtcccgttcccgtcg

SEQ ID NO: 326590 - DNA, 629 bp, Homo sapiens
  misc_feature: GZ8MTXP01D47N1.44.53.E09.1.454.CMB.2.raw
tcagacagtatatacacgaccggtgctcgatttagagagagtgtgttgggtttggggggaagcacctgtggttcttcctcctgctggtggcggctcccagatgggtcctgtctcagccgcagctgcgggagtcgggcccaggactggtgaagccttcggagaccctgtccctcacgtgcacggtctctggtgcctccatcgacagaagtaatttctacgtggggctggactccgccacgcccccgaggaggaggggctgcaggtggtagttgggagtctctattagtaggtggaacacctactaccaaccccgtccctacgaacggtcgacgtcacatactccgtgacacgtcgagacactagtttcccagaaacgtgagttctggtcggcccgccgccgacgacggtctcgtcctactactgtgtcagacagtcgggtccacctagtcggcagggttctctacgtaattccgtaacttcggtcgttcggggaccgttcggtcgggggaccgaaacggggtaccctccggggtacctacccgtccttccctcgttactcccttcaccgtcccttaccgacccgacgggccctacgtccggttccctccccgttgggccccttccgtccg

SEQ ID NO: 326591 - DNA, 677 bp, Homo sapiens
  misc_feature: GZ8MTXP01BJ1XA.44.53.E09.1.454.CMB.2.raw
  modified_base (280)..(280): a, c, t, g, unknown or other
  misc_feature (280)..(280): n is a, c, g, or t
  modified_base (285)..(285): a, c, t, g, unknown or other
  misc_feature (285)..(285): n is a, c, g, or t
  modified_base (451)..(451): a, c, t, g, unknown or other
  misc_feature (451)..(451): n is a, c, g, or t
  modified_base (455)..(455): a, c, t, g, unknown or other
  misc_feature (455)..(455): n is a, c, g, or t
tcagacagtatatacacgaccggtgctcgatttagagagagtgtgttgggtttggggggaagcacctgtggttcttcctcctgctggtggcggctcccagatgggtcctgtctcagccgcagctgcgggagtcgggcccaggactggtgaagccttcggagaccctgtccctcacgtgcacggtctctggtgcctccatcgacagaagttaatttctacgtggggctggactccgccacgcccccgagggagaggggctgcaggtggagttgggagtctntatanagtggaactacctactaccaacccgtccctacgaaccggtcgacgtaccaaccagtactccggaggacacgtcgacggtacacgttacgtttcccgtagaaacgttgtacgttcgtggtacggcccgcccgcgacaccgggtctcgtactactacgtgtcgtcganacgngtcggtcccgtactagtcggacgtcggtcgtctactaactttcgtaacgtacgtcgttacgggacgtcggtacggggtaccgaaacgggggaccctaccgggtcccacccgttccgttaaccctacgttaaccttcccgttcaacgtccccaacccgttacccgaacgggtcccctacgtccccggtttccctcccccgttcgggtcccgttccccgtccgg

SEQ ID NO: 326592 - DNA, 631 bp, Homo sapiens
  misc_feature: GZ8MTXP01DLSHH.44.53.E09.1.454.CMB.2.raw
  modified_base (193)..(193): a, c, t, g, unknown or other
  misc_feature (193)..(193): n is a, c, g, or t
  modified_base (307)..(307): a, c, t, g, unknown or other
  misc_feature (307)..(307): n is a, c, g, or t
  modified_base (316)..(316): a, c, t, g, unknown or other
  misc_feature (316)..(316): n is a, c, g, or t
tcagacagtatatacacgaccggtgctcgatttagagagagtgtgttggggtttggggggggtcacaagaggcagcgctctcgggacgtctccaccatggcctgggctctgctgctcctcactctcctcacccaggacacagggtcctgggcccagtctgccctgactcagcctgcctccgtgtcgtgggtcncctggacagtcgtcaccatctctgcactggacgccagcgtaatattcttagtcttaactttgtctctgtatcaacatcatccgaagtaaaccgacccccaaactcatcatctangacgctaanaacgcgcctacgtagggtttactaagtcgcttccactcgtccctaccaacggtcccgacaaccgccgtaccctcccagacactctcgtacggctcgaggcacggaggacgagctagtattagttattgtacgctagtagtattcggttcgtcgtctattacctaattttcgtacggtttccgttaagggtaacgggtacgggttaaaccgtaacggttacccgtacccggttcgttaccgggttccgaaccgtaaccccgaaaaccggtaacccccaaacccctacggttaccgtaaccgttaacctttccccgg

SEQ ID NO: 326593 - DNA, 713 bp, Homo sapiens
  misc_feature: GZ8MTXP01AB442.44.53.E09.1.454.CMB.2.raw
  modified_base (188)..(188): a, c, t, g, unknown or other
  misc_feature (188)..(188): n is a, c, g, or t
  modified_base (195)..(195): a, c, t, g, unknown or other
  misc_feature (195)..(195): n is a, c, g, or t
  modified_base (209)..(209): a, c, t, g, unknown or other
  misc_feature (209)..(209): n is a, c, g, or t
  modified_base (220)..(220): a, c, t, g, unknown or other
  misc_feature (220)..(220): n is a, c, g, or t
  modified_base (232)..(232): a, c, t, g, unknown or other
  misc_feature (232)..(232): n is a, c, g, or t
tcagacagtatatacacgaccggtgctcgatttagagagagtgtgttgggtttgggggggtcacaagaggcagcgctctcgggacgtctccaccatggcctgggctctgctgctcctcactctcctcacccaggacacagggtcctgggcccagtctgccctgactcagcctgcctcgtgtctggtcnctggacngtcgcacatctccngcacgtggacnccagtcgtaatnttcttagtcttaacttgtctcctgtatcaacatcatacaacgtaaacgacccccaaatcatcatctatgagctaatagacgcctcgtagggtttctaagtcgcttccactcgaccctaccgaacgtacccgacaaccgtccggccctacctacgactaactcgttcgtacggggccttaccggaggtcgtacggaacgggaaccggtagggtaccttaaggttaatttaacgtttaagttgtttcgtaccgttagtaacggttactttcgggtttccgtaccggtacgtaacttaccgtaacgttttagttaccggtttccggtttaacggggtaaacgggttaccggggttaaaccggtaaacgggttcccgtaacccgggttaccggttaacgggttcccaacccgggtaaccccgaaaccgggaaccccgtaaacccccttacgttaccgggttaaccccttaaccgttttcccccgg

SEQ ID NO: 326594 - DNA, 838 bp, Homo sapiens
  misc_feature: GZ8MTXP01EC94O.44.53.E09.1.454.CMB.2.raw
  modified_base (190)..(190): a, c, t, g, unknown or other
  misc_feature (190)..(190): n is a, c, g, or t
  modified_base (221)..(221): a, c, t, g, unknown or other
  misc_feature (221)..(221): n is a, c, g, or t
  modified_base (232)..(232): a, c, t, g, unknown or other
  misc_feature (232)..(232): n is a, c, g, or t
tcagacagtatatacacgaccggtgctcgatttagagagagtgtgttgggtttggggggggtcacaagaggcagcgctctcgggacgtctccaccatggcctgggctctgctgctcctcactctcctcacccaggacacagggtcctgggcccagtctgccctgactcagcctgcctcgtgtcgtggtcnctggacagtcgtcaccatctctgcactgganccagcgtaatnttcttagtctttaactttgtctcctggtactacaacatcactaccaaacggttaaaaccgaccccctaaaactacatacacttacttaatacgaacggtaccttaagtaaaggacgggtacccgttacgttaacgggggttttacttaaacgttccggtacctttacccaccgttcgtaccccgtacccgtaaaccggttaccccgggaacctaacccgtaacccgggtccccctttacccccgtacggtaaacctaaaccgttccgttccggttcggggtacccttacccggaagggtccgttaacgggaacggggtaacggaacgggttaccgttagttaaacgtttaacttttaagttttgggtttaactcggttaccgttaaagggttaacgtttacggttccgttaacggtaccttaactttacccgtaatttttacggtttacggttaccgtttacgggggaaacggttaacgggggaaccgtaaaccgggttacccgtaacccggttacccggttaacgggttcccaaaccggttaaccccggaaaccgaacccccggtaaacccctaaccttcggttaaccccttaaccgtttccccg

SEQ ID NO: 326595 - DNA, 702 bp, Homo sapiens
  misc_feature: GZ8MTXP01AJ3K0.44.53.E09.1.454.CMB.2.raw
  modified_base (441)..(441): a, c, t, g, unknown or other
  misc_feature (441)..(441): n is a, c, g, or t
  modified_base (580)..(580): a, c, t, g, unknown or other
  misc_feature (580)..(580): n is a, c, g, or t
tcagacagtatatacacgaccggtgctcgatttagagagagtgtgttgggtttggggggaagcacctgtggttcttcctcctgctggtggcggctcccagatgggtcctgtctcagccgcagctgcgggagtcgggcccaggactggtgaagccttcggagaccctgtccctcacgtgcacggtctctggtgcctccatcgacagaagttaatttctacgtggggctggactccgccacgcccccaggaggaggggctggcaggtggagttgggatctctattagaggtcggaactacctactaccaaccccgtccctacgaaccggtcgacgtaccaccatacgtccgtaggaccgtacgtcggaaggaccactacgtttccctagaaacgttgagttcgtggtcggcccgcccgccgacgacggtctgtctactatgtntcgagaccgtgtcgggtccacgtagtcgggctacggtcgtctacgtaatttcgtaacgttcggtcgttacggggtccgttcgcggggaacccgtaacgggggaaccctccggggtaaccctccccggttcctccccgtnttaacccgttccccgttacgtaaccccgtccccgttaaccccgaaccggttaacccggggtcccctacggtttccccggttcccccgttcccccggttaagggcccccgttcccgttcccgg

SEQ ID NO: 326596 - DNA, 690 bp, Homo sapiens
  misc_feature: GZ8MTXP01DDEBE.44.53.E09.1.454.CMB.2.raw
tcagacagtatatacacgaccggtgctcgatttagagagagtgtgttgggtttggggggaagcacctgtggttcttcctcctgctggtggcggctcccagatgggtcctgtctcagccgcagctgcgggagtcgggcccaggactggtgaagccttcggagaccctgtccctcacgtgcacggtctctggtgcctccatcgacagaagtaattctactgggctggatccgccacgccccaggagagggctgcagtggattgggagtctctattatagtacgggaacacctaactaccacccccgtccctacgaacggtcgacgtccaacctatactccggtggaccacgttacgaggtacacttacgtttccagtaaacgtgtagttctagtcggcccgtccgccgacgaccggctagtcctactacgtgtcgtcagacgtagtcgggtcccgacgtagtggctaggttcgtctacgtaacttcgtaaccgtacgtcgttacggggacgttcggttacggggaccgtaaacggggcccgtaaccgggtccgaacccgttcccgttaaccctcttaaccttccccacgtacccgtccccgttaccccgacccgttaaaccggggtccccctaacggttccccggttaaccccgttccccccggttaggtcccccgttccccgtttcccggg

SEQ ID NO: 326597 - DNA, 633 bp, Homo sapiens
  misc_feature: GZ8MTXP01ATGG0.44.53.E09.1.454.CMB.2.raw
  modified_base (291)..(291): a, c, t, g, unknown or other
  misc_feature (291)..(291): n is a, c, g, or t
  modified_base (427)..(427): a, c, t, g, unknown or other
  misc_feature (427)..(427): n is a, c, g, or t
tcagacagtatatacacgaccggtgctcgatttagagagagtgtgttgggtttgggggaagcacctgtggttcttcctcctgctggtggcggctcccagatgggtcctgtctcagccgcagctgcgggagtcgggcccaggactggtgaagccttcggagaccctgtccctcacgtgcacggtctcgtggtcgcctccatcgacagtaagtaatttctacgtggggctggactccgccacgcccccgaggaggaggggctgcgaggtgggtagttgggagtctcgtattanagtagggaacacgtacacaaccccgtccctcacgtcgagtcaccatactcgtcgacacgtcgaggactactacgtttccctgaaacgtgagttctggtcgcccgccgccgacacgggctcgtctactactgtcgtnaggtacaggtcggtaccgtccgttacgttggccgtaggttccgtcttactaacgttcgttaactacggtcgttggggtaaccgtcggaggggtacccgaacgggcccggtaacgtccgtacccggttctccctcactcccttacgccaccgttcccgccgttaacggccctacgtccgttcccttccccgcgtccgttcccgtccg

SEQ ID NO: 326598 - DNA, 689 bp, Homo sapiens
  misc_feature: GZ8MTXP01DO330.44.53.E09.1.454.CMB.2.raw
  modified_base (481)..(481): a, c, t, g, unknown or other
  misc_feature (481)..(481): n is a, c, g, or t
tcagacagtatatacacgaccggtgctcgatttagagagagtgtgttgggtttgggggaagcacctgtggttcttcctcctgctggtggcggctcccagatgggtcctgtctcagccgcagctgcgggagtcgggcccaggactggtgaagccttcggacgaccctgtccctcacgtgcacggtctctggtcgcctccatcgacaagtaagttaatttctacgtggggctggactcccgccacgcccccgaggaggaggggctggcaggtggtagttgggagtcgtactattaagaggtaggaaacctacctaactaacccaaccccgttccctacgaaccggtcgacgtacctaaccattacgtccgtaggaaccacgtacgaggacctactacgtttccgtagaacgtgtacgttcgtggtcgcccgccgccgacacgggtctcgtactactactgtctacgagtacgcgtcggtaccnccgttagtggacgtaggttccgtctaacttaacgttcgttaacgtacggtcggtttaacgggcgtccgtacgggggaccgaaaccggggtcctaccgtaccgacccggttcctcccgtcacgtcccacgtccgtcccttaccccgaccgaaccggggtccctacgttccccgggttccccttccccggcgggtccccttcccgttccg

SEQ ID NO: 326599 - DNA, 642 bp, Homo sapiens
  misc_feature: GZ8MTXP01CR2LZ.44.53.E09.1.454.CMB.2.raw
  modified_base (269)..(269): a, c, t, g, unknown or other
  misc_feature (269)..(269): n is a, c, g, or t
  modified_base (273)..(273): a, c, t, g, unknown or other
  misc_feature (273)..(273): n is a, c, g, or t
  modified_base (278)..(278): a, c, t, g, unknown or other
  misc_feature (278)..(278): n is a, c, g, or t
tcagacagtatatacacgaccggtgctcgatttagagagagtgtgttgggtttggggggaagcacctgtggttcttcctcctgctggtggcggctcccagatgggtcctgtctcagccgcagctgcgggagtcgggcccaggactggtgaagccttcggagaccctgtccctcacgtgcacggtctctggtgcctcatcgacagaagttaatttctacgtggggctggactccgccacgcccccaggagaggggctgcaggtggatggntctntatanagagaacactactaccaccgtccacgacgtcgatcacatacgtcgtggagacgtcgacgactactacgtttcgagtaacgtgtagttcgtcggtcggcccgccgccgacgacgtctcgtactacgtactgtcgacacgacgtacgtcgggtaccgtacgttacgtcggacgtaggttctactactaacgttcggtacgtacggtcgtacgggacgtcggacgggaccgaacgggtaccgtaccggtcctaccgttcctcccgtcttaccttcccgacgtacccgtcccgttacccgaaccggacccgggtaaccctacggtttccccggttccctttcccccggcggtaaccccgttcccgtcg

SEQ ID NO: 326600 - DNA, 556 bp, Homo sapiens
  misc_feature: GZ8MTXP02IU2HO.44.53.E09.1.454.CMB.2.raw
tcagacagtatatacacgaccggtgctcgatttagagagagtgtgttgggtttgggggaagcacctgtggttcttcctcctgctggtggcggctcccagatgggtcctgtctcagccgcagctgcgggagtcgggcccaggactggtgaagccttcggagaccctgtccctcacgtgcatggtctctggtgcctccatcgacagaagtaatttctactggggctggatccgccagcccccaggagaggggctgcagtggattgggagtctctattatagtgggaacacctactacaacccgtccctcaacggtcgagtcaccatatccgtggacacgtcgaggacacagttttcctgaaagtgagttctgtggccgccgccgacacggctgtctactactgtgtcagacatgggtccgcctatggcaggtcgtctctaaattcttactacgcgttgggacgtcgtggggaccaagggaccacggtcaccgtctcctcactcctcacgccctaccaccgaacggcccaagtccggtccttcccccgtggcccgtccc

SEQ ID NO: 326601 - DNA, 554 bp, Homo sapiens
  misc_feature: GZ8MTXP02IQJON.44.53.E09.1.454.CMB.2.raw
  modified_base (356)..(356): a, c, t, g, unknown or other
  misc_feature (356)..(356): n is a, c, g, or t
  modified_base (422)..(422): a, c, t, g, unknown or other
  misc_feature (422)..(422): n is a, c, g, or t
  modified_base (508)..(508): a, c, t, g, unknown or other
  misc_feature (508)..(508): n is a, c, g, or t
  modified_base (548)..(548): a, c, t, g, unknown or other
  misc_feature (548)..(548): n is a, c, g, or t
tcagacagtatatacacgaccggtgctcgatttagagagagtgtgttgggtttgggggaagcacctgtggttcttcctcctgctggtggcggctcccagatgggtcctgtctcagccgcagctgcgggagtcgggcccaggactggtgaagccttcggagaccctgtccctcacgtgcacggtctctggtgcctccatcgacagaagtaatttctactggggctggatccgccagccccaggagaggggctgcagtggattgggagtctctattatagtgggaacacctactacaacccgtccctcaacggtcgagtcaccatatccgtggacacgtcgaggacacagttttcccngaaacgtgagtttctgtggcccgccgccgacacggctgtctactactgtgtcagacagtgggtccncctatggcagggtcgtctcaaatttctactacgcttgggacctcgtgggacccaagggaccacggttcaccgtctcctcatccctnacgcctccacaagggcccactcggtccttccccctggccnccctcg

SEQ ID NO: 326602 - DNA, 527 bp, Homo sapiens
  misc_feature: GZ8MTXP02IZA96.44.53.E09.1.454.CMB.2.raw
  modified_base (295)..(295): a, c, t, g, unknown or other
  misc_feature (295)..(295): n is a, c, g, or t
  modified_base (392)..(392): a, c, t, g, unknown or other
  misc_feature (392)..(392): n is a, c, g, or t
  modified_base (398)..(398): a, c, t, g, unknown or other
  misc_feature (398)..(398): n is a, c, g, or t
  modified_base (402)..(402): a, c, t, g, unknown or other
  misc_feature (402)..(402): n is a, c, g, or t
  modified_base (422)..(422): a, c, t, g, unknown or other
  misc_feature (422)..(422): n is a, c, g, or t
tcagacagtatatacacgaccggtgctcgatttagagagagtgtgttgagctctgggagaggagccccagccttgggattcccaggtgttttcattcagtgatcaggactgaacacagaggactcaccatggagtttgggctgagcgtgagtttcctgctgctatttaaagtgtccagtgtgaggtgcagttggtggagtcgtgggggaggtttggtaaagccgtggggagtcccttagactctcctgtgcagcctctggattcactttcagtaacgcctggatgacctggtccnccaggctcgagggagggctggagtgggtgcgtatagaacaagctgacggtggacagcagactacgctggccaccggtgaaacgcagattcaccatcncaaganatanataacaagatagtgtctctncagagagacacgacgacgacgaacgacgacgacgacgacgtactactactcgtcgtcgtacgttgttcgtaacgtcggtacgacggtaccgtacgtcgtacgtcg

SEQ ID NO: 326603 - DNA, 574 bp, Homo sapiens
  misc_feature: GZ8MTXP02HTCA5.44.53.E09.1.454.CMB.2.raw
  modified_base (300)..(300): a, c, t, g, unknown or other
  misc_feature (300)..(300): n is a, c, g, or t
  modified_base (357)..(357): a, c, t, g, unknown or other
  misc_feature (357)..(357): n is a, c, g, or t
  modified_base (431)..(431): a, c, t, g, unknown or other
  misc_feature (431)..(431): n is a, c, g, or t
tcagacagtatatacacgaccggtgctcgatttagagagagtgtgttgagctctgggagaggagccccagccttgggattcccaggtgttttcattcagtgatcaggactgaacacagaggactcaccatggagtttgggctgagctggattttccttgctgctattttaaaaggtgtccagtgtgaggtgcagttggtggagtcgtgggggaggtttggtaaagccgtggggagtcccttagactctcctgtgcagcctctggattcactttcagtaacgcctggatgacctgggtccnccaggctccgagggagggctggagtgggtgcgtatagaacaaagctgacggtggacngcagactacgctgcacccgtgaaacgcagattcaccatctacaagagatgaattacaaaaagtataacgggttntctctgacaagatagaacagaccgtaagaaaccgaccggaaggaaccacgtacgtaccgttacttacttacgtggtacgtagggtacttcggtttacaacggttccgggaccgtacgggaacccgttcggtaccctaccgtcc

SEQ ID NO: 326604 - DNA, 530 bp, Homo sapiens
  misc_feature: GZ8MTXP02I0N7U.44.53.E09.1.454.CMB.2.raw
  modified_base (301)..(301): a, c, t, g, unknown or other
  misc_feature (301)..(301): n is a, c, g, or t
  modified_base (321)..(321): a, c, t, g, unknown or other
  misc_feature (321)..(321): n is a, c, g, or t
  modified_base (410)..(410): a, c, t, g, unknown or other
  misc_feature (410)..(410): n is a, c, g, or t
  modified_base (467)..(467): a, c, t, g, unknown or other
  misc_feature (467)..(467): n is a, c, g, or t
  modified_base (474)..(474): a, c, t, g, unknown or other
  misc_feature (474)..(474): n is a, c, g, or t
  modified_base (480)..(480): a, c, t, g, unknown or other
  misc_feature (480)..(480): n is a, c, g, or t
tcagacagtatatacacgaccggtgctcgatttagagagagtgtgttgagctctgggagaggagccccagccttgggattcccaggtgttttcattcagtgatcaggactgaacacagaggactcaccatggagtttgggctgagctggattttccttgctgctaattttaaaaggtgtccagtgtgaggtgcagttggtggagtcgtgggggtaggtttggtaaagccgtggggagtcccttagactctcctgtgcagcctctggattcactttcagtaacgcctggatgacctgggccnccaggctccgagggagggcnggagtgggtgccgtattagaaccaaagctggacggtgggacagcagactacgctgccaccgtgaaagcaagattcaccatctacaaganatgaattacaaaagatacgtgtactctagcagatagaacagccagaacacgagacanacgcctntatacngtcgtggattggttacaagttccggctaacgggacctcggtacaccgtcc

SEQ ID NO: 326605 - DNA, 542 bp, Homo sapiens
  misc_feature: GZ8MTXP02HSL5K.44.53.E09.1.454.CMB.2.raw
tcagacagtatatacacgaccggtgctcgatttagagagagtgtgttgagctctgggagaggagccccagccttgggattcccaggtgttttcattcagtgatcaggactgaacacagaggactcaccatggagtttgggctgagctggattttccttgctgctattttaaaaggtgtccagtgtgaggtgcagttggtggagtcgtgggggaggtttggtaaagccgtggggatcccttagactctcctgtgcagcctctggattcactttcagtaacgcctggatgacctgggtccgccaggcctccgaggggaagggctggagtgggtgcgtattagaaccaaagctgacggtgggacagcagactacgctgcaccgtgaaacgcagacttcaccatctacaagagatagattaacaaaagatacgtagtctctgacagatagaacagaccagaacacgagacacacgctacttatactgtactgggcttaggtttcaagtttcgggaccacggggtaaccctcggtacctacccgtcc

SEQ ID NO: 326606 - DNA, 541 bp, Homo sapiens
  misc_feature: GZ8MTXP02J3D1N.44.53.E09.1.454.CMB.2.raw
  modified_base (372)..(372): a, c, t, g, unknown or other
  misc_feature (372)..(372): n is a, c, g, or t
tcagacagtatatacacgaccggtgctcgatttagagagagtgtgttgggtttgggggagcacctgtggttcttcctcctgctggtggcggctcccagatgggtcctgtctcagccgcagctgcgggagtcgggcccaggactggtgaagccttcggagaccctgtccctcacgtgcacggtctctggtgcctccatcgacagaagtaatttctactggggctggatccgccagcccccaggagaggggctgcagtggattgggagtctctattatagtgggaacacctactacaaccccgtccctcaacggtcgagtcaccatatccgtggacacgtcgaggacacagttttcccctgaaacgtgagttcngtggccgccgcgacacggctgtctactactgtgtcagacatgggtccgcctatggcaggtcgtctcaattctactacgcttggggacgtctggggccagggaccacggtcacgtctcctcatctcacgcctccaccaagggcccatcggtcttccccctggcgccctcg

SEQ ID NO: 326607 - DNA, 551 bp, Homo sapiens
  misc_feature: GZ8MTXP02GT4LG.44.53.E09.1.454.CMB.2.raw
  modified_base (354)..(354): a, c, t, g, unknown or other
  misc_feature (354)..(354): n is a, c, g, or t
  modified_base (540)..(540): a, c, t, g, unknown or other
  misc_feature (540)..(540): n is a, c, g, or t
tcagacagtatatacacgaccggtgctcgatttagagagagtgtgttgggtttgggggaagcacctgtggttcttcctcctgctggtggcggctcccagatgggtcctgtctcagccgcagctgcgggagtcgggcccaggactggtgaagccttcggagaccctgtccctcacgtgcacggtctctggtgcctccatcgacagaagtaatttctactggggctggatccgccagccccaggagaggggctgcagtggattgggagtctctattatagtgggaacacctactacaacccgtcctcaacggtcgagtcaccatatccgtggacacgtcgaggacacagtttcccngaaacgtgagttctgtggccgccgccgacacggctgtctactactgtgtcagacagtgggtcccgctagtggcaggtcgtctcaattctactacgcttggggacgtcgtggggccaagggaccacggtcaccgtctcctcactcctcacgccctccaccaacgggcccagtccggtcctcccccgnggccgccctcg

SEQ ID NO: 326608 - DNA, 562 bp, Homo sapiens
  misc_feature: GZ8MTXP02IYH3H.44.53.E09.1.454.CMB.2.raw
  modified_base (480)..(480): a, c, t, g, unknown or other
  misc_feature (480)..(480): n is a, c, g, or t
tcagacagtatatacacgaccggtgctcgatttagagagagtgtgttgggtttgggggaggcgtggtccagcccgggaggtccctgagactctcctgtgtagcctctgggttctcattcgatagatttggtttgcactgggtccgccaggctccaggcaaggggccggagtgggtggcagtcatctccgacgatggaagtgagaagtattactcagactccgtgaaggccgattcacatctccagagacaattccaagaatatgctgtattgcaaatgaacagcgtgagagttgacgacacgtctgtttattactgtgcgaggggacctcgaaaggaaacggttcgggaatcataaactactactatttgatggatgtcgtggggacgagggggacgtcggtcaccgtctcctcagccttccgaccgaacgggcccagtccgtccttcccccgtgcccgtccctcgtcctcccatcgacnccacgtcgtacggggcacgacgcggccgtggctcgccgtggtacaacggtacttacgtccgtataactctgtcctgacgcgg

SEQ ID NO: 326609 - DNA, 573 bp, Homo sapiens
  misc_feature: GZ8MTXP02IEN7K.44.53.E09.1.454.CMB.2.raw
  modified_base (323)..(323): a, c, t, g, unknown or other
  misc_feature (323)..(323): n is a, c, g, or t
  modified_base (421)..(421): a, c, t, g, unknown or other
  misc_feature (421)..(421): n is a, c, g, or t
  modified_base (567)..(567): a, c, t, g, unknown or other
  misc_feature (567)..(567): n is a, c, g, or t
tcagacagtatatacacgaccggtgctcgatttagagagagtgtgttgggtttggggaagcacctgtggttcttcctcctgctggtggcggctcccagatgggtcctgtctcagccgcagctgcgggagtcgggcccaggactggtgaagccttcggagaccctgtccctcacgtgcacggtctctggtgcctccatcgacagaagtaatttctactgggctggatccgccagcccccaggagagggctgcagtggattgggagtctctattatagtgggaacacctactacaacccgtccctcaacggtcgagtcaccatanccgtggacacgtcgaggacacacgttttcctagaaacgtgagttctgtggccgccgccgacacggctgtctactactgtgtcagacagtggggtcccnctatggcagggtctctactaaatttcctaactacgctttggggacttcgtgggggacccaaaggggcccacgggtcaaccgttctcctcatccctcacgccctccaaccaaggggcccccaagttccggtccttcccccgtggccncccctg

SEQ ID NO: 326610 - DNA, 552 bp, Homo sapiens
  misc_feature: GZ8MTXP02JB3F1.44.53.E09.1.454.CMB.2.raw
  modified_base (355)..(355): a, c, t, g, unknown or other
  misc_feature (355)..(355): n is a, c, g, or t
  modified_base (493)..(493): a, c, t, g, unknown or other
  misc_feature (493)..(493): n is a, c, g, or t
  modified_base (502)..(502): a, c, t, g, unknown or other
  misc_feature (502)..(502): n is a, c, g, or t
tcagacagtatatacacgaccggtgctcgatttagagagagtgtgttgggtttgggggaagcacctgtggttcttcctcctgctggtggcggctcccagatgggtcctgtctcagccgcagctgcgggagtcgggcccaggactggtgaagccttcggagaccctgtccctcacgtgcacggtctctggtgcctccatcgacagaagtaatttctactggggctggatccgccagcccccaggagaggggctgcagtggattgggagtctctattatagtgggaacacctactacaacccgtccctcaacggtcagtcaccatatccgtggacacgtcgaggacacagtttcccngaaacgtgagttctgtggccgcgccgacacgggctgtctactactgtgtcagacatgggtccgcctatggcagggtcgtctcaattctactacgctttgggactcgtggggccaaggggccacgggtcaccgtctccncactccctnacgccctaccaccaacgggcccagtccggtcttcccccgtggccgcctcg

SEQ ID NO: 326611 - DNA, 505 bp, Homo sapiens
  misc_feature: GZ8MTXP02J3NS7.44.53.E09.1.454.CMB.2.raw
  modified_base (320)..(320): a, c, t, g, unknown or other
  misc_feature (320)..(320): n is a, c, g, or t
  modified_base (420)..(420): a, c, t, g, unknown or other
  misc_feature (420)..(420): n is a, c, g, or t
tcagacagtatatacacgaccggtgctcgatttagagagagtgtgttgggtttggggggtcacaagaggcagcgctctcgggacgtctccaccatggcctgggctctgctgctcctcactctcctcacccaggacacagggtcctgggcccagtctgtcctgactcagcctgcctccgtgtctgggtcgcctggacagtcggtcaccatctcctgcactggagccagcggtaatattcttagtcttaacttgtctcctggtatcaacatcatccaggtaaagcccccaaactcatcatctatgagcctatagaggccctnaggggtttctaatcgcttccactgcctccaagtccggcacacgcctccctgacatctctgggctccaggctgagacgaggctgatttattattgttgctnagatgttcgtcgcatcacgtttatgtcttcggaagtgggaccaaggtcacgtcctagtcagcccaaggccaacccatcgtcactc

SEQ ID NO: 326612 - DNA, 526 bp, Homo sapiens
  misc_feature: GZ8MTXP02HPAWD.44.53.E09.1.454.CMB.2.raw
  modified_base (299)..(299): a, c, t, g, unknown or other
  misc_feature (299)..(299): n is a, c, g, or t
  modified_base (397)..(397): a, c, t, g, unknown or other
  misc_feature (397)..(397): n is a, c, g, or t
  modified_base (412)..(412): a, c, t, g, unknown or other
  misc_feature (412)..(412): n is a, c, g, or t
tcagacagtatatacacgaccggtgctcgatttagagagagtgtgttgagctctgggagaggagccccagccttgggattcccaggtgttttcattcagtgatcaggactgaacacagaggactcaccatggagtttgggctgagctggattttccttgctgctatttaaaaggtgtccagtgtgaggtgcagttggtggagtcgtgggggaggtttggtaaagccgtggggagtcccttagactctcctgtgcagcctctggattcactttcagtaacgcctggatgacctgggtccnccaggctccgagggaggctggagtgggtgcgtatagaacaaagctgacggtggacagcagactacgctgcaccgtgaaagcagatcacatctcaaganatagattacaaaagntacggtgtctctgacagatagaacacgcctagaaacaccgaggacacgacgccgtacgtatacgtgtacgtgggattggttcaagttcggactacgggacctcggtctacgtcc

SEQ ID NO: 326613 - DNA, 573 bp, Homo sapiens
  misc_feature: GZ8MTXP02GHNBH.44.53.E09.1.454.CMB.2.raw
  modified_base (301)..(301): a, c, t, g, unknown or other
  misc_feature (301)..(301): n is a, c, g, or t
  modified_base (324)..(324): a, c, t, g, unknown or other
  misc_feature (324)..(324): n is a, c, g, or t
  modified_base (441)..(441): a, c, t, g, unknown or other
  misc_feature (441)..(441): n is a, c, g, or t
tcagacagtatatacacgaccggtgctcgatttagagagagtgtgttgagctctgggagaggagccccagccttgggattcccaggtgttttcattcagtgatcaggactgaacacagaggactcaccatggagtttgggctgagctggattttccttgctgctaattttaaaaggtgtccagtgtgaggtgcagttggtggagtcgtgggggaggtttggtaaagccgtggggagtcccttagactctcctgtgcagcctctggattcactttcagtaacgcctggatgacctgggtccnccaggctccgagggagggctggngtgggtgccgtatagaaccaaagctgacggtggacagcagactacgctgccacccgtagaaacgcaagacttccaaccatacctacaaagagatagaattacaaaaagtatacggtntactctagacagatagaacacgacctagaaaccaccgaggacacagccgtactattacgtgtcgtgggtattcggtttacaacggtttccggggaccgtaacggggtaacccctgggtaccctaccggttcc

SEQ ID NO: 326614 - DNA, 560 bp, Homo sapiens
  misc_feature: GZ8MTXP02GGDQM.44.53.E09.1.454.CMB.2.raw
  modified_base (260)..(260): a, c, t, g, unknown or other
  misc_feature (260)..(260): n is a, c, g, or t
  modified_base (299)..(299): a, c, t, g, unknown or other
  misc_feature (299)..(299): n is a, c, g, or t
  modified_base (306)..(306): a, c, t, g, unknown or other
  misc_feature (306)..(306): n is a, c, g, or t
tcagacagtatatacacgaccggtgctcgatttagagagagtgtgttgagctctgggagaggagccccagccttgggattcccaggtgttttcattcagtgatcaggactgaacacagaggactcaccatggagtttgggctgagctggattttcctgctgctattttaaaaggtgtccagtgtgaggtgcagttggtggagtcgtgggggaggtttggtaaagccgtggggagtcccttagactctcctgtgcagcctntggattcactttcagtaacgcctggatgacctgggtccnccaggcnccgaggggagggctggagtgggtgccgtatagaaaccaaagctggacggtggacagcagactacgctgccaccgtgaaacgcagacttcaccatctacaagagatagattacaaaagaagtacgtagtcgtctgcagatagaacacgaccacgtttaacgaaccgacgacgacacgaccgtactacttactgtacgtcggtacgtggtttcgtaacgttcggaccgacgggacccgtcggtccgtaccgtcccg

SEQ ID NO: 326615 - DNA, 581 bp, Homo sapiens
  misc_feature: GZ8MTXP02FOXBP.44.53.E09.1.454.CMB.2.raw
tcagacagtatatacacgaccggtgctcgatttagagagagtgtgttgggtttgggggaagcacctgtggttcttcctcctgctggtggcggctcccagatgggtcctgtctcagccgcagctgcgggagtcgggcccaggactggtgaagccttcggagaccctgtccctcacgtgcacggtctctggtgcctccatcgacagaagtaatttctactggggctggatccgccagcccccaggagaggggctgcagtggattgggagtctctattatagtgggaacacctactacaaccccgtcctcaacggtcgagtccaccatactccgtggacacgtcgaggacacagttttcccagaaacgtgagttctgtcggccgccgccgacacggctgtctactactgtgtcagacagtcgggtccgtcctatcggcgtaggtcgtctactaattcctacgttacgcgttcgggacgtcgtgggaccgaacggggaccacgggtccaccgtctaccgtcactcctcacgtccctaccaccaacgggcccacgtccggtccttcccccgtcggcccgtccctcg

SEQ ID NO: 326616 - DNA, 703 bp, Homo sapiens
  misc_feature: GZ8MTXP02J2Q5I.44.53.E09.1.454.CMB.2.raw
  modified_base (308)..(308): a, c, t, g, unknown or other
  misc_feature (308)..(308): n is a, c, g, or t
  modified_base (379)..(379): a, c, t, g, unknown or other
  misc_feature (379)..(379): n is a, c, g, or t
  modified_base (389)..(389): a, c, t, g, unknown or other
  misc_feature (389)..(389): n is a, c, g, or t
  modified_base (404)..(404): a, c, t, g, unknown or other
  misc_feature (404)..(404): n is a, c, g, or t
  modified_base (411)..(411): a, c, t, g, unknown or other
  misc_feature (411)..(411): n is a, c, g, or t
tcagacagtatatacacgaccggtgctcgatttagagagagtgtggttgggtttggggggtcacaagaggcagcgctctcgggacgtctccaccatggcctgggctctgctgctcctcactctcctcacccaggacacagggtcctgggcccagtctgccctgactcagcctgcctccgtgtctgggtcgactggacagtcgtcaccatctctgcactgaaccaacagtgacgttcggtcgttttgaccgttgtctcgtggtaccagcacgaccccaagaaccacgacccccaaatctaatttattangcgtactaagttcgtccgtcccgttccggtctccctgacgcgtcctttactcgtcgggtaccccaagttcncggaccaacnccggtcccttcccgnaaccctntcgtcgtcggtacctcgagtcgtaggaacggacgtaggtcttagttaacttaacgttacgcgaccgtacgtactactaactaacgtaacgtaaacggtaacgggttaaaccgttaaccgtttaaccgttaaccggttaccggtaccggaaccggaaccgggtaaaccgtaacgtaccgtaccggtacccgtaccggtaccggtaccgaccgtacccgtaacccggtacccgtccccgtacccccggtacccgtacccgtacccgttcccgttaccccgttaccccgtccccg

SEQ ID NO: 326617 - DNA, 587 bp, Homo sapiens
  misc_feature: GZ8MTXP02F4U21.44.53.E09.1.454.CMB.2.raw
  modified_base (498)..(498): a, c, t, g, unknown or other
  misc_feature (498)..(498): n is a, c, g, or t
tcagacagtatatacacgaccggtgctcgatttagagagagtgtgttgggtttgggggaagcacctgtggttcttcctcctgctggtggcggctcccagatgggtcctgtctcagccgcagctgcgggagtcgggcccaggactggtgaagccttcggagaccctgtccctcacgtgcacggtctctggtgcctccatcgacagaagtaatttctactggggctggatccgccagcccccaggagaggggctgcagtggattgggagtctctattatagtgggaacacctactacacccgtcctcaacggtcgagtcaccatatccgtggacacgtcgaggacactagtttccctagaaacgtgagttctgtcggcccgcgccgacacggctgtctactactgtgtcagacagtcggggtcccgcctagtcggctaggggtcctcgtactaatttctacgtacgtcgttggggacgtcgtggggtaccaaggggaccncgggtccaccgtctcctcactccctcacgtccctaccaccgaacgggccctaacgtccggttcccttcccccgtcggcccgtcccgtcg

SEQ ID NO: 326618 - DNA, 558 bp, Homo sapiens
  misc_feature: GZ8MTXP02FLGG9.44.53.E09.1.454.CMB.2.raw
  modified_base (356)..(356): a, c, t, g, unknown or other
  misc_feature (356)..(356): n is a, c, g, or t
tcagacagtatatacacgaccggtgctcgatttagagagagtgtgttgggtttgggggaagcacctgtggttcttcctcctgctggtggcggctcccagatgggtcctgtctcagccgcagctgcgggagtcgggcccaggactggtgaagccttcggagaccctgtccctcacgtgcacggtctctggtgcctccatcgacagaagtaatttctactggggctggatccgccagcccccaggagaggggctgcagtggattgggagtctctattatagtgggaacacctactacaaccccgtccctcaacggtcagtcaccatatccgtggacacgtcgaggacacagtttcccngaaagtgagttctgtggccgccgccgacacggctgtctactactgtgtcagacatgggtccgcctatggcagggtcgtctctaaattctactacgtcttggggacgtcgtggggccaaggggaccacggtcaccgtctcctcatccctcacgcctccaccgaacgggcccagtccggtccttcccccgtggcccgcccgtcg

SEQ ID NO: 326619 - DNA, 551 bp, Homo sapiens
  misc_feature: GZ8MTXP02GUZVK.44.53.E09.1.454.CMB.2.raw
  modified_base (300)..(300): a, c, t, g, unknown or other
  misc_feature (300)..(300): n is a, c, g, or t
  modified_base (322)..(322): a, c, t, g, unknown or other
  misc_feature (322)..(322): n is a, c, g, or t
  modified_base (348)..(348): a, c, t, g, unknown or other
  misc_feature (348)..(348): n is a, c, g, or t
tcagacagtatatacacgaccggtgctcgatttagagagagtgtgttgagctctgggagaggagccccagccttgggattcccaggtgttttcattcagtgatcaggactgaacacagaggactcaccatggagtttgggctgagctggattttccttgctgcttaattttaaaaggtgtccagtgtgaggtgcagttggtggagtcgtgggggaggtttggtaaagccgtggggagtcccttagactctcctgtgcagcctctggattcacttcagtaacgcctggatgacctgggccncaggctccgaggggaggctggngtgggtggccgtatagaaccaaagcnggacggtgggacagcagactacgctgccaccgtgaaagcagattcaccatcacaagagatgaattacaaaagatacggtgtactctgacagatagaacagacctagaaaccacggagacacacgccgtactattactgtctaggggtattggtttacaagttccgggaccgtacggggtaacccctcgggtaccaccggttcc

SEQ ID NO: 326620 - DNA, 589 bp, Homo sapiens
  misc_feature: GZ8MTXP02HV5F5.44.53.E09.1.454.CMB.2.raw
  modified_base (244)..(244): a, c, t, g, unknown or other
  misc_feature (244)..(244): n is a, c, g, or t
  modified_base (325)..(325): a, c, t, g, unknown or other
  misc_feature (325)..(325): n is a, c, g, or t
tcagacagtatatacacgaccggtgctcgatttagagagagtgtgttgggtttgggggaagcacctgtggttcttcctcctgctggtggcggctcccagatgggtcctgtctcagccgcagctgcgggagtcgggcccaggactggtgaagccttcggagaccctgtccctcacgtgcacggtctctggtgcctccatcgacagaagtaatttctactggggctggatccgccagcccccaggngagggctgcagtggattgggagtctctattatagtgggaacacctactacaacccgtccctacaacggtcgagtcacatancgtgacacgtcgaggacactagtttccctagaagtgagttctgtgcccgccgccgacacggctgtctactactgtgtcagacagtgggtccgcctagtggcaggtcgtctactaacttctaacttacgctttggggaaccttcgtgggggaccaaaggggacccacgggtcacccgtcttccctcaactccctcgaaccctccctacccaaccgaacggtccctacgttcccggttcccttcccccgtcggtcccgtcccgtcg

SEQ ID NO: 326621 - DNA, 555 bp, Homo sapiens
  misc_feature: GZ8MTXP02GDC3U.44.53.E09.1.454.CMB.2.raw
  modified_base (302)..(302): a, c, t, g, unknown or other
  misc_feature (302)..(302): n is a, c, g, or t
  modified_base (434)..(434): a, c, t, g, unknown or other
  misc_feature (434)..(434): n is a, c, g, or t
  modified_base (441)..(441): a, c, t, g, unknown or other
  misc_feature (441)..(441): n is a, c, g, or t
tcagacagtatatacacgaccggtgctcgatttagagagagtgtgttgagctctgggagaggagccccagccttgggattcccaggtgttttcattcagtgatcaggactgaacacagaggactcaccatggagtttgggctgagctggattttccttgctgctaattttaaaaggtgtccagtgtgaggtgcagttggtggagtcgtgggggaggtttggtaaagccgtggggacgtcccttagactctcctgtgcagcctctggattcactttcagtaacgcctggatgacctgggtccnccaggctccgaggggaggggctggaggtgggttgccgtattagaaccaaagctggacggtgggacagcaaggactacgctgcacccggtgaaagcagtatcaaccatcacaagagatagaattacaaaagtntacggtntactctgacagatagaacagccagaacaccgagacacgacgcctctatactggtactcggggtattggttacaaggttcgggaccgtacggggacccctggaccctaccgttcc

SEQ ID NO: 326622 - DNA, 573 bp, Homo sapiens
  misc_feature: GZ8MTXP02J393L.44.53.E09.1.454.CMB.2.raw
  modified_base (181)..(181): a, c, t, g, unknown or other
  misc_feature (181)..(181): n is a, c, g, or t
  modified_base (257)..(257): a, c, t, g, unknown or other
  misc_feature (257)..(257): n is a, c, g, or t
  modified_base (263)..(263): a, c, t, g, unknown or other
  misc_feature (263)..(263): n is a, c, g, or t
  modified_base (266)..(266): a, c, t, g, unknown or other
  misc_feature (266)..(266): n is a, c, g, or t
  modified_base (277)..(277): a, c, t, g, unknown or other
  misc_feature (277)..(277): n is a, c, g, or t
  modified_base (279)..(280): a, c, t, g, unknown or other
  misc_feature (279)..(280): n is a, c, g, or t
  modified_base (292)..(292): a, c, t, g, unknown or other
  misc_feature (292)..(292): n is a, c, g, or t
  modified_base (304)..(304): a, c, t, g, unknown or other
  misc_feature (304)..(304): n is a, c, g, or t
  modified_base (306)..(306): a, c, t, g, unknown or other
  misc_feature (306)..(306): n is a, c, g, or t
  modified_base (308)..(308): a, c, t, g, unknown or other
  misc_feature (308)..(308): n is a, c, g, or t
  modified_base (329)..(329): a, c, t, g, unknown or other
  misc_feature (329)..(329): n is a, c, g, or t
  modified_base (331)..(331): a, c, t, g, unknown or other
  misc_feature (331)..(331): n is a, c, g, or t
tcagacagtatatacacgaccggtgctcgatttagagagagtgtgttgagctctgggagaggagccccagccttgggattcccaggtgttttcattcagtgatcaggactgaacacagaggactcaccatggagtttgggctgagcgtggtagtttcctaggcctgactagtttaaaaggngtccagtgtgaggtgcagttggtggagtctgggggagtttggaaagcctggggatcccttaagctctcctgtgcanctctgntcnctcagtacgcngnngcgtcggcgcgngcgcgaggaggngngngtggtgacgtatagaacaagngngacggcggacgagcacgacgacgcgcgacgaccgacgagacgacactacacactactacaagagagtagtaataacgtaaaagaacgtacgtcgtctctacgacgagagacgacgacgacgacgaacgaacggacgacgacgacgtaccgtacttacttacgtacgtacgtacggtacgttacgttacgtaacggtaccggaccggtaccggtaacccggtaccggtaccgtacccgtcccg

SEQ ID NO: 326623 - DNA, 667 bp, Homo sapiens
  misc_feature: GZ8MTXP02HLGJ0.44.53.E09.1.454.CMB.2.raw
  modified_base (426)..(426): a, c, t, g, unknown or other
  misc_feature (426)..(426): n is a, c, g, or t
  modified_base (432)..(432): a, c, t, g, unknown or other
  misc_feature (432)..(432): n is a, c, g, or t
tcagacagtatatacacgaccggtgctcgatttagagagagtgtgttgggtttgggggaagcacctgtggttcttcctcctgctggtggcggctcccagatgggtcctgtctcatccgcagctgcgggagtcgggcccaggactggtgaagccttcggagaccctgtccctcacgtgcacggtctctggtgcctccatcgacagaagtaatttctactggggctggatccgccagccccaggagagggctgcagtggattgggagtctctattataggtgggaacacctactaccacccgtcctacaacggtcgagtcaccatatccgtggacacgtcgagacactacgtttcctagaaacgtgagttctgtggcccgccgccgacgacggctgtcctactactgtcgtcagacagtcgggtcccncttagngggcagggttcctcgtactaaatttccgtaaacgttcggtccgttgggggaacctttcggacgggggacccaaacgggggtaccccgtaaccggggttcccaacccggttccttcccgtacctactttcccctacgaaccgtcccccttaccgaaccccgaaaaccgggggtccccctaaacggttccccggggttaccccttccccccggttcgggccccgtcccccgttccgg

SEQ ID NO: 326624 - DNA, 621 bp, Homo sapiens
  misc_feature: GZ8MTXP02JJP2P.44.53.E09.1.454.CMB.2.raw
tcagacagtatatacacgaccggtgctcgatttagagagagtgtgttgagctctgggagaggagccccagccttgggattcccaggtgttttcattcagtgatcaggactgaacacagaggactcaccatggagtttgggctgagctggattttccttgctgctaattttaaaaggtgtccagtgtgaggtgcagttggtggagtcgtgggggaggtttggtaaagccgtggggagtcccttagactctcctgtgcagcctctggattcactttcagtaacgcctggatcgaccgtgggtcccgccgaggcctccggaggggaaggggctgggaggtggggttggccgttattacgaaaccaaagcgtaggacgggtgggacagacaagactacgctcgccacccggtagaaaaggcaaggacttccaacccatcctacgaaagaagatagtaacttaacaaaaagtagtaacggtgtactctagacaagatacggaaacacgacctacggaaaccaaccggaaggaccaacgacgtccgtactacttaccgtgtacgtagggtacttggttacaaggttccgggaccgtaacggggacccttcggtacccgaccgttccc

SEQ ID NO: 326625 - DNA, 520 bp, Homo sapiens
  misc_feature: GZ8MTXP02HTFPP.44.53.E09.1.454.CMB.2.raw
  modified_base (188)..(188): a, c, t, g, unknown or other
  misc_feature (188)..(188): n is a, c, g, or t
  modified_base (222)..(222): a, c, t, g, unknown or other
  misc_feature (222)..(222): n is a, c, g, or t
  modified_base (320)..(320): a, c, t, g, unknown or other
  misc_feature (320)..(320): n is a, c, g, or t
  modified_base (357)..(357): a, c, t, g, unknown or other
  misc_feature (357)..(357): n is a, c, g, or t
  modified_base (508)..(508): a, c, t, g, unknown or other
  misc_feature (508)..(508): n is a, c, g, or t
tcagacagtatatacacgaccggtgctcgatttagagagagtgtgttgggtttgggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactgganccagcggtaatattcttagtcttaactttgtctcctggtatcaacatcatccaggtaaacgcccccaaatcatcatctatgagcctataagagccctnagggtttctaatcgcttcactgcctccaagtcccggnaccacggccctcctgacaatctctgggctccagctgagacgaggctgatttattattgttgctcagattgttcgtgcatcactttatgtctttacggaagttgggaccaagggtccaacgtctacggtcagcccgaaggccctaaacccgntcgtcacttccg

SEQ ID NO: 326626 - DNA, 590 bp, Homo sapiens
  misc_feature: GZ8MTXP02GYAAD.44.53.E09.1.454.CMB.2.raw
  modified_base (466)..(466): a, c, t, g, unknown or other
  misc_feature (466)..(466): n is a, c, g, or t
tcagacagtatatacacgaccggtgctcgatttagagagagtgtgttgagctctgggagaggagccccagccttgggattcccaggtgttttcattcagtgatcaggactgaacacagaggactcaccatggagtttgggctgagctggtattttccttgctgcttaattttaaaaggtgtccagtgtgaggtgcagttggtggagtcgtgggggtaggtttggtaaagccgtggggagtcccttagactctcctgtgcagcctctggattcactttcagtaacgcctggatgaccgtgggtcccgccaggcctccgaggggacggggctggaggtgggttggccgtagttacgaaaccaaagcgtaggacggtcgggacagcagactacgctgccacccggtagaaagcagtacttccaccatacctacaaagagattagaattaacaaaagtatacggtgtctntgcagataggaacagcctagaacaccgaggaccacgacgtccgtacttattacgtggtacgtgggactttcggttacaacgttccggggacctaacggggtacccttcggtaccacccgttccc

SEQ ID NO: 326627 - DNA, 680 bp, Homo sapiens
  misc_feature: GZ8MTXP02JFH8S.44.53.E09.1.454.CMB.2.raw
tcagacagtatatacacgaccggtgctcgatttagagagagtgtgttgagctctgggagaggagccccagccttgggattcccaggtgttttcattcagtgatcaggactgaacacagaggactcaccatggagtttgggctgagctggattttccttgctgctattttaaaggtgtccagtgtgaggtgcagttggtggagtcgtgggggaggtttggtaaagccgtggggagtcccttagactctcctgtgcagcctctggattcactttcagtaacgcctggatcgaccgtgggtccgccgaggcctccgaggggaacggggctaggggaggttgggggttcggacccggttaagttaacggaaacccgaaaaggtccgtagggaaccggggtggggaacaggacaagaccgtacgcgtcgaccaacccggtaggaaacggcaaggacttaccaacccattacctacaaaaggagtaattagaaattaaccgaaaaagtcgtaacggtagttctaccgtgaccagtactacggaaacacgtaccacgaaaccgacgacggtaccaacgacgtcccgttactagttaccgtggtaccgttagggtaattcggtttaccaaggtttacccggggaccgtaaccggggtaacccctcggttacccctaccggtttccccc

SEQ ID NO: 326628 - DNA, 582 bp, Homo sapiens
  misc_feature: GZ8MTXP02JN03U.44.53.E09.1.454.CMB.2.raw
  modified_base (450)..(450): a, c, t, g, unknown or other
  misc_feature (450)..(450): n is a, c, g, or t
tcagacagtatatacacgaccggtgctcgatttagagagagtgtgttgagctctgggagaggagccccagccttgggattcccaggtgttttcattcagtgatcaggactgaacacagaggactcaccatggagtttgggctgagctggattttccttgctgctattttaaaaggtgtccagtgtgaggtgcagttggtggagtcgtgggggtaggtttggtaaagccgtggggagtcccttagactctcctgtgcagcctctggattcactttcagtaacgcctggatcgaccgtgggtcccgccaggcctccgaggggacggggctggaggtgggttggccgtattagaaccaaagctaggacggtgggacagcagactacgctcgccacccgtagaaagcaagacttccaacctatctacaagagatagtaacttaacgaaaaagtntacggtgtctcgtagacagatagaacagacctagaaccacggagacacgacgtccgtactagtactgtcgtgggtacttggttacaacgttccgggaccgtacggggacccttcgggtaccctaccgttccg

SEQ ID NO: 326629 - DNA, 565 bp, Homo sapiens
  misc_feature: GZ8MTXP02HLPMY.44.53.E09.1.454.CMB.2.raw
  modified_base (299)..(299): a, c, t, g, unknown or other
  misc_feature (299)..(299): n is a, c, g, or t
  modified_base (343)..(343): a, c, t, g, unknown or other
  misc_feature (343)..(343): n is a, c, g, or t
  modified_base (372)..(372): a, c, t, g, unknown or other
  misc_feature (372)..(372): n is a, c, g, or t
  modified_base (397)..(397): a, c, t, g, unknown or other
  misc_feature (397)..(397): n is a, c, g, or t
tcagacagtatatacacgaccggtgctcgatttagagagagtgtgttgagctctgggagaggagccccagccttgggattcccaggtgttttcattcagtgatcaggactgaacacagaggactcaccatggagtttgggctgagctggattttccttgctgctattttaaaggtgtccagtgtgaggtgcagttggtggagtcgtgggggaggtttggtaaagccgtggggagtcccttagactctcctgtgcagcctctggattcactttcagtaacgcctggatgacctgggtccnccaggctccgagggaggctggagtgggtgcgtatagaacaagcngaggtggacagcagacacgctcgcaccgngaaacgcagatccacatcacaaganatagtattacaaaaagtagtaacggtcgttactagtgacagatacggaacacgaccgtacgaaaccgacggaggacacgacgccgtattacttacgtgttacgtaggtacttcggttctaacggttccgggaccgtacggggtaccctcgggtacctacccggttccc

SEQ ID NO: 326630 - DNA, 636 bp, Homo sapiens
  misc_feature: GZ8MTXP02JHSLJ.44.53.E09.1.454.CMB.2.raw
  modified_base (407)..(407): a, c, t, g, unknown or other
  misc_feature (407)..(407): n is a, c, g, or t
  modified_base (425)..(425): a, c, t, g, unknown or other
  misc_feature (425)..(425): n is a, c, g, or t
tcagacagtatatacacgaccggtgctcgatttagagagagtgtgttgggtttgggggaagcacctgtggttcttcctcctgctggtggcggctcccagatgggtcctgtctcagccgcagctgcgggagtcgggcccaggactggtgaagccttcggagaccctgtccctcacgtgcacggtctctggtgcctccatcgacagaagtaatttctactggggctggatccgccacgccccaggagagggctgcagtggagttgggagtctctattatagtgggaacacctactaccacccgtcctacaacggtcagtcacatactcgtggacacgtcgaggacactacgtttcccagaaacgtgagtttctggtcggccgccgccgacacggctgtctactactgtntcagacagtcgggtcccnctagtcggcgtaggtccgtcttacaagtttcctacgtacgtcgttagggggaccttcggtcgggggacccgaacggggacccgtacgggtcctacccggtctccctacgacctccctccgaaccggtccctacccgaaccgaaaccggggtcccctaacggtccccggggtttccccttaccccccggtcggtccccgtccccgttcccgg

SEQ ID NO: 326631 - DNA, 555 bp, Homo sapiens
  misc_feature: GZ8MTXP02GQM52.44.53.E09.1.454.CMB.2.raw
  modified_base (324)..(324): a, c, t, g, unknown or other
  misc_feature (324)..(324): n is a, c, g, or t
  modified_base (355)..(355): a, c, t, g, unknown or other
  misc_feature (355)..(355): n is a, c, g, or t
  modified_base (421)..(421): a, c, t, g, unknown or other
  misc_feature (421)..(421): n is a, c, g, or t
  modified_base (549)..(549): a, c, t, g, unknown or other
  misc_feature (549)..(549): n is a, c, g, or t
tcagacagtatatacacgaccggtgctcgatttagagagagtgtgttgggtttgggggaagcacctgtggttcttcctcctgctggtggcggctcccagatgggtcctgtctcagccgcagctgcgggagtcgggcccaggactggtgaagccttcggagaccctgtccctcacgtgcacggtctctggtgcctccatcgacagaagtaatttctactggggctggatccgccagcccccaggagaggggctgcagtggattgggagtctctattatagtgggaacacctactacaacccgtcctcaacggtcagtcaccatanccgtggacacgtcgaggacacagttttcccngaaacgtgagttctgtcggccgccgccgacacggctgtctactactgtgtcagacagtgggtcccncctatggcaggtcgtctcaattctactacgctttggggactcgtggggccaaggggaccacggtcaccgtctcctcatccctcacgccctacccacaacgggcccatccggtcctcccccgtggcccnccctcg

SEQ ID NO: 326632 - DNA, 588 bp, Homo sapiens
  misc_feature: GZ8MTXP02GJUCU.44.53.E09.1.454.CMB.2.raw
  modified_base (299)..(299): a, c, t, g, unknown or other
  misc_feature (299)..(299): n is a, c, g, or t
  modified_base (437)..(437): a, c, t, g, unknown or other
  misc_feature (437)..(437): n is a, c, g, or t
  modified_base (442)..(442): a, c, t, g, unknown or other
  misc_feature (442)..(442): n is a, c, g, or t
tcagacagtatatacacgaccggtgctcgatttagagagagtgtgttgagctctgggagaggagccccagccttgggattcccaggtgttttcattcagtgatcaggactgaacacagaggactcaccatggagtttgggctgagctggattttccttgctgctattttaaaaggtgtccagtgtgaggtgcagttggtggagtcgtgggggaggtttggtaaagccgtggggagtcccttagactctcctgtgcagcctctggattcacttcagtaacgcctggatgacctgggtccnccaggcctccgaggggacggggctgggaggtggggttggccgttagttaacgaaaccaaagcgtaggacggtgggacagcagactacgctcgcaccggtgaaagcagacttcacatcacaagagatgattacaaaagntacgntactctagacagatagaaccagcctagaacaaccggagaccacgacgaccgttctaacttacgtcgtcgtaggggtactttcggtttacaacggtttcccggggaccgtaacgggggtaaccctcgggtacccgaccggtttcccg

SEQ ID NO: 326633 - DNA, 556 bp, Homo sapiens
  misc_feature: GZ8MTXP02JGYWN.44.53.E09.1.454.CMB.2.raw
  modified_base (353)..(353): a, c, t, g, unknown or other
  misc_feature (353)..(353): n is a, c, g, or t
  modified_base (416)..(416): a, c, t, g, unknown or other
  misc_feature (416)..(416): n is a, c, g, or t
  modified_base (500)..(500): a, c, t, g, unknown or other
  misc_feature (500)..(500): n is a, c, g, or t
tcagacagtatatacacgaccggtgctcgatttagagagagtgtgttgggtttgggggaagcacctgtggttcttcctcctgctggtggcggctcccagatgggtcctgtctcagccgcagctgcgggagtcgggcccaggactggtgaagccttcggagaccctgtccctcacgtgcacggtctctggtgcctccatcgacagaagtaatttctactggggctggatccgccagccccaggagaggggctgcagtggattgggagtctctattatagtgggaacacctactacaacccgtcctcaacggtcgagtcaccatatccgtgacacgtcgaggacacagtttcccngaaacgtgagttctgtggccgcgccgacacggctgtctacgtactgtgtcagacatgggtccnctatggcagtcgtctcaattctactacgcttgggacgtcgtcggggaccaaggggaccacgggtcaccgtctccctcacttccncacgcctaccgaccgaacgggcccagtccggtccttcccccgtggtcccgccctcg

SEQ ID NO: 326634 - DNA, 506 bp, Homo sapiens
  misc_feature: GZ8MTXP02HCD9E.44.53.E09.1.454.CMB.2.raw
  modified_base (281)..(281): a, c, t, g, unknown or other
  misc_feature (281)..(281): n is a, c, g, or t
  modified_base (317)..(317): a, c, t, g, unknown or other
  misc_feature (317)..(317): n is a, c, g, or t
  modified_base (415)..(415): a, c, t, g, unknown or other
  misc_feature (415)..(415): n is a, c, g, or t
  modified_base (497)..(497): a, c, t, g, unknown or other
  misc_feature (497)..(497): n is a, c, g, or t
tcagacagtatatacacgaccggtgctcgatttagagagagtgtgttgggtttgggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtaatattcttagtcttaacttgtctcctggtatcaacatcatccaggtaacnccccaaatcatcatctatgagcctataagaggcctnagggtttcaatcgcttccactgcctcaagtccgacaccacggcctccctagaccaatctctggctccagctgagacgaggctgtattagttattgttnctcagtatgttctcgcattcactttatgtcttcggaagtcggaccaaggtcacgtcctaggtcagcccaagcccaacccgancgtacactc

SEQ ID NO: 326635 - DNA, 588 bp, Homo sapiens
  misc_feature: GZ8MTXP02G0MOK.44.53.E09.1.454.CMB.2.raw
  modified_base (342)..(342): a, c, t, g, unknown or other
  misc_feature (342)..(342): n is a, c, g, or t
tcagacagtatatacacgaccggtgctcgatttagagagagtgtgttgagctctgggagaggagccccagccttgggattcccaggtgttttcattcactgatcaggactgaacacagaggactcaccatggagtttgggctgagctggattttccttgctgctattttaaaaggtgtccagtgtgaggtgcagttggtggagtcgtgggggaggtttggtaaagccgtggggagtcccttagactctcctgtgcagcctctggattcactttcagtaacgcctggatgacctggccgcaggctccgagggagggctggagtgggtgcgtatagaccaagcngacggtggacagcagactacgctcgcacccgtagaaacgcaagtacttccaaccatcctacaaagagatgaacttacaaaaagtatacgggtgtctacgtgactaagactagaaaccaggacctacgaaaccgaccggaacgaaccacgaacgtccgtactagttaccgtgtacgttgggaactttggtttacgaacgtttccggggaccctacggggtaaccccgtggtcccgtaaccggttccc

SEQ ID NO: 326636 - DNA, 578 bp, Homo sapiens
  misc_feature: GZ8MTXP02JA4LD.44.53.E09.1.454.CMB.2.raw
  modified_base (269)..(269): a, c, t, g, unknown or other
  misc_feature (269)..(269): n is a, c, g, or t
  modified_base (402)..(402): a, c, t, g, unknown or other
  misc_feature (402)..(402): n is a, c, g, or t
  modified_base (419)..(419): a, c, t, g, unknown or other
  misc_feature (419)..(419): n is a, c, g, or t
  modified_base (424)..(424): a, c, t, g, unknown or other
  misc_feature (424)..(424): n is a, c, g, or t
tcagacagtatatacacgaccggtgctcgatttagagagagtgtgttgggtttgggggaagcacctgtggttcttcctcctgctggtggcggctcccagatgggtcctgtctcagccgcagctgcgggagtcgggcccaggactggtgaagccttcggagaccctgtccctcacgtgcacggtctctggtgcctccatcgacagaagtaatttctactggggctggatccgccagccccaggagagggctgcagtggattgggagtctntatatagtgggaacacctactacaacccgtcctcaacggtcgagtcaccatactccgtggacacgtcgaggacactagtttcccagaaagtgagttctgtcggccgccgccgacacggctgtctactactgtntcagacagtcgggtccnctagnggctaggtcgtctcaattctacgtacgctttgggactcgtggggaccaggggaccacggtccacggtcctacctcactccctacacggtccctacccgaaccgaacgggtccccaacgttcccggttcccgtcccccgtggccccgtcccctcg

SEQ ID NO: 326637 - DNA, 565 bp, Homo sapiens
  misc_feature: GZ8MTXP02I924Z.44.53.E09.1.454.CMB.2.raw
  modified_base (298)..(298): a, c, t, g, unknown or other
  misc_feature (298)..(298): n is a, c, g, or t
  modified_base (402)..(402): a, c, t, g, unknown or other
  misc_feature (402)..(402): n is a, c, g, or t
  modified_base (424)..(424): a, c, t, g, unknown or other
  misc_feature (424)..(424): n is a, c, g, or t
tcagacagtatatacacgaccggtgctcgatttagagagagtgtgttgagctctgggagaggagccccagccttgggattcccaggtgttttcattcagtgatcaggactgaacacagaggactcaccatggagtttgggctgagctggattttccttgctgctattttaaaggtgtccagtgtgaggtgcaggttggtggagtcgtgggggaggtttggaaagccgtggggatcccttagactctcctgtgcagcctctggattcactttcagtaacgcctggatgacctgggtccncaggctccgagggaggctggagtgggtgccgtatagaaccaagctggacggtggacagcagactacgctcgccacccggtgaaacgcaagacttccacatccanaagagatgaacttacgaaaagngttacggtgtctactgacagactagaaacacgcctaaggaaccaccggaggtaccacgacgcccgtatacttacgtgtacgtagggtacttcggtttacaaggttccgggacgtacggggaaccctggtacccacggttcc

SEQ ID NO: 326638 - DNA, 591 bp, Homo sapiens
  misc_feature: GZ8MTXP02IWE5Z.44.53.E09.1.454.CMB.2.raw
  modified_base (189)..(189): a, c, t, g, unknown or other
  misc_feature (189)..(189): n is a, c, g, or t
  modified_base (223)..(223): a, c, t, g, unknown or other
  misc_feature (223)..(223): n is a, c, g, or t
  modified_base (318)..(318): a, c, t, g, unknown or other
  misc_feature (318)..(318): n is a, c, g, or t
tcagacagtatatacacgaccggtgctcgatttagagagagtgtgttgggtttggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactgganccagcggtaatattcttagtcttaacttgtctcctggtatcaacatcatccagtaaacgccccaaactcatcatctatgagctataagagccctnagggtttctaatcgcttccactgcctccaagtcccggacacacggccctccctagaccaatctctgggctcccgagcgtgaggacgagctgattattattgttgctcagtattggttcgtcgctaatctaactttatgttctttacgggaaaagttcggggaaaccaaagggttcccaaacccggtttccgtaacgggttaccaaacggtaacccccgaaaacgggtacccccaaaaacccccgtacttccggttacctaaccgttttccccg

SEQ ID NO: 326639 - DNA, 571 bp, Homo sapiens
  misc_feature: GZ8MTXP02H1OGF.44.53.E09.1.454.CMB.2.raw
  modified_base (357)..(357): a, c, t, g, unknown or other
  misc_feature (357)..(357): n is a, c, g, or t
  modified_base (372)..(372): a, c, t, g, unknown or other
  misc_feature (372)..(372): n is a, c, g, or t
  modified_base (407)..(407): a, c, t, g, unknown or other
  misc_feature (407)..(407): n is a, c, g, or t
tcagacagtatatacacgaccggtgctcgatttagagagagtgtgttgggtttgggggaagcacctgtggttcttcctcctgctggtggcggctcccagatgggtcctgtctcagccgcagctgcgggagtcgggcccaggactggtgaagccttcggagaccctgtccctcacgtgcacggtctctggtgcctccatcgacagaagtaatttctactggggctggatccgccagcccccaggagaggggctgcagtggattgggagtctctattatagtgggaacacctactacaaccccgtcctcaacggtcgagtcaccatatccgtggacacgtcgaggacactagtttcccngaaacgtgagtttcngtggccgccgccgacacggctgtcctactactgtntcagacagtcgggtccctactagtggcagggttcgtctcaacttctactacgccttgggacgtcgtggggaccaagggtccacgggtccaccgtctcctcgactcctcacgtcctaccaccgaagggccccagtcccggtccttcccccgtggcccgtccctcg

SEQ ID NO: 326640 - DNA, 529 bp, Homo sapiens
  misc_feature: GZ8MTXP02JZ073.44.53.E09.1.454.CMB.2.raw
  modified_base (297)..(297): a, c, t, g, unknown or other
  misc_feature (297)..(297): n is a, c, g, or t
  modified_base (395)..(395): a, c, t, g, unknown or other
  misc_feature (395)..(395): n is a, c, g, or t
  modified_base (415)..(415): a, c, t, g, unknown or other
  misc_feature (415)..(415): n is a, c, g, or t
tcagacagtatatacacgaccggtgctcgatttagagagagtgtgttgagctctgggagaggagccccagccttgggattcccaggtgttttcattcagtgatcaggactgaacacagaggactcaccatggagtttgggctgagctggattttccttgctgctattttaaaaggtgtccagtgtgaggtgcagttggtggagtctgggggaggtttggaaagcctggggagtcccttagactctcctgtgcagcctctggattcactttcagtaacgcctggatgacctgggtccncaggctccgagggagggctggagtgggttgccgtatagaaccaaagctgacggtgggacagcagactacgctgcacccgtgaaagcagatcaccatcncaagagatgattacaaaagntacggtgtctctgctagatagaacagccctagaaaccaccgaggacacgtacgccgtatattactgtactgggatggtttcaagttcgggccacgggaccctggtccaccgtcc

SEQ ID NO: 326641 - DNA, 607 bp, Homo sapiens
  misc_feature: GZ8MTXP02GUVG7.44.53.E09.1.454.CMB.2.raw
  modified_base (299)..(299): a, c, t, g, unknown or other
  misc_feature (299)..(299): n is a, c, g, or t
  modified_base (316)..(316): a, c, t, g, unknown or other
  misc_feature (316)..(316): n is a, c, g, or t
  modified_base (320)..(320): a, c, t, g, unknown or other
  misc_feature (320)..(320): n is a, c, g, or t
  modified_base (422)..(422): a, c, t, g, unknown or other
  misc_feature (422)..(422): n is a, c, g, or t
  modified_base (430)..(430): a, c, t, g, unknown or other
  misc_feature (430)..(430): n is a, c, g, or t
  modified_base (435)..(435): a, c, t, g, unknown or other
  misc_feature (435)..(435): n is a, c, g, or t
tcagacagtatatacacgaccggtgctcgatttagagagagtgtgttgagctctgggagaggagccccagccttgggattcccaggtgttttcattcagtgatcaggactgaacacagaggactcaccatggagtttgggctgagctggtattttccttgctgctattttaaaaggtgtccagtgtgaggtgcagttggtggagtcgtgggggaggtttggtaaagccgtggggagtcccttagactctcctgtgcagcctctggattcactttcagtaacgctggatgacctgggccncaggctcgaggggaggntggngtgggtgcgtatagacaagctgaggtcggacagcagactacgctcgcctacccgagaaagcagacttccaaccatctacaaagagatagaattacaaaagtntacgggtntctgngactagatacgaacacgacgtacgaaaccgaaccggaacgaccgaacgtaccggtaccgttacttaacgtttacgttacggtcggttagggtacgtttaccgggtttaccgaacggggttcccggggaacccggttaacggggtaccccgtcgggttaccctacccggttcc

SEQ ID NO: 326642 - DNA, 586 bp, Homo sapiens
  misc_feature: GZ8MTXP02IFMD0.44.53.E09.1.454.CMB.2.raw
  modified_base (408)..(408): a, c, t, g, unknown or other
  misc_feature (408)..(408): n is a, c, g, or t
  modified_base (424)..(424): a, c, t, g, unknown or other
  misc_feature (424)..(424): n is a, c, g, or t
  modified_base (478)..(478): a, c, t, g, unknown or other
  misc_feature (478)..(478): n is a, c, g, or t
tcagacagtatatacacgaccggtgctcgatttagagagagtgtgttgggtttgggggaagcacctgtggttcttcctcctgctggtggcggctcccagatgggtcctgtctcagccgcagctgcgggagtcgggcccaggactggtgaagccttcggagaccctgtccctcacgtgcacggtctctggtgcctccatcgacagaagtaatttctactggggctggatccgccagcccccaggagaggggctgcagtggattgggagtctctattatagtgggaacacctactaccaaccccgtccctcaacggtcgagtcaccatatccgtggacacgtcgaggacactagtttccctgaaacgtgagttctgtggccgccgccgacacggctgtcctactactgtntcagacatgggtcccncgtatggcagggtcgtctctaaatttcctacttacgcgtttaggggacgttcgngggggtaccaacgggggaccaccgggtcacccgtcctccctcactccctcacgtccctccgaccaacgggccccagtccggtcccttcccccgtggccctcccgtccg

SEQ ID NO: 326643 - DNA, 571 bp, Homo sapiens
  misc_feature: GZ8MTXP02JGW12.44.53.E09.1.454.CMB.2.raw
  modified_base (299)..(299): a, c, t, g, unknown or other
  misc_feature (299)..(299): n is a, c, g, or t
  modified_base (317)..(317): a, c, t, g, unknown or other
  misc_feature (317)..(317): n is a, c, g, or t
  modified_base (320)..(320): a, c, t, g, unknown or other
  misc_feature (320)..(320): n is a, c, g, or t
  modified_base (430)..(430): a, c, t, g, unknown or other
  misc_feature (430)..(430): n is a, c, g, or t
tcagacagtatatacacgaccggtgctcgatttagagagagtgtgttgagctctgggagaggagccccagccttgggattcccaggtgttttcattcagtgatcaggactgaacacagaggactcaccatggagtttgggctgagctggattttccttgctgctattttaaaggtgtccagtgtgaggtgcagttggtggagtcgtgggggtaggtttggtaaagccgtggggagtcccttagactctcctgtgcagcctctggattcactttcagtaacgcctggatgacctgggccnccaggctcgagggaggcnggngtgggtgccgtatagaaccaaagcgtggacggtgggacagcaagactacgctgccaccggtagaaacgcaagacttccaacatctacaaagagatgaattaacaaaagtntacggtgtctctgcagatagaacagcctagaacacgagactacgacgtccgtatattacgtgttacgtggggtaacttgggtttaccgaaggttcccgggaccgtacggggtaaccccttcgggtacccaccggtttcccg

SEQ ID NO: 326644 - DNA, 513 bp, Homo sapiens
  misc_feature: GZ8MTXP02IGJIU.44.53.E09.1.454.CMB.2.raw
  modified_base (224)..(224): a, c, t, g, unknown or other
  misc_feature (224)..(224): n is a, c, g, or t
  modified_base (320)..(320): a, c, t, g, unknown or other
  misc_feature (320)..(320): n is a, c, g, or t
  modified_base (334)..(334): a, c, t, g, unknown or other
  misc_feature (334)..(334): n is a, c, g, or t
  modified_base (432)..(432): a, c, t, g, unknown or other
  misc_feature (432)..(432): n is a, c, g, or t
tcagacagtatatacacgaccggtgctcgatttagagagagtgtgttgggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactgganccagcggtaatattcttagtcttaaactttgtctcctggtatcaacatcatccagtaaagcccccaaatcatcatctatgagctataagagccctnagggtttcaatcgnttcatgcctcaagtccgcacacgctccctgacaatctctgggctcccaggctgacggacgaggtctagatttatattgttgctcgagatgttcgtacnctatctattatgtacgtacggtaagtcggaactagtaccacgtcgtacgtcacgaaccgaacgacccaccatctacactcg

SEQ ID NO: 326645 - DNA, 661 bp, Homo sapiens
  misc_feature: GZ8MTXP02JAD5G.44.53.E09.1.454.CMB.2.raw
  modified_base (259)..(259): a, c, t, g, unknown or other
  misc_feature (259)..(259): n is a, c, g, or t
  modified_base (308)..(308): a, c, t, g, unknown or other
  misc_feature (308)..(308): n is a, c, g, or t
  modified_base (470)..(470): a, c, t, g, unknown or other
  misc_feature (470)..(470): n is a, c, g, or t
tcagacagtatatacacgaccggtgctcgatttagagagagtgtgttgagctctgggagaggagccccagccttgggattcccaggtgttttcattcagtgatcaggactgaacacagaggactcaccatggagtttgggctgagctggattttccttgctgctattttaaaaggtgtccagtgtgaggtgcagttggtggagtcgtgggggtaggtttggtaaagccgtggggacgtcccttagactctcctgtcgcngcctctggacttctactttcagtaacgcctggatcgaccgtgggtcccnccgaggctccggaggggaggctggagtgggtgccgtatacgaaaccgaaagctaggacggtggacagcagactacgctcggaccacccggtagaaacggcaagtacttccaaccctatcctacgaaagagtatacgtaacttacaaaaagtagtaacgggtnttactacgtagacgtagtaactacggaaaccacgtacctaacggaaaccgaaccggaaggaaccaacggtacgtacccgttacttaacgttaacgttcgttccggtagggttaacgtttcgggtttacgaacggtttccgggggaacccgtacggggtaacccccgttggggtaccctacccggtttcccg

SEQ ID NO: 326646 - DNA, 560 bp, Homo sapiens
  misc_feature: GZ8MTXP02FRBRJ.44.53.E09.1.454.CMB.2.raw
  modified_base (298)..(298): a, c, t, g, unknown or other
  misc_feature (298)..(298): n is a, c, g, or t
tcagacagtatatacacgaccggtgctcgatttagagagagtgtgttgagctctgggagaggagccccagccttgggattcccaggtgttttcattcagtgatcaggactgaacacagaggactcaccatggagtttgggctgagctggattttccttgctgctatttaaaggtgtccagtgtgaggtgcagttggtggagtcgtgggggaggtttggtaaagccgtggggagtcccttagactctcctgtgcagcctctggattcactttcagtaacgcctggatgacctgggtccncaggctccgagggaggctggagtgggtgcgtatagaacaagctggacggtggacagcagactacgctgcacccggtagaaacggcagtacttcaccatctacaaagagatagaattacgaaaaagtatacggtgtactctggacagatagaacagcctagaacaccggagaccacacgccgtactattacgtgttaccgtgggtacttcgggtttacaacgttcgggacccgtaggggtacccctcgggtaccaccggttcc

SEQ ID NO: 326647 - DNA, 543 bp, Homo sapiens
  misc_feature: GZ8MTXP02JVANA.44.53.E09.1.454.CMB.2.raw
  modified_base (432)..(432): a, c, t, g, unknown or other
  misc_feature (432)..(432): n is a, c, g, or t
tcagacagtatatacacgaccggtgctcgatttagagagagtgtgttgagctctgggagaggagccccagccttgggattcccaggtgttttcattcagtgatcaggactgaacacagaggactcaccatggagtttgggctgagctggattttccttgctgctattttaaaaggtgtccagtgtgaggtgcagttggtggagtcgtgggggaggtttggtaaagcctggggagtcccttagactctcctgtgcagcctctggattcactttcagtaacgcctggatgacctgggtcccgccaggcctccgaggggagggctggagtgggtgccgtatagaaccaaagctgacggtgggacagcagactacgctgccacccggtgaaacgcagattcaccatctacaagagatgattacaaaagatacggtntactctgcagatagaacagcctagaaccacgagacacgagccgtctatactgtcgtggggacttcggttcaagttccggggaccacggggtaccctcgggaccaccgttcc

SEQ ID NO: 326648 - DNA, 592 bp, Homo sapiens
  misc_feature: GZ8MTXP02JG4QN.44.53.E09.1.454.CMB.2.raw
  modified_base (304)..(304): a, c, t, g, unknown or other
  misc_feature (304)..(304): n is a, c, g, or t
  modified_base (444)..(444): a, c, t, g, unknown or other
  misc_feature (444)..(444): n is a, c, g, or t
tcagacagtatatacacgaccggtgctcgatttagagagagtgtgttgagctctgggagaggagccccagccttgggattcccaggtgttttcattcagtgatcaggactgaacacagaggactcaccatggagtttgggctgagctggattttccttgctgcttaattttaaaaggtgtccagtgtgaggtgcagttggtggagtcgtgggggtaggtttggtaaagccgtggggacgtcccttagactctcctgtgcagcctctggattcactttcagtaacgctggatgaccgtgggtccncaggcctccggaggggacggggctggggaggtggggttcggccgttagttacgaaaccaaagctaggacggtgggacagcagactacgctcgccacccggtagaaacggcaagtacttccaaccatcctacaagagatanaacttaacgaaaagtagtacggtgttactctagacagataggaaaccagccagaaccacgaacgacaacgacgtccgtatattaccgtagtcgtgggtacttggttcaacgttcggggacctacggggaccctggtaccctaccgtcc

SEQ ID NO: 326649 - DNA, 812 bp, Homo sapiens
  misc_feature: GZ8MTXP02IJ91D.44.53.E09.1.454.CMB.2.raw
  modified_base (174)..(174): a, c, t, g, unknown or other
  misc_feature (174)..(174): n is a, c, g, or t
tcagacagtatatacacgaccggtgctcgatttagagagagtgtgttgagctctgggagaggagccccagccttgggattcccaggtgttttcattcagtgatcaggactgaacacagaggactcaccatggagtttgggctgagctggattttcctgctgctattttaaaggngtccagtgtgaggtgcagttggtggagtcgtgggggagtttggtaaagccgtggggactcccttagactctcctgtgcagcctctggacttcactttcagtaacgcctggatcgaccgtgggtccgccgaggcctaccggaggggaaggggccgtaggggaggttggggttacggtacccggttaagtttaaacggaaaaccccgtaaaagggtccgtacggggaaccggggttacggggaaacctaacgggccgaaaacggtaaccgttaaacccgggccgttaccggggaccccgtaaacccccggggttaagggaaaaacccgggggtcctaaagggtaaaccttttacccggaaaccccttaaggttaccccttaaacggaaaaaggtacggttaaaagttagggtaaacttttaaaacccgaaaaaaaggttcggtttaaaccgggtgtttaacctaccgttgggaacctaagggtaacttacgaaaacccgtaggacccttaagggaaacccgtaaccggaacggaccaaacgacgtaccgttacttaagttaccgtggtaccgttggggtactttcggtttacaacggttcgggaaccgtacggggaacccttcggtaacctaccgttccc

SEQ ID NO: 326650 - DNA, 570 bp, Homo sapiens
  misc_feature: GZ8MTXP02GZIPM.44.53.E09.1.454.CMB.2.raw
  modified_base (301)..(301): a, c, t, g, unknown or other
  misc_feature (301)..(301): n is a, c, g, or t
  modified_base (411)..(411): a, c, t, g, unknown or other
  misc_feature (411)..(411): n is a, c, g, or t
  modified_base (427)..(427): a, c, t, g, unknown or other
  misc_feature (427)..(427): n is a, c, g, or t
tcagacagtatatacacgaccggtgctcgatttagagagagtgtgttgagctctgggagaggagccccagccttgggattcccaggtgttttcattcagtgatcaggactgaacacagaggactcaccatggagtttgggctgagctggattttccttgctgctattttaaaaggtgtccagtgtgaggtgcagttggtggagtcgtgggggaggtttggtaaagccgtggggagtcccttagactctcctgtgcagcctctggattcactttcagtaacgcctggatgaccgtgggtccnccgaggctccgaggggagggctggagtgggtggccgtagtagaaccaaagctgacggtggacagcagactacgctgcaccgtagaaacgcagacttcacatctacaaganatagattacaaaagtntacggtgtactactgacagatacgaaacacgaccgtagaaccgaaccggagaccgaacacggtaccgtactaatttacgtgttcgtgggtacttcggttacaagttccgggacgacgggtacccgtcggtaccgtaccgttcc

SEQ ID NO: 326651 - DNA, 614 bp, Homo sapiens
  misc_feature: GZ8MTXP02IGFZX.44.53.E09.1.454.CMB.2.raw
  modified_base (260)..(260): a, c, t, g, unknown or other
  misc_feature (260)..(260): n is a, c, g, or t
  modified_base (265)..(265): a, c, t, g, unknown or other
  misc_feature (265)..(265): n is a, c, g, or t
  modified_base (436)..(436): a, c, t, g, unknown or other
  misc_feature (436)..(436): n is a, c, g, or t
  modified_base (470)..(470): a, c, t, g, unknown or other
  misc_feature (470)..(470): n is a, c, g, or t
  modified_base (496)..(496): a, c, t, g, unknown or other
  misc_feature (496)..(496): n is a, c, g, or t
tcagacagtatatacacgaccggtgctcgatttagagagagtgtgttgagctctgggagaggagcccccagccttgggattcccaggtgttttcattcagtgatcaggactgaacacagaggactcaccatggagtttgggctgagctggatttttcctgctgcttaattttaaaaggtgtccagtgtgaggtgcaggttggtggagtcgtgggggaggtttggtaaagccgtggggacgtcccttagactctctgtgcngcctntggattcactttcagtaacgcctgggatcgaccgtgggtcccgccagggcctccggaggggaggggcttggggaggtggggttggcccggttaattaacgaaaccaaaagcgtaggacgggtcgggacagcaggactacgctgccaccggagaaagccagacttccaccanctacaagagatagattaacaaaagtatacgggtntactacgtcgacgtagactagaaacncgacgtacgaaccgaacggacgaccacgtacgtaccttatacttcgtggtcgttagggtactttcggttacgtaacggttccgggacgtaccgggtacccttcggtacctacccgtcc

SEQ ID NO: 326652 - DNA, 577 bp, Homo sapiens
  misc_feature: GZ8MTXP02GINFH.44.53.E09.1.454.CMB.2.raw
  modified_base (425)..(425): a, c, t, g, unknown or other
  misc_feature (425)..(425): n is a, c, g, or t
tcagacagtatatacacgaccggtgctcgatttagagagagtgtgttgggtttgggggaagcacctgtggttcttcctcctgctggtggcggctcccagatgggtcctgtctcagccgcagctgcgggagtcgggcccaggactggtgaagccttcggagaccctgtccctcacgtgcacggtctctggtgcctccatcgacagaagtaatttctactggggctggatccgccagcccccaggagagggctgcagtggattgggagtctctattatagtgggaacacctactaccaaccccgtccctcaacggtcgagtcaccatatccgtggacacgtcgaggacactagtttccctgaaacgtgagttctgtcggccgccgccgacacggctgtctactactgtgtcagacagtcgggtcccncctatggcaggtcgtctcaattctactacgcgttaggggactcgtggggacctaagggacccacggtccaccgtctcctcactccctcacgtccctacccaccgtaacgggcccctacgtccggtccttcccccgtcggcccgtcccgtccg

SEQ ID NO: 326653 - DNA, 543 bp, Homo sapiens
  misc_feature: GZ8MTXP02FMXN6.44.53.E09.1.454.CMB.2.raw
  modified_base (300)..(300): a, c, t, g, unknown or other
  misc_feature (300)..(300): n is a, c, g, or t
tcagacagtatatacacgaccggtgctcgatttagagagagtgtgttgagctctgggagaggagccccagccttgggattcccaggtgttttcattcagtgatcaggactgaacacagaggactcaccatggagtttgggctgagctggattttccttgctgctattttaaaaggtgtccagtgtgaggtgcagttggtggagtcgtgggggaggtttggtaaagccgtgggggatcccttagactctcctgtgcagcctctggattcactttcagtaacgcctggatgacctgggtccncaggctcgagggagggctggagtgggtgcgtatagaaccaagctgacggtggacagcagactacgctcgcacccgtagaaacggcaagacttcaccatctacaagagatgaattacaaaagtatacggtgtactctagctagatagaacagccctagaaccaccgagaacacgacgccgtactattacctgtcgtggtattcgttcaagttcgggaccacgggtaccctcggtaccaccgtcc

SEQ ID NO: 326654 - DNA, 580 bp, Homo sapiens
  misc_feature: GZ8MTXP02HMRSU.44.53.E09.1.454.CMB.2.raw
  modified_base (190)..(190): a, c, t, g, unknown or other
  misc_feature (190)..(190): n is a, c, g, or t
  modified_base (354)..(354): a, c, t, g, unknown or other
  misc_feature (354)..(354): n is a, c, g, or t
  modified_base (437)..(437): a, c, t, g, unknown or other
  misc_feature (437)..(437): n is a, c, g, or t
  modified_base (445)..(445): a, c, t, g, unknown or other
  misc_feature (445)..(445): n is a, c, g, or t
tcagacagtatatacacgaccggtgctcgatttagagagagtgtgttgggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactggagccagcggtaatattcttagtcttaactttgtctcctggtatcaacatcatccaaggtaaacgcccccaaatcatcatctatgagcctaataagacggccctgtaggggtttactaatcgtcttccactcncctcaagtcccggacaccgccggcctccctagactaatcctcgtggctccgaggctaggaggacgagctgatttattattgtncttcagtntgttcgtcgctatcctattagtgttacgttacggtaaggtacggggaaacctaaacgggtcctaccgttacccgttaggtaccaccgaaccccgaaacggacccctaaaccccgtactcgtacctacgtttcccg

SEQ ID NO: 326655 - DNA, 592 bp, Homo sapiens
  misc_feature: GZ8MTXP02HRKUK.44.53.E09.1.454.CMB.2.raw
  modified_base (396)..(396): a, c, t, g, unknown or other
  misc_feature (396)..(396): n is a, c, g, or t
  modified_base (399)..(399): a, c, t, g, unknown or other
  misc_feature (399)..(399): n is a, c, g, or t
  modified_base (416)..(416): a, c, t, g, unknown or other
  misc_feature (416)..(416): n is a, c, g, or t
tcagacagtatatacacgaccggtgctcgatttagagagagtgtgttgggtttgggggaagcacctgtggttcttcctcctgctggtggcggctcccagatgggtcctgtctcagccgcagctgcgggagtcgggcccaggactggtgaagccttcggagaccctgtccctcacgtgcatggtctctggtgcctccatcgacagaagtaatttctactgggctggatccgccagccccaggagaggggctgcagtggattgggagtctctattatagtggaacacctactacaaccccgtcctcaacggtcgagtcaccatatccgtgacacgtcgagacactagtttcctagaaagtgagttctgtcgccgccgccgacacggctgtctactacngtntcagacagtcgggtccncctagtcggctacgggtctctactaatttcgtactacgtcgttcgggtacgtcgtggggaccgaacggggacccacgggtaccacccggttcctcccttcacttccctcaccgcccttacccaccgaaacgggcccctaacgttcccggtccctttcccccgcgggtccctccccg

SEQ ID NO: 326656 - DNA, 586 bp, Homo sapiens
  misc_feature: GZ8MTXP02JDPG7.44.53.E09.1.454.CMB.2.raw
  modified_base (429)..(429): a, c, t, g, unknown or other
  misc_feature (429)..(429): n is a, c, g, or t
  modified_base (516)..(516): a, c, t, g, unknown or other
  misc_feature (516)..(516): n is a, c, g, or t
  modified_base (574)..(574): a, c, t, g, unknown or other
  misc_feature (574)..(574): n is a, c, g, or t
tcagacagtatatacacgaccggtgctcgatttagagagagtgtgttgggtttgggggaagcacctgtggttcttcctcctgctggtggcggctcccagatgggtcctgtctcagccgcagctgcgggagtcgggcccaggactggtgaagccttcggagaccctgtccctcacgtgcacggtctctggtgcctccatcgacagaagtaattctactggggctggatccgccagccccaggagaggggctgcagtggattgggagtctctatatagtgggaacacctactacaacccgtcctcaacggtcgagtcaccatactccgtggacacgtcgaggaccacgtagttttccctagaaacgtgtagttctgtcggcccgccgccgacacgggctgtctactactgtgtcagacagtcggggtcccnccgtatcggcagggtcgtctctaaattcctactacgtcttggggacctcgtcggggaccaacgggccacgggtccaccgtctccctnactcatccgacgccctaccgaaccgtaacgggccccagtcccggtccctttcccccgnggcccgtccccg

SEQ ID NO: 326657 - DNA, 693 bp, Homo sapiens
  misc_feature: GZ8MTXP02IP8S1.44.53.E09.1.454.CMB.2.raw
tcagacagtatatacacgaccggtgctcgatttagagagagtgtgttgggtttgggggaagcacctgtggttcttcctcctgctggtggcggctcccagatgggtcctgtctcagccgcagctgcgggagtcgggcccaggactggtgaagccttcggagaccctgtccctcacgtgcacggtctctggtgcctccatcgacagaagtaatttctactggggctggatccgccacgcccccaggaggaggggctgcagtggagttgggagtctctattagtaggtagggaacacctactaccaaccccgtccctacgaacggtcgagtcaccatactccgtgacacgtcgagacactacgtttccagtaacgtgtacgttcgtggtcggcccgccgcccgacgaccggcgtcgtcctactacttgtcgtacacggactagtcgggtcccgactagtcggacgtacgggttcgtactactaaacgtttccgttaacgttaccggtcgtttacggggaccgttcgggtacgggggtacccgaaacgggggtccctaaccggggtccgtacccggttcccttcccgtacgtaccttccccgtacgaccgtacccccgtacccgaacccgaaaccggggtccccgtaacgttccccgggttccccttccccggtccggtccccgtccccgttcccgg

SEQ ID NO: 326658 - DNA, 580 bp, Homo sapiens
  misc_feature: GZ8MTXP02GPB21.44.53.E09.1.454.CMB.2.raw
  modified_base (190)..(190): a, c, t, g, unknown or other
  misc_feature (190)..(190): n is a, c, g, or t
  modified_base (224)..(224): a, c, t, g, unknown or other
  misc_feature (224)..(224): n is a, c, g, or t
  modified_base (235)..(235): a, c, t, g, unknown or other
  misc_feature (235)..(235): n is a, c, g, or t
  modified_base (267)..(267): a, c, t, g, unknown or other
  misc_feature (267)..(267): n is a, c, g, or t
  modified_base (281)..(281): a, c, t, g, unknown or other
  misc_feature (281)..(281): n is a, c, g, or t
  modified_base (366)..(366): a, c, t, g, unknown or other
  misc_feature (366)..(366): n is a, c, g, or t
  modified_base (387)..(387): a, c, t, g, unknown or other
  misc_feature (387)..(387): n is a, c, g, or t
  modified_base (469)..(469): a, c, t, g, unknown or other
  misc_feature (469)..(469): n is a, c, g, or t
tcagacagtatatacacgaccggtgctcgatttagagagagtgtgttgggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactgganccagcgtaatnttcttagtcttaacttgtctctggtatcaacntcatcaggtaaacncccccaaactcatcatctatgagctaataagacggcctcgtaggggtttactaatcgtcttcctctcgctcaagtctggccaacncgccctccctgactatctcgnggcctcgaggctggaggaccgagctagacttacacgtgcagtctacaattaacaaccaagcaagaccactccctaacccttnttacgtacgttacgggaaaccgttacggggaaacctaacggtcctaaccgttaccggtaacggtaccgaaccgaccccgaaaccggaccccaaaacccccgtcgttaaccg

SEQ ID NO: 326659 - DNA, 581 bp, Homo sapiens
  misc_feature: GZ8MTXP02JUKZA.44.53.E09.1.454.CMB.2.raw
  modified_base (302)..(302): a, c, t, g, unknown or other
  misc_feature (302)..(302): n is a, c, g, or t
  modified_base (416)..(416): a, c, t, g, unknown or other
  misc_feature (416)..(416): n is a, c, g, or t
  modified_base (431)..(431): a, c, t, g, unknown or other
  misc_feature (431)..(431): n is a, c, g, or t
  modified_base (439)..(439): a, c, t, g, unknown or other
  misc_feature (439)..(439): n is a, c, g, or t
tcagacagtatatacacgaccggtgctcgatttagagagagtgtgttgagctctgggagaggagccccagccttgggattcccaggtgttttcattcagtgatcaggactgaacacagaggactcaccatggagtttgggctgagctggattttccttgctgctattttaaaaggtgtccagtgtgaggtgcagttggtggagtcgtgggggtaggtttggtaaagccgtggggactcccttagactctcctgtgcagcctctggattcactttcagtaacgcctggatcgacctgggtccnccgaggcctccgaggggagggctgggagtggggttgccgttatacgaaaccaaagctggacggtgggacagcagactacgctgccaccgtgaaagcagatcaccatcacaaganatagattacaaaagntaacggtntactctgacagatagaaacacgtaccagaaaccgaccggaaggaccaacgacgtaccgtactacttacgtgtacgtagggtattcggttacaacggtttccgggaccgtacgggtaccccgtggtacccgtacccgttcccg

SEQ ID NO: 326660 - DNA, 642 bp, Homo sapiens
  misc_feature: GZ8MTXP02F6YT5.44.53.E09.1.454.CMB.2.raw
tcagacagtatatacacgaccggtgctcgatttagagagagtgtgttgggtttgggggaagcacctgtggttcttcctcctgctggtggcggctcccagatgggtcctgtctcagccgcagctgcgggagtcgggcccaggactggtgaagccttcggagaccctgtccctcacgtgcacggtctctggtgcctccatcgacagaagtaatttctactggggctggatccgccacgccccaggagaggggctgcagtggattgggagtctctattatagtgggaacacctactacacccgtcctcaacggtcagtcaccatactccgtggacacgtcgaggacactagtttccagaaacgtgtagttctggtcggcccgccgccgacacggtctgtctactactgtcgtcagactagtcggggtcccgctagtcggcgtagggttccgtctactaactttctaacgtacgtcgttaggggaccgttcggtcgggggaccgaaacggggtaccctaccgggtcctacccggtccttacccgtcaccttcccgtacgaccgtacccctacccgaacccggtaaccgggtcccctaacggttccccggttccccttcccccggtcggggcccctccccgttccgg

SEQ ID NO: 326661 - DNA, 637 bp, Homo sapiens
  misc_feature: GZ8MTXP02IC0ZK.44.53.E09.1.454.CMB.2.raw
  modified_base (299)..(299): a, c, t, g, unknown or other
  misc_feature (299)..(299): n is a, c, g, or t
  modified_base (414)..(414): a, c, t, g, unknown or other
  misc_feature (414)..(414): n is a, c, g, or t
  modified_base (441)..(441): a, c, t, g, unknown or other
  misc_feature (441)..(441): n is a, c, g, or t
tcagacagtatatacacgaccggtgctcgatttagagagagtgtgttgagctctgggagaggagccccagccttgggattcccaggtgttttcattcagtgatcaggactgaacacagaggactcaccatggagtttggctgagctggattttcctgctgcttaatttaaaggtgtccagtgtgaggtgcaggttggtggagtcgtgggggagttggtaaagccgtggggatcccttagactctcctgtgcagtcctcgtggattcactttcagtaacgcctggatgaccgtgggtccnccgaggcctccggaggggagggctggagtggggtgcgtatagaacaaagctaggacggtcggacagcagactacgctcgccaaccggtagaaacgccaagacttaccaaccctancctacgaaagataatagtaactttaanaaaaacggtattaaccggtgtacttaccgtagaccgttaagaacgtaggaaacctaccgacgtaaagaaccgaacggaggacaacgaacgtcccgttattaacgttaacgtcggttacgttggggtacgtttcggttaaccgcggtttacccggggaccgtaacgggtacccccttggggtccctaacccgttccc

SEQ ID NO: 326662 - DNA, 542 bp, Homo sapiens
  misc_feature: GZ8MTXP02JXXHE.44.53.E09.1.454.CMB.2.raw
  modified_base (299)..(299): a, c, t, g, unknown or other
  misc_feature (299)..(299): n is a, c, g, or t
  modified_base (355)..(355): a, c, t, g, unknown or other
  misc_feature (355)..(355): n is a, c, g, or t
  modified_base (400)..(400): a, c, t, g, unknown or other
  misc_feature (400)..(400): n is a, c, g, or t
  modified_base (414)..(414): a, c, t, g, unknown or other
  misc_feature (414)..(414): n is a, c, g, or t
  modified_base (421)..(421): a, c, t, g, unknown or other
  misc_feature (421)..(421): n is a, c, g, or t
  modified_base (425)..(425): a, c, t, g, unknown or other
  misc_feature (425)..(425): n is a, c, g, or t
  modified_base (437)..(437): a, c, t, g, unknown or other
  misc_feature (437)..(437): n is a, c, g, or t
tcagacagtatatacacgaccggtgctcgatttagagagagtgtgttgagctctgggagaggagccccagccttgggattcccaggtgttttcattcagtgatcaggactgaacacagaggactcaccatggagtttgggctgagctggattttccttgctgctattttaaaaggtgtccagtgtgaggtgcagttggtggagtcgtgggggaggtttggtaaagccgtggggatcccttagactctcctgtgcagcctctggattcactttcagtaacgcctggatgacctgggtccncaggctcgagggagggctggagtgggtgcgtatagaacaagctggacggtgggacngcagactacgctgccaccgtgaaagcagatcaccatcacaagagntgattacaaaagtntacggtnctcngcagatagaacngcctagaaccaccggagacacgagccgtactatacctgtcgtagggattcggtttacaaggtttccggggacctacggggaccccttgggtacccacccggttcc

SEQ ID NO: 326663 - DNA, 590 bp, Homo sapiens
  misc_feature: GZ8MTXP02H2ZXB.44.53.E09.1.454.CMB.2.raw
  modified_base (352)..(352): a, c, t, g, unknown or other
  misc_feature (352)..(352): n is a, c, g, or t
  modified_base (416)..(416): a, c, t, g, unknown or other
  misc_feature (416)..(416): n is a, c, g, or t
tcagacagtatatacacgaccggtgctcgatttagagagagtgtgttgggtttgggggaagcacctgtggttcttcctcctgctggtggcggctcccagatgggtcctgtctcagccgcagctgcgggagtcgggcccaggactggtgaagccttcggagaccctgtccctcacgtgcacggtctctggtgcctccatcgacagaagtaatttctactggggctggatccgccagcccccaggagagggctgcagtggattgggagtctctattatagtgggaacacctactacacccgtcctcaacggtcgagtcacatatccgtgacacgtcgaggacactagtttcccngaagtgagttctgtggccgccgccgacacggctgtctactactgtcgtcagacagtcgggcccnctagtggctaggtcgtctcaaattctactacgtcttgggacgtcgtcgggggcctaaagggggaccctacgggtccacccgttctccctcgtaacttccctacgaacgtcccctaccaacccgaacgggtccccacgttccggttcccttcccccgtcggcccgtccccgtcgg

SEQ ID NO: 326664 - DNA, 578 bp, Homo sapiens
  misc_feature: GZ8MTXP02F5BLD.44.53.E09.1.454.CMB.2.raw
  modified_base (358)..(358): a, c, t, g, unknown or other
  misc_feature (358)..(358): n is a, c, g, or t
tcagacagtatatacacgaccggtgctcgatttagagagagtgtgttgggtttgggggaagcacctgtggttcttcctcctgctggtggcggctcccagatgggtcctgtctcagccgcagctgcgggagtcgggcccaggactggtgaagccttcggagaccctgtccctcacgtgcacggtctctggtgcctccatcgacagaagtaatttctactggggctggatccgccagcccccaggagaggggctgcagtggattgggagtctctattatagtgggaacacctactacaaccccgtccctcaacggtcgagtcaccatactccgtggacacgtcgaggacacagtttcccngaaagtgagttctgtggcccgccgccgacacggctgtctactactgtgtcagacagtgggtcccgcctagtcggcacggttcgtctcaattctactacgcttagggacgtcgtggggccaagggaccacggtcaccgtctccgtcactcctacacgccctaccacccgtaaacggcccctaagtcccgggttcccttcccccgtggcccgtcccctccgg

SEQ ID NO: 326665 - DNA, 647 bp, Homo sapiens
  misc_feature: GZ8MTXP02GE75P.44.53.E09.1.454.CMB.2.raw
  modified_base (354)..(354): a, c, t, g, unknown or other
  misc_feature (354)..(354): n is a, c, g, or t
tcagacagtatatacacgaccggtgctcgatttagagagagtgtgttgggtttgggggaagcacctgtggttcttcctcctgctggtggcggctcccagatgggtcctgtctcagccgcagctgcgggagtcgggcccaggactggtgaagccttcggagaccctgtccctcacgtgcacggtctctggtgcctccatcgacagaagtaatttctactggggctggatccgccagcccccaggagagggctgcagtggatgggagtctctattatagtgggaacacctactacaacccgtcctacaacggtcgagtcaccatatccgtggacacgtcgaggacacagtttcccngaaacgtgagttctgtcggccgccgccgacacggctgtctactactgtgtcagacagtcgggtcccgcctagtcgggacgtacgggttcgttcctactaatttcctacgttacgtccgttacggggaccgttccgtcgggggtcccgaaagggggacccgtaccggtaccgtacccggttcctacccgttaccgacttcccgtaccaccggtcccctaccccgaaccgtaaaccggggcccctaacggttcccggttccctttcccccccgtggtcccccgtccccgttccgg

SEQ ID NO: 326666 - DNA, 550 bp, Homo sapiens
  misc_feature: GZ8MTXP02HMUSH.44.53.E09.1.454.CMB.2.raw
  modified_base (301)..(301): a, c, t, g, unknown or other
  misc_feature (301)..(301): n is a, c, g, or t
  modified_base (369)..(369): a, c, t, g, unknown or other
  misc_feature (369)..(369): n is a, c, g, or t
  modified_base (402)..(402): a, c, t, g, unknown or other
  misc_feature (402)..(402): n is a, c, g, or t
  modified_base (418)..(418): a, c, t, g, unknown or other
  misc_feature (418)..(418): n is a, c, g, or t
  modified_base (492)..(492): a, c, t, g, unknown or other
  misc_feature (492)..(492): n is a, c, g, or t
tcagacagtatatacacgaccggtgctcgatttagagagagtgtgttgagctctgggagaggagccccagccttgggattcccaggtgttttcattcagtgatcaggactgaacacagaggactcaccatggagtttgggctgagctggattttccttgctgctattttaaaaggtgtccagtgtgaggtgcaggttggtggagtcgtgggggaggtttggtaaagccgtggggagtcccttagactctcctgtgcagcctctggattcactttcagtaacgcctggatgacctgggtccnccaggctccgagggagggctggagtgggtgcgtatagaacaaagctgacggtggacagcagactacgntgcaccgtgaaaggcagatcaccatctacaagngatgattacaaaaagntacggtatctactgactagatacgaaacacgcctagaaccgaccgaggacacacgcctactattacgtgtacgngggtattcggtttacaagtttcgggacctacggggtaaccctcgggtaccaccgttcc

SEQ ID NO: 326667 - DNA, 603 bp, Homo sapiens
  misc_feature: GZ8MTXP02H9PR3.44.53.E09.1.454.CMB.2.raw
  modified_base (465)..(465): a, c, t, g, unknown or other
  misc_feature (465)..(465): n is a, c, g, or t
tcagacagtatatacacgaccggtgctcgatttagagagagtgtgttgagctctgggagaggagccccagccttgggattcccaggtgttttcattcagtgatcaggactgaacacagaggactcacatggagtttgggctgagctggattttccttgctgcttattttaaaaggtgtccagtgtgaggtgcagttggtggagtcgtgggggtaggtttaggtaaagccgtggggacgttcccttagactctcctgtgcagcctctggattcactttcagtaacgcctggactgacctgggtccgcgaggcctccgagggaacggggctggaggtgggttcggaccgtattacgaaaccaaagcgtggacggtcgggaacagacagactacgctcgaccaacccgtgaaaacggcaagattcgaacctatcacaagagatagattaacaaaagtagtaacgggtntacgtctagataggataggaaacacgaccagaaccgaacggaagaccacgacggtccctattataacctggtacgtggtacttggttaccaaggtttccgggaccgtaacggggaccctcggtaccctaccggttccc

SEQ ID NO: 326668 - DNA, 665 bp, Homo sapiens
  misc_feature: GZ8MTXP02HVOOX.44.53.E09.1.454.CMB.2.raw
tcagacagtatatacacgaccggtgctcgatttagagagagtgtgttgggtttgggggaagcacctgtggttcttcctcctgctggtggcggctcccagatgggtcctgtctcagccgcagctgcgggagtcgggcccaggactggtgaagccttcggagaccctgtccctcacgtgcacggtctctggtgcctccatcgacagaagtaatttctactgggctggatccgccacgcccccaggagaggggctgcagtggattgggagtctctattatagtgggaacacctactacaaccccgtcctcaacggtcagtcaccatatccgtgacacgtcgaggacactagtttcccagaaacgtgagttctgtggcccgccgccgacgacggtctgtctactactgtcgtcagacagtcggggtcccgtccgtaagtcgggctagggtccgttactacgaaactttccgtaacttacgcgtttacggggaccgttcgtacgggggacccaaacgggggcccaaccggggttccaaccccggttccttcccgtacctaacttccccttacgaccgcccccttacccgaaccccgtaaaacgggggcccccctaaggttccccgggttccccttaccccccgttcggggcccccgtacccccgtcccgg

SEQ ID NO: 326669 - DNA, 590 bp, Homo sapiens
  misc_feature: GZ8MTXP02HV9DN.44.53.E09.1.454.CMB.2.raw
  modified_base (178)..(178): a, c, t, g, unknown or other
  misc_feature (178)..(178): n is a, c, g, or t
  modified_base (263)..(263): a, c, t, g, unknown or other
  misc_feature (263)..(263): n is a, c, g, or t
  modified_base (299)..(299): a, c, t, g, unknown or other
  misc_feature (299)..(299): n is a, c, g, or t
  modified_base (320)..(320): a, c, t, g, unknown or other
  misc_feature (320)..(320): n is a, c, g, or t
  modified_base (323)..(323): a, c, t, g, unknown or other
  misc_feature (323)..(323): n is a, c, g, or t
  modified_base (408)..(408): a, c, t, g, unknown or other
  misc_feature (408)..(408): n is a, c, g, or t
  modified_base (433)..(433): a, c, t, g, unknown or other
  misc_feature (433)..(433): n is a, c, g, or t
  modified_base (445)..(445): a, c, t, g, unknown or other
  misc_feature (445)..(445): n is a, c, g, or t
tcagacagtatatacacgaccggtgctcgatttagagagagtgtgttgagctctgggagaggagccccagccttgggattcccaggtgttttcattcagtgatcaggactgaacacagaggactcaccatggagtttgggctgagcgtggtatttccttgctgacttaatttaaaggngtccagtgtgaggtgcagttggtggagtcgtgggggaggtttggtaaagccgtggggagtcccttagactctcctgtgcagcctntggattcacttcagtacgctggatgacctgggtccnccgaggcctcggagggaggcnggngtgggtgcgtatagaacaaagctggacggtggacagcagactacgctcgaccaccgtagaacggcagtacttaccacctatccanaaagagatagaacttaacgaaaagngttaaccgggtntctagtagacgtaagatacgaacgacgaccgaacgaacgaacgaacgacgacgacgtacgtacttacttacgtacgtacgtacggtacgttacgttacgtaacggtacggtaccggaccggtaccgtaccgtaccgtaccgtccg

SEQ ID NO: 326670 - DNA, 622 bp, Homo sapiens
  misc_feature: GZ8MTXP02HBZZE.44.53.E09.1.454.CMB.2.raw
tcagacagtatatacacgaccggtgctcgatttagagagagtgtgttgggtttgggggaagcacctgtggttcttcctcctgctggtggcggctcccagatgggtcctgtctcagccgcagctgcgggagtcgggcccaggactggtgaagccttcggagaccctgtccctcacgtgcacggtctctggtgcctccatcgacagaagtaattctactggggctggatccgccagccccaggagagggctgcagtggattgggagtctctattatagtgggaacacctactacaacccgtcctacaacggtcgagtcaccatactcgtggacacgtcgagacactagtttcctgaaacgtgagttctgtcgccgccgccgacacggctgtctactactgtctcagacagttcgggtaccgccctaagtcgggctacgggttcgtacttactaaacttcttaacgtacgtcgttagggggtaccgtcggtcgggggaccgaaggggaacccgtacggtccaaccggttctaccctccaatcccttacaccggtccctacccgaaccgaaaccggggccctaacgttcccggttcccttcccccgttcggcccgtcccgttccgg

SEQ ID NO: 326671 - DNA, 758 bp, Homo sapiens
  misc_feature: GZ8MTXP02GHUT9.44.53.E09.1.454.CMB.2.raw
tcagacagtatatacacgaccggtgctcgatttagagagagtgtgttgagctctgggagaggagccccagccttgggattcccaggtgttttcattcagtgatcaggactgaacacagaggactcaccatggagtttgggctgagctggtattttccttgctgtcttaattttaaaaggtgtccagtgtgaggtgctaggttggtggagtcggtgggggtaggtttaggtaaagccgtggggacgtccttagactctcctgtgcagcctctggacttctacttcacgtaacgcctggatcgaccgtcgggtcccgccgaggcctaccggaaggggaacggggcgtggggaggttcgggggttcggtacccggttaagttaacggaaacccgtaaaaggtccgtagggacgggtcgggaacgagacgaagacctacgctcgaccgaacccggtaggaaaacggcaagtacttaccaaccctatacctacgaaagagtaatagtaacttaacgaaaaagtcgttaacgggtcgtactcgtagacgtaagtactaggaaaccacgtacccgtaaggaaacccgaaacccgggacggaaaccgaacccgtacgggtaccccttactttaaacgtttacccgtggggtttacgttacgggggttaacttttcggggttttaaccaacgggggtttcccccggggaaaaccgttaccgggggtaaaccccctttggggttaaaaccccctcccggtttaccccg

SEQ ID NO: 326672 - DNA, 773 bp, Homo sapiens
  misc_feature: GZ8MTXP02I523J.44.53.E09.1.454.CMB.2.raw
tcagacagtatatacacgaccggtgctcgatttagagagagtgtgttgagctctgggagaggagccccagccttgggattcccaggtgttttcattcagtgatcaggactgaacacagaggactcaccatggagtttgggctgagctggattttccttgctgctatttaaaaggtgtccagtgtgaggtgcagttggtggagtcgtgggggtaggtttggtaagccgtgggagtccttagactctctgtgcagcctctggattctactttcagtaacgcctggatcgaccgtgggtcccgccgaggcctccggaaggggaacggggcgtaggggaggttggggttcggacccggttaagttaacggaaaacccgaaaaggccgtagggtaaccggggtggggaaccaggacgaacggtaccgttaaccggccgttcgggaccccgtaaacccccgggtaagggaaaaaccgggccgtaaaggtactttacccaaacccctaattaccctaacgaaaaggaagtaagttaggtaaactttaaacgaaaaaaggtacgttaaccgggttgttaccttaccgttaggaccgtaagtaacgttacgggaaaacccacggtacccttaaggaaaacccgaacccggaaggaaacccaaccgtacgaccccgttattaaacgttaccgtaggtccgttaggggtaactttcgggtttacaacggtttccggggacccgtaacgggggtaaccccttcgggtacccgtacccgtttcccg

SEQ ID NO: 326673 - DNA, 534 bp, Homo sapiens
  misc_feature: GZ8MTXP02GQQ7Z.44.53.E09.1.454.CMB.2.raw
  modified_base (261)..(261): a, c, t, g, unknown or other
  misc_feature (261)..(261): n is a, c, g, or t
  modified_base (300)..(300): a, c, t, g, unknown or other
  misc_feature (300)..(300): n is a, c, g, or t
  modified_base (357)..(357): a, c, t, g, unknown or other
  misc_feature (357)..(357): n is a, c, g, or t
  modified_base (417)..(417): a, c, t, g, unknown or other
  misc_feature (417)..(417): n is a, c, g, or t
tcagacagtatatacacgaccggtgctcgatttagagagagtgtgttgagctctgggagaggagccccagccttgggattcccaggtgttttcattcagtgatcaggactgaacacagaggactcaccatggagtttgggctgagctggattttccttgctgctattttaaaaggtgtccagtgtgaggtgcagttggtggagtcgtgggggaggtttggtaaagccgtggggagtcccttagactctcctgtgcagcctntggattcactttcagtaacgcctggatgacctgggtccncaggctccgagggagggctggagtgggttgcgtatagaaccaagctgacggtggacngcagactacgctgccaccgtgaaaagcagattcacatctcaagagatgattacaaaaagntaacggtgtctctgcagatgaacagcctagaacaccgaggacacgagccgtctattactgtctgggattggtttacaagttcgggaccgtacggggaaccctgggtaccaccggtcc

SEQ ID NO: 326674 - DNA, 612 bp, Homo sapiens
  misc_feature: GZ8MTXP02IUK19.44.53.E09.1.454.CMB.2.raw
  modified_base (306)..(306): a, c, t, g, unknown or other
  misc_feature (306)..(306): n is a, c, g, or t
  modified_base (416)..(416): a, c, t, g, unknown or other
  misc_feature (416)..(416): n is a, c, g, or t
  modified_base (421)..(421): a, c, t, g, unknown or other
  misc_feature (421)..(421): n is a, c, g, or t
tcagacagtatatacacgaccggtgctcgatttagagagagtgtgttgagctctgggagaggagccccagccttgggattcccaggtgttttcattcagtgatcaggactgaacacagaggactcaccatggagtttgggctgagctggattttccttgctgcttaattttaaaaggtgtccagtgtgaggtgcagttggtggagtcgtgggggaggtttggtaaagccgtgggggagtcccttagactctcctgtgcagcctctggattcactttcagtaacgcctggatcgaccgtgggtcccnccgaggcctccgaggggaggggctggaggtgggttggccgtatagaaccaaagctaggacggtgggacagcagacctacgctgccaccgtagaaacgcagatcacatcanaaganatagacttaacaaaagtatacgtgtctcgtgacagtatagaaacagacctagaaccgaaccggaggtaaccacgaacgtccgtacttaagttaccgttcggtacgtcgggggtaatttcgggtttaccgtaacggtttacccggggaccgtaaaccggggtacccgttacggtcccgtacccggtttcccg

SEQ ID NO: 326675 - DNA, 589 bp, Homo sapiens
  misc_feature: GZ8MTXP02IGXRM.44.53.E09.1.454.CMB.2.raw
  modified_base (224)..(224): a, c, t, g, unknown or other
  misc_feature (224)..(224): n is a, c, g, or t
  modified_base (236)..(236): a, c, t, g, unknown or other
  misc_feature (236)..(236): n is a, c, g, or t
  modified_base (302)..(302): a, c, t, g, unknown or other
  misc_feature (302)..(302): n is a, c, g, or t
  modified_base (310)..(310): a, c, t, g, unknown or other
  misc_feature (310)..(310): n is a, c, g, or t
  modified_base (320)..(320): a, c, t, g, unknown or other
  misc_feature (320)..(320): n is a, c, g, or t
  modified_base (387)..(387): a, c, t, g, unknown or other
  misc_feature (387)..(387): n is a, c, g, or t
tcagacagtatatacacgaccggtgctcgatttagagagagtgtgttgggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactgganccagcggtaatnttcttagtcttaacttgtctcctggtatcaacatcatccagtaaacgcccccaaatcatcatctangagctaanaagagccctnagggttctaatcgtcttccactcgcctacaagtcccggacaccgcgcctccctgaacctactctcgngggcctccgaggccgtaggacggtacgacgggctagtatttacgtttattggtttgtacttcgtaagtacgtttgttcgtcgtacattacctacttagttgtcgttacgggaaggttcgggaacctaaacggtccgacccgttccgtaacggtcaaccggaacccgaacggacccaacccctacgtcgtacctacttccccg

SEQ ID NO: 326676 - DNA, 658 bp, Homo sapiens
  misc_feature: GZ8MTXP02IS4SA.44.53.E09.1.454.CMB.2.raw
tcagacagtatatacacgaccggtgctcgatttagagagagtgtgttgagctctgggagaggagccccagccttgggattcccaggtgttttcattcagtgatcaggactgaacacagaggactcaccatggagtttgggctgagctggattttccttgctgctattttaaaaggtgtccagtgtgaggtgcagttggtggagtcgtgggggaggtttggtaaagccgtggggagtcccttagactctcctgtgcagcctcgtggattctactttcagtaacgcctggatcgaccgtgggtccgccgaggcctccgaggggaacggggctagggaggtggggttggacccgttagttaacgaaaccgaaagcgtaggacggtgggacagcaagactacgctcgccaacccggtagaaacgcaagtactccaacctatacacgaaagagatagtaacttaacgaaaagtacgtacggtacgttaccgtctagacgtaagaactacggaaacaacgccgtaagaaacccgaaccggaaacggaccaaccgacgggtacccgttacttaacgtttacgtcgttacggttacgggtagtttcggttactaacgggtttaccgggaccgtacgggggtaaccctcggtaccctacccggttcc

SEQ ID NO: 326677 - DNA, 600 bp, Homo sapiens
  misc_feature: GZ8MTXP02HTID7.44.53.E09.1.454.CMB.2.raw
  modified_base (323)..(323): a, c, t, g, unknown or other
  misc_feature (323)..(323): n is a, c, g, or t
  modified_base (357)..(357): a, c, t, g, unknown or other
  misc_feature (357)..(357): n is a, c, g, or t
  modified_base (404)..(404): a, c, t, g, unknown or other
  misc_feature (404)..(404): n is a, c, g, or t
  modified_base (422)..(422): a, c, t, g, unknown or other
  misc_feature (422)..(422): n is a, c, g, or t
tcagacagtatatacacgaccggtgctcgatttagagagagtgtgttgggtttgggggaagcacctgtggttcttcctcctgctggtggcggctcccagatgggtcctgtctcagccgcagctgcgggagtcgggcccaggactggtgaagccttcggagaccctgtccctcacgtgcacggtctctggtgcctccatcgacagaagtaatttctactggggctggatccgccagcccccaggagaggggctgcagtggattgggagtctctattatagtgggaacacctactacaaccccgtcctcaacggtcagtcaccanatccgtggacacgtcgaggacacgtagtttcccngaaaacgtgagttctgtgcccgcgcgacacggctgtctactacttgngtcagacagtcggtcccnctagtcggacaggtcgtactactaaattctaacgtacgtcgttaggggaccgttgcgggacgaacgggaccggtaccgtacgtaccgtccgtacctactactcctaccgacgtaccctacccaacccgaaccggaacccgtacgtaccgttcccgttccccgtccgtccgtcccgtcg

SEQ ID NO: 326678 - DNA, 604 bp, Homo sapiens
  misc_feature: GZ8MTXP02JGG09.44.53.E09.1.454.CMB.2.raw
tcagacagtatatacacgaccggtgctcgatttagagagagtgtgttgggtttgggggaagcacctgtggttcttcctcctgctggtggcggctcccagatgggtcctgtctcagccgcagctgcgggagtcgggcccaggactggtgaagccttcggagaccctgtccctcacgtgcacggtctctggtgcctccatcgacagaagtaatttctactggggctggatccgccagccccaggagaggggctgcagtggattgggagtctctattatagtggaacacctactacaacccgtcctcaacggtcagtcaccatactcgtggacacgtcgagacactagtttcccagaaagtgagttctgtcggccgccgccgacacggctgtctactactgtgtcagacagtcgggtacccgcctagtcggctagggtctcgttacaatttctaactacgtcgttaggggaccttcgtcgggggaccaaacggggacccaacgggtcctacccggtcttcccgtacacttcccttacgacgtcccctacccgacccgaaacgggccccaacgttccggtcccttcccccgtcggccccgtccctcgg

SEQ ID NO: 326679 - DNA, 607 bp, Homo sapiens
  misc_feature: GZ8MTXP02H5NTU.44.53.E09.1.454.CMB.2.raw
  modified_base (354)..(354): a, c, t, g, unknown or other
  misc_feature (354)..(354): n is a, c, g, or t
  modified_base (398)..(398): a, c, t, g, unknown or other
  misc_feature (398)..(398): n is a, c, g, or t
tcagacagtatatacacgaccggtgctcgatttagagagagtgtgttgggtttgggggaagcacctgtggttcttcctcctgctggtggcggctcccagatgggtcctgtctcagccgcagctgcgggagtcgggcccaggactggtgaagccttcggagaccctgtccctcacgtgcacggtctctggtgcctccatcgacagaagtaatttctactggggctggatccgccagcccccaggagagggctgcagtggattgggagtctctattatagtgggaacacctactacaacccgtcctcaacggtcgagtcaccatatccgtggacacgtcgaggacacagtttcccngaaagtgagttctgtgccgccgccgacacggctgtctactactntgtcagacatcgggtccaccgtatggcagggtcgtctactaatttcctaacgttaccgtcttacggggacgtccgtcgggggacccgtaaggggaccctacgggtaccacccgttcctccctctacttccttaccgacgccctacccgaacccgaacggggccccctacgtcccggttcccttcccccgtcgggcccgtccccgtccgg

SEQ ID NO: 326680 - DNA, 537 bp, Homo sapiens
  misc_feature: GZ8MTXP02G9YX2.44.53.E09.1.454.CMB.2.raw
  modified_base (299)..(299): a, c, t, g, unknown or other
  misc_feature (299)..(299): n is a, c, g, or t
  modified_base (465)..(465): a, c, t, g, unknown or other
  misc_feature (465)..(465): n is a, c, g, or t
tcagacagtatatacacgaccggtgctcgatttagagagagtgtgttgagctctgggagaggagccccagccttgggattcccaggtgttttcattcagtgatcaggactgaacacagaggactcaccatggagtttgggctgagctggattttccttgctgctattttaaaaggtgtccagtgtgaggtgcagttggtggagtcgtgggggaggtttggaaagccgtggggagtcccttagactctcctgtgcagcctctggattcactttcagtaacgcctggatgacctgggtccnccaggctccgagggaaggggctggagtgggtggccgtatagaaccaaagctggacggtggacagcagactacgctgcaccgtgaaagcagatcaccatcacaagagatagattacaaaaagtataacggtgtactctgcagatgaacagcctagaacacgagacanacgtaccgtctatactgtcgtgggactggttacaacgttcgggacctacgggaaccctcggtaccaccgtcc

SEQ ID NO: 326681 - DNA, 666 bp, Homo sapiens
  misc_feature: GZ8MTXP02HDB28.44.53.E09.1.454.CMB.2.raw
  modified_base (277)..(277): a, c, t, g, unknown or other
  misc_feature (277)..(277): n is a, c, g, or t
tcagacagtatatacacgaccggtgctcgatttagagagagtgtgttgggtttggggggaagcacctgtggttcttcctcctgctggtggcggctcccagatgggtcctgtctcagccgcagctgcgggagtcgggcccaggactggtgaagccttcggagaccctgtccctcacgtgcacggtctctggtgcctccatcgacagaagtaatttctacgtggggctggatccgccacgccccgaggaggaggggctgcgaggtggagttgggatctntattagtagtggaacacctactaccaacccgtcctacgaacggtcgagtcaccatactccgtggaccacgtcgaggacacgtacgtttcccgtagaaacgtgtagtttcgtggtcggcccgccgccgacacggctgtacctactactgtcgtcagactacggtcgggtcccgtacgtagtcggacgtacggtcgtctactaactttacctaacttacgtcgttacgggggaccgttcggtacggggacccgtaaacgggggacccgtaaccgggttacccacccggttcccttcccgtcctaaccgtcccctacgtacccgcccttacccaaccgtaaccgggcccctacgttccggtccccttcccccgtcggtccccgtcccgtccg

SEQ ID NO: 326682 - DNA, 533 bp, Homo sapiens
  misc_feature: GZ8MTXP02HOPXS.44.53.E09.1.454.CMB.2.raw
  modified_base (199)..(199): a, c, t, g, unknown or other
  misc_feature (199)..(199): n is a, c, g, or t
  modified_base (300)..(300): a, c, t, g, unknown or other
  misc_feature (300)..(300): n is a, c, g, or t
  modified_base (354)..(354): a, c, t, g, unknown or other
  misc_feature (354)..(354): n is a, c, g, or t
  modified_base (416)..(416): a, c, t, g, unknown or other
  misc_feature (416)..(416): n is a, c, g, or t
tcagacagtatatacacgaccggtgctcgatttagagagagtgtgttgagctctgggagaggagccccagccttgggattcccaggtgttttcattcagtgatcaggactgaacacagaggactcaccatggagtttgggctgagctggattttccttgctgctattttaaaaggtgtccagtgtgaggtgcagttggnggagtcgtgggggaggtttggtaaagccgtggggagtcccttagactctcctgtgcagcctctggattcactttcagtaacgcctggatgacctgggtccncaggctccgagggagggctggagtgggtgcgtatagacaagctgacggtggacngcagactacgctgcaccgtgaaaggcagattcgaccatctacaagagatgaattacaaaagntacggtgtactctgacagataggaacagcctagaacaccgagaccacgacgccgtatattactgtctaggggcttggtttcaagttccggcgtacggggaccctggtccaccggtcc

SEQ ID NO: 326683 - DNA, 570 bp, Homo sapiens
  misc_feature: GZ8MTXP02I9K3E.44.53.E09.1.454.CMB.2.raw
  modified_base (411)..(411): a, c, t, g, unknown or other
  misc_feature (411)..(411): n is a, c, g, or t
  modified_base (426)..(426): a, c, t, g, unknown or other
  misc_feature (426)..(426): n is a, c, g, or t
  modified_base (433)..(433): a, c, t, g, unknown or other
  misc_feature (433)..(433): n is a, c, g, or t
  modified_base (441)..(441): a, c, t, g, unknown or other
  misc_feature (441)..(441): n is a, c, g, or t
  modified_base (445)..(445): a, c, t, g, unknown or other
  misc_feature (445)..(445): n is a, c, g, or t
tcagacagtatatacacgaccggtgctcgatttagagagagtgtgttgagctctgggagaggagccccagccttgggattcccaggtgttttcattcagtgatcaggactgaacacagaggactcaccatggagtttgggctgagctggattttccttgctgctattttaaaggtgtccagtgtgaggtgcaggttggtggagtcgtgggggaggtttggtaaagccgtggggagtcccttagactctcctgtgcagcctctggattcactttcagtacgcctggatgaccgtgggtccgccgaggctccgaggggagggctggagtgggtggccgtattagaaccaaagctggacggtggacagcagactacgctgccaccggtagaaagcagacttcacatcacaaganatgaattacaaaagntacggtntctctganaganacgaacacgcacgaaccacggagacacgacgccgtacttattacgtgtcggttacggtacgttcggtttacgccggttaccggggacccgtaacggggtacccgtacgggtacccacccggttcc

SEQ ID NO: 326684 - DNA, 563 bp, Homo sapiens
  misc_feature: GZ8MTXP02H0NM3.44.53.E09.1.454.CMB.2.raw
  modified_base (300)..(300): a, c, t, g, unknown or other
  misc_feature (300)..(300): n is a, c, g, or t
  modified_base (421)..(421): a, c, t, g, unknown or other
  misc_feature (421)..(421): n is a, c, g, or t
  modified_base (426)..(426): a, c, t, g, unknown or other
  misc_feature (426)..(426): n is a, c, g, or t
  modified_base (441)..(441): a, c, t, g, unknown or other
  misc_feature (441)..(441): n is a, c, g, or t
tcagacagtatatacacgaccggtgctcgatttagagagagtgtgttgagctctgggagaggagccccagccttgggattcccaggtgttttcattcagtgatcaggactgaacacagaggactcaccatggagtttgggctgagctggtattttccttgctgcttaattttaaaaggtgtccagtgtgaggtgcagttggtggagtcgtgggggaggtttggtaaagcgtggggatcccttagactctctgtgcagcctctggattcactttcagtaacgctggatgaccgtgggtccnccaggctccgaggggaaggggctgggaggtggggttcggccgtattacgaaaccaagctggacggtgggacaggcagactacgctggccaacccggtgaaacggcagattccaccatccanaagantagattacaaaagtntacggtatctactgcagatagaacacgcctagaaccgaaccggaggaaccacgacgtcccgtataacgtactgtcgtggtactggtttccaagttccggacacgggaccctcggtcaccgtc

SEQ ID NO: 326685 - DNA, 618 bp, Homo sapiens
  misc_feature: GZ8MTXP02H23YW.44.53.E09.1.454.CMB.2.raw
  modified_base (258)..(258): a, c, t, g, unknown or other
  misc_feature (258)..(258): n is a, c, g, or t
  modified_base (443)..(443): a, c, t, g, unknown or other
  misc_feature (443)..(443): n is a, c, g, or t
  modified_base (452)..(452): a, c, t, g, unknown or other
  misc_feature (452)..(452): n is a, c, g, or t
tcagacagtatatacacgaccggtgctcgatttagagagagtgtgttgagctctgggagaggagccccagccttgggattcccaggtgttttcattcagtgatcaggactgaacacagaggactcaccatggagtttgggctgagctggtattttccttgctgcttaattttaaaaggtgtccagtgtgaggtgcaggttggtggagtcgtgggggtaggtttggtaaagcgtggggagtcccttagactctcctgtncagcctctggattcactttcagtaacgcctggatcgaccgtcgggtcccgccgaggcctccggaggggacggggcgtggaggttggggttcggacgttagttaacgaaccgaaagcgtaggacggtgggacagcagactacgctcgaccaccgtagaaacgcagacttacaccatctacaagagntagaactanaaaagtactacggtagtctcgtagactaagacgtaggaaacacgccgtaacgaaaccgaccggaacgacaacgacgccgttacttattaccgtggtcgttggggtacttcggtttactaaggttccggggaaccgtaccggggtacccgtcggtccctaccgtccc

SEQ ID NO: 326686 - DNA, 596 bp, Homo sapiens
  misc_feature: GZ8MTXP02JWD9R.44.53.E09.1.454.CMB.2.raw
  modified_base (412)..(412): a, c, t, g, unknown or other
  misc_feature (412)..(412): n is a, c, g, or t
  modified_base (535)..(535): a, c, t, g, unknown or other
  misc_feature (535)..(535): n is a, c, g, or t
tcagacagtatatacacgaccggtgctcgatttagagagagtgtgttgggtttgggggaagcacctgtggttcttcctcctgctggtggcggctcccagatgggtcctgtctcagccgcagctgcgggagtcgggcccaggactggtgaagccttcgggaaccctgtctctcatctgcactgtctctggagtttccatcagttctgatcattcttggggctggatccggcacgccccgagggagggaatggagtggattggtgacatccattatacgtgggcgacgtactactctccgtcctcaagagtcgtctcacctatttcgagggacacgtcatcgaaccgtcttcccctccctagaaacctcgaccctccgtgcccgccgcggaccgcgtccgtttattctgtgcgnggcgagactgttctttcgaattcgtagtcggggccgtaggcctacccgtggtccacgttcgtcctccttcgacgtccttacccgaccgaacgggtcccccagttcccggtccctttcccccgnggcccgccctacgcccttaccgacggtaacgccaccttcggacggggccacgacggcccgg

SEQ ID NO: 326687 - DNA, 558 bp, Homo sapiens
  misc_feature: GZ8MTXP02I4I9F.44.53.E09.1.454.CMB.2.raw
  modified_base (174)..(174): a, c, t, g, unknown or other
  misc_feature (174)..(174): n is a, c, g, or t
  modified_base (273)..(273): a, c, t, g, unknown or other
  misc_feature (273)..(273): n is a, c, g, or t
  modified_base (291)..(291): a, c, t, g, unknown or other
  misc_feature (291)..(291): n is a, c, g, or t
  modified_base (403)..(403): a, c, t, g, unknown or other
  misc_feature (403)..(403): n is a, c, g, or t
  modified_base (427)..(427): a, c, t, g, unknown or other
  misc_feature (427)..(427): n is a, c, g, or t
  modified_base (436)..(436): a, c, t, g, unknown or other
  misc_feature (436)..(436): n is a, c, g, or t
tcagacagtatatacacgaccggtgctcgatttagagagagtgtgttgagctctgggagaggagccccagccttgggattcccaggtgttttcattcagtgatcaggactgaacacagaggactcaccatggagtttgggctgagctggattttcctgctgctattttaaaggngtcagtgtgaggtgcagttggtggagtcgtgggggtagtttggaaagccgtggggatccttagactctcctgtgcagctctggattcacttcagtaacnctggatgaccgtgggccnccgaggctcgaaggggaggctggagtgggtgccgtatagaacaaagctaggacggtggacagacagactacgctgaccaccggtagaaacggcagtactcaacctataccanaagagtatagattaacgaaaagtntaacgggtntctacgtgacaggatagaacagacctagaacacgagacacacgtccgtatacttacacgttacgtgggtaacttggtttaccaagttaccgggacgtacgggaccctcggtaccaccgtccg

SEQ ID NO: 326688 - DNA, 572 bp, Homo sapiens
  misc_feature: GZ8MTXP02JL8A4.44.53.E09.1.454.CMB.2.raw
  modified_base (353)..(353): a, c, t, g, unknown or other
  misc_feature (353)..(353): n is a, c, g, or t
  modified_base (417)..(417): a, c, t, g, unknown or other
  misc_feature (417)..(417): n is a, c, g, or t
tcagacagtatatacacgaccggtgctcgatttagagagagtgtgttgggtttgggggaagcacctgtggttcttcctcctgctggtggcggctcccagatgggtcctgtctcagccgcagctgcgggagtcgggcccaggactggtgaagccttcggagaccctgtccctcacgtgcacggtctctggtgcctccatcgacagaagtaattctactgggctggatccgccagccccaggagaggggctgcagtggattgggagtctctattatagtgggaacacctactacaacccgtccctcaacggtcgagtcaccatatccgtggacacgtcgaggacacagtttcccngaaacgtgagttctgtggccgccgccgacacggctgtctactactgtgtcagacatgggtcccncctagtggcaggtcgtctcaattctactacgcttgggacgtcgtggggaccaaggggaccacggtccaccgtctcccgtcacgtccctcacgcctacccaccgaaacgggccccctaagtcccggtccttcccccgtcggcccgtccccgtccgg

SEQ ID NO: 326689 - DNA, 712 bp, Homo sapiens
  misc_feature: GZ8MTXP02HE9AJ.44.53.E09.1.454.CMB.2.raw
tcagacagtatatacacgaccggtgctcgatttagagagagtgtgttgggtttgggggaagcacctgtggttcttcctcctgctggtggcggctcccagatgggtcctgtctcagccgcagctgcgggagtcgggcccaggactggtgaagccttcggagaccctgtccctcacgtgcacggtctctggtgcctccatcgacagaagttaatttctacgtggggctggatccgccacgccccgaggaggaggggctggcgaggtggagttgggagtctctattataggtacgggaacacctactaccaaccccgtcctacgaacggtcgagtcacatagtccgtagacacgtcgagacacgtacgtttccagaaacgtgtacgttcgtggtcggcccgccgccgacgacgtctcgtactactactgtcgtacagacagtcgggtccctcctagtcggcgtacggttcgtactacttaacttccttaacgttacggtcgtttacgggggaaccgttcgggtacgggggaccccgaaaacgggggaccccgtaacgggtaccccgtaacccggttcccttacccgtacctacgtttccccctacgaacccggtaccccctacccgaaaacccggaaacccgggggtcccctaacggtttcccccggggttaccccctttccccccggcggggtccccctacccccggttcccgg

SEQ ID NO: 326690 - DNA, 572 bp, Homo sapiens
  misc_feature: GZ8MTXP02I7K4O.44.53.E09.1.454.CMB.2.raw
tcagacagtatatacacgaccggtgctcgatttagagagagtgtgttgggtttgggggaagcacctgtggttcttcctcctgctggtggcggctcccagatgggtcctgtctcagccgcagctgcgggagtcgggcccaggactggtgaagccttcggagaccctgtccctcacgtgcacggtctctggtgcctccatcgacagaagtaatttctactggggctggatccgccagcccccaggagaggggctgcagtggattgggagtctctattatagtgggaacacctactacaacccgtccctcaacggtcgagtcacatatccgtgacacgtcgaggacactagttttccctagaaagtgagttctggtggcccgccgccgacacggctcgtctactactgtgtcagacagtgggtcccgcctatggcagggtcgtctcaaattctacttacgcttgggacgttcgtggggcccaaggggacccacgggtcaccgtctaccgtcactcctcacgcctaccacccgaagggcccctacgtccggtcccttcccccgtggcccgccctcg

SEQ ID NO: 326691 - DNA, 580 bp, Homo sapiens
  misc_feature: GZ8MTXP02JFZ07.44.53.E09.1.454.CMB.2.raw
  modified_base (301)..(301): a, c, t, g, unknown or other
  misc_feature (301)..(301): n is a, c, g, or t
  modified_base (323)..(323): a, c, t, g, unknown or other
  misc_feature (323)..(323): n is a, c, g, or t
  modified_base (359)..(359): a, c, t, g, unknown or other
  misc_feature (359)..(359): n is a, c, g, or t
  modified_base (429)..(429): a, c, t, g, unknown or other
  misc_feature (429)..(429): n is a, c, g, or t
  modified_base (437)..(437): a, c, t, g, unknown or other
  misc_feature (437)..(437): n is a, c, g, or t
  modified_base (482)..(482): a, c, t, g, unknown or other
  misc_feature (482)..(482): n is a, c, g, or t
tcagacagtatatacacgaccggtgctcgatttagagagagtgtgttgagctctgggagaggagccccagccttgggattcccaggtgttttcattcagtgatcaggactgaacacagaggactcaccatggagtttgggctgagctggattttccttgctgctattttaaaaggtgtccagtgtgaggtgcagttggtggagtcgtgggggaggtttggtaaagccgtgggggagtcccttagactctcctgtgcagcctctggattcactttcagtaacgcctggatgacctgggtccnccaggctccgagggaggctggngtgggtgccgtatagaaccaagctggacggtggacngcagactacgctgcacccggtgaaaacggcaagatccacccatcctcaaagagatgaattacaaaaagtntacgggtntactctgctaagatagaaacagccctagaaccaccggagactacncggtacctctattaccgtgtaccgtggggtaattcggtttacgaacggtttccggggaccctacgggggtaccccttcgggtaccctaccggtttccc

SEQ ID NO: 326692 - DNA, 543 bp, Homo sapiens
  misc_feature: GZ8MTXP02HW69R.44.53.E09.1.454.CMB.2.raw
  modified_base (190)..(190): a, c, t, g, unknown or other
  misc_feature (190)..(190): n is a, c, g, or t
  modified_base (224)..(224): a, c, t, g, unknown or other
  misc_feature (224)..(224): n is a, c, g, or t
  modified_base (236)..(236): a, c, t, g, unknown or other
  misc_feature (236)..(236): n is a, c, g, or t
  modified_base (309)..(309): a, c, t, g, unknown or other
  misc_feature (309)..(309): n is a, c, g, or t
  modified_base (312)..(312): a, c, t, g, unknown or other
  misc_feature (312)..(312): n is a, c, g, or t
  modified_base (317)..(317): a, c, t, g, unknown or other
  misc_feature (317)..(317): n is a, c, g, or t
  modified_base (356)..(356): a, c, t, g, unknown or other
  misc_feature (356)..(356): n is a, c, g, or t
tcagacagtatatacacgaccggtgctcgatttagagagagtgtgttgggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactgganccagcggtaatnttcttagtcttaacttgtctcctggtatcaacatcatccagtaaacgcccccaaactcatcatcatgagctanagngcctnagggtttcaatcgcttccactcgcctcagtccggacacncggcctccctgacatctctggctccgagctgagacgaggctagatttattattgttgcttactagtattgttccgtgactatctactttatgtcttagggaacgtcgggaacctaaggtctaaccgttccgtaggttccaacgaacccgtaaacggaccctaaacccccatacggtcctacgttccc

SEQ ID NO: 326693 - DNA, 601 bp, Homo sapiens
  misc_feature: GZ8MTXP02GBAOA.44.53.E09.1.454.CMB.2.raw
  modified_base (249)..(249): a, c, t, g, unknown or other
  misc_feature (249)..(249): n is a, c, g, or t
  modified_base (256)..(256): a, c, t, g, unknown or other
  misc_feature (256)..(256): n is a, c, g, or t
  modified_base (297)..(297): a, c, t, g, unknown or other
  misc_feature (297)..(297): n is a, c, g, or t
  modified_base (380)..(380): a, c, t, g, unknown or other
  misc_feature (380)..(380): n is a, c, g, or t
  modified_base (420)..(420): a, c, t, g, unknown or other
  misc_feature (420)..(420): n is a, c, g, or t
  modified_base (436)..(436): a, c, t, g, unknown or other
  misc_feature (436)..(436): n is a, c, g, or t
  modified_base (443)..(443): a, c, t, g, unknown or other
  misc_feature (443)..(443): n is a, c, g, or t
tcagacagtatatacacgaccggtgctcgatttagagagagtgtgttgagctctgggagaggagccccagccttgggattcccaggtgttttcattcagtgatcaggactgaacacagaggactcaccatggagtttgggctgagctggattttccttgctgctattttaaaaggtgtccagtgtgaggtgcagttggtggagtcgtgggggagtttggaaagccgtggggatccctagctctcctgtncagcctntggattcactttcagtaacgcctggatcgacctgggtcccncgaggcctacggaggggaacggggctgggagtggggttgccgttatacgaaaccaagctggacggtggacagcagactaccgntcgccaccggtagaaacgcagacttcactatcacgaaganatagattacaaaagtntacggtntcctgtgacgagagtacgaaacgcgacgtacgaacgaccggacggacacgtacgtaccgtactaagttaccgtggttacgtagggtaacgttcggtttacgaacggttacccgggacgtaaaccggggtaccccgttcgggtaccctaccggttcccg

SEQ ID NO: 326694 - DNA, 586 bp, Homo sapiens
  misc_feature: GZ8MTXP02HWOVV.44.53.E09.1.454.CMB.2.raw
  modified_base (176)..(176): a, c, t, g, unknown or other
  misc_feature (176)..(176): n is a, c, g, or t
  modified_base (375)..(375): a, c, t, g, unknown or other
  misc_feature (375)..(375): n is a, c, g, or t
  modified_base (406)..(406): a, c, t, g, unknown or other
  misc_feature (406)..(406): n is a, c, g, or t
  modified_base (426)..(426): a, c, t, g, unknown or other
  misc_feature (426)..(426): n is a, c, g, or t
  modified_base (432)..(432): a, c, t, g, unknown or other
  misc_feature (432)..(432): n is a, c, g, or t
tcagacagtatatacacgaccggtgctcgatttagagagagtgtgttgagctctgggagaggagccccagccttgggattcccaggtgttttcattcagtgatcaggactgaacacagaggactcaccatggagtttgggctgagctggattttccttgctgctattttaaaaggngtccagtgtgaggtgcagttggtggagtcgtgggggaggtttggtaaagccgtggggatcccttagactctcctgtgcagcctctggattcactttcagtaacgcctggatgaccgtgggtccgccaggcctccgaggggaggggctggagtgggttgcgtattagaacaaagctggacggtggacagcagactacgcngcacccgtgaaacgcagattccacatcctanaagagatgaattacaaaagntaggtntctctgacagactagaaccagcctagaaaccgacggaagacactacggtcctacttacttacgtcggttacgtggggtaactttcggggtttactaacggtttcccggggaccgtaaaccggggtacccgttcgggtaccgttaacccgtcccg

SEQ ID NO: 326695 - DNA, 547 bp, Homo sapiens
  misc_feature: GZ8MTXP02GOH4W.44.53.E09.1.454.CMB.2.raw
  modified_base (356)..(356): a, c, t, g, unknown or other
  misc_feature (356)..(356): n is a, c, g, or t
  modified_base (538)..(538): a, c, t, g, unknown or other
  misc_feature (538)..(538): n is a, c, g, or t
tcagacagtatatacacgaccggtgctcgatttagagagagtgtgttgggtttgggggaagcacctgtggttcttcctcctgctggtggcggctcccagatgggtcctgtctcagccgcagctgcgggagtcgggcccaggactggtgaagccttcggagaccctgtccctcacgtgcacggtctctggtgcctccatcgacagaagtaatttctactgggctggatccgccagcccccaggagaggggctgcagtggattgggagtctctattatagtgggaacacctactacaaccccgtccctcaacggtcgagtcaccatatccgtggacacgtcgaggacacagtttcccngaaacgtgagttctgtgccgcgccgacacggctgtctactactgtgtcagacatgggtcccgctatggcaggtcgtcgtcaaattctactacgcttgggacgtcgtggggcctaagggaccacggtcaccgtctccgtcactccgtcacgccctccaccaaggcccatccggtctcccccgngccgcctcg

SEQ ID NO: 326696 - DNA, 645 bp, Homo sapiens
  misc_feature: GZ8MTXP02G5KYZ.44.53.E09.1.454.CMB.2.raw
  modified_base (302)..(302): a, c, t, g, unknown or other
  misc_feature (302)..(302): n is a, c, g, or t
  modified_base (360)..(360): a, c, t, g, unknown or other
  misc_feature (360)..(360): n is a, c, g, or t
  modified_base (367)..(367): a, c, t, g, unknown or other
  misc_feature (367)..(367): n is a, c, g, or t
  modified_base (533)..(533): a, c, t, g, unknown or other
  misc_feature (533)..(533): n is a, c, g, or t
  modified_base (626)..(626): a, c, t, g, unknown or other
  misc_feature (626)..(626): n is a, c, g, or t
tcagacagtatatacacgaccggtgctcgatttagagagagtgtgttgagctctgggagaggagccccagccttgggattcccaggtgttttcattcagtgatcaggactgaacacaggggactcaccatggagtttgggctgagctggattttccttgctgctattttaaaaggtgtccagtgtgagtgcagttggtggagtcgtgggggtaggtttggtaaagccgtggggacgtcccttagactctcctgtgcagcctctggattcactttcagtaacgcctggatcgacctgggtccncaggctcgaggggaggctggagtggtgcgtatacgaacaagctgacggtggacagcanacacgcncgccaccgtgaaacggcagacttacaccatctacgaaagagatgtaacttaaacaaaagtgtaacggtgtacctagtggacaaggtacgtagaaacccgagtcccccgtaagaaaccgaacccggaaggtaacccaacgacgtaccccgttacttaagtttaccgnggttccggtaggggttaacgtttcggggttttaaccaacggggtttcccggggaacccggaaccgggggttaaaccccctggggttaaacccnccccgggttccttaccccg

SEQ ID NO: 326697 - DNA, 582 bp, Homo sapiens
  misc_feature: GZ8MTXP02HUL8O.44.53.E09.1.454.CMB.2.raw
  modified_base (299)..(299): a, c, t, g, unknown or other
  misc_feature (299)..(299): n is a, c, g, or t
  modified_base (416)..(416): a, c, t, g, unknown or other
  misc_feature (416)..(416): n is a, c, g, or t
  modified_base (424)..(424): a, c, t, g, unknown or other
  misc_feature (424)..(424): n is a, c, g, or t
  modified_base (472)..(472): a, c, t, g, unknown or other
  misc_feature (472)..(472): n is a, c, g, or t
tcagacagtatatacacgaccggtgctcgatttagagagagtgtgttgagctctgggagaggagccccagccttgggattcccaggtgttttcattcagtgatcaggactgaacacagaggactcaccatggagtttgggctgagctggtattttccttgctgcttaattttaaaaggtgtccagtgtgaggtgcagttggtggagtcgtgggggaggtttggtaaagccgtggggagtcccttagactctcctgtgcagcctctggattcacttcagtacgcctggatgacctggccnccgaggcctccgaaggggaagggcgtgggaggtggggttcggaccgttaagtaacgaaaccaaagcgtggacggtgggacagcagactacgctgccaccgagaaagcagatcaccancacaaganatagaattacgaaaagtacttacgtagtctctagctaagatagaaacncgactacgaaacgaccggacggactacaacgtccgtactatactcgtacgtcggtacgttggttcgtaacgttcgggaccgtacggaacccgtcggtccaacccgtcccg

SEQ ID NO: 326698 - DNA, 540 bp, Homo sapiens
  misc_feature: GZ8MTXP02FXU88.44.53.E09.1.454.CMB.2.raw
  modified_base (453)..(453): a, c, t, g, unknown or other
  misc_feature (453)..(453): n is a, c, g, or t
  modified_base (477)..(477): a, c, t, g, unknown or other
  misc_feature (477)..(477): n is a, c, g, or t
  modified_base (483)..(483): a, c, t, g, unknown or other
  misc_feature (483)..(483): n is a, c, g, or t
tcagacagtatatacacgaccggtgctcgatttagagagagtgtgttgagctctgggagaggagccccagccttgggattcccaggtgttttcattcagtgatcaggactgaacacagaggactcaccatggagtttgggctgagctggattttccttgctgctattttaaaaggtgtccagtgtgaggtgcagttggtggagtcgtgggggaggtttggtaaagccgtggggagtcccttagactctcctgtgcagcctctggattcactttcagtaacgcctggatcgacctgggtcccgccaggcctccgaggggaggggctggagtgggtgccgtatagaaccaaagctggacggtggacagcagactacgctgcacccgtgaaagcagatcacatctacaagagatagattaacaaaagtataacggtgtactcgtgcagatagaacngcctagaacacgagacacaccgtntatacngtcgtggattcggttcagttcgggaccgacgggtaccctggtaccacccgtctcccg

SEQ ID NO: 326699 - DNA, 570 bp, Homo sapiens
  misc_feature: GZ8MTXP02F0CUP.44.53.E09.1.454.CMB.2.raw
  modified_base (352)..(352): a, c, t, g, unknown or other
  misc_feature (352)..(352): n is a, c, g, or t
tcagacagtatatacacgaccggtgctcgatttagagagagtgtgttgggtttgggggaagcacctgtggttcttcctcctgctggtggcggctcccagatgggtcctgtctcagccgcagctgcgggagtcgggcccaggactggtgaagccttcggagaccctgtccctcacgtgcacggtctctggtgcctccatcgacagaagtaattctactgggctggatccgccagcccccaggagagggctgcagtggattgggagtctctattatagtgggaacactactacaaccccgtcctcaacggtcgagtcaccatatccgtggacacgtcgaggacacagtttcccngaaacgtgagttctgtggcccgcgccgacacggctgtctactactgtgtcagacatgggtccgcctatggcaggtcgtctacaattctactacgctttgggactcgtggggaccaagggaccaggtccacgtctcctcactccgtcacgtccctaccgaacccgaaacggggcccctaacgttccggtcccgttcccccgtcgggcccgtcccgtccg

SEQ ID NO: 326700 - DNA, 581 bp, Homo sapiens
  misc_feature: GZ8MTXP02I2TBL.44.53.E09.1.454.CMB.2.raw
  modified_base (306)..(306): a, c, t, g, unknown or other
  misc_feature (306)..(306): n is a, c, g, or t
  modified_base (427)..(427): a, c, t, g, unknown or other
  misc_feature (427)..(427): n is a, c, g, or t
  modified_base (454)..(454): a, c, t, g, unknown or other
  misc_feature (454)..(454): n is a, c, g, or t
  modified_base (480)..(480): a, c, t, g, unknown or other
  misc_feature (480)..(480): n is a, c, g, or t
tcagacagtatatacacgaccggtgctcgatttagagagagtgtgttgagctctgggagaggagccccagccttgggattcccaggtgttttcattcagtgatcaggactgaacacagaggactcaccatggagtttgggctgagctggattttcctgctgcttattttaaaaggtgtccagtgtgaggtgcaggttggtggagtcgtgggggtaggtttaggtaaagccgtggggacgtcccttagactctcctgtgcagcctctggtattctactttcagtaacgctggatgaccgtgggtccnccaggcctccggaggggaggggctggaggtgggtcggccgttaataacgaaaccaaagcctaggacggtggacagcaagactacgctcgccaccgtagaacgcagactcacatcacaaganatagaattaacgaaaagtctaacggtntacctctagactaagacgtagaaacncgactacgaacgacgagacacgacgtacctattacttcgtgtcgtggtacttcggttacaacggttcggaccgtacgggtaccctcggtaccgtaccgtcc

SEQ ID NO: 326701 - DNA, 582 bp, Homo sapiens
  misc_feature: GZ8MTXP02GBS7D.44.53.E09.1.454.CMB.2.raw
  modified_base (355)..(355): a, c, t, g, unknown or other
  misc_feature (355)..(355): n is a, c, g, or t
tcagacagtatatacacgaccggtgctcgatttagagagagtgtgttgggtttgggggaagcacctgtggttcttcctcctgctggtggcggctcccagatgggtcctgtctcagccgcagctgcgggagtcgggcccaggactggtgaagccttcggagaccctgtccctcacgtgcacggtctctggtgcctccatcgacagaagtaatttctactggggctggatccgccagcccccaggagaggggctgcagtggattgggagtctctattatagtgggaacacctactacaaccccgtcctcaacggtcagtcaccatatccgtggacacgtcgaggacacagtttcccngaaacgtgagttctgtggccgcgccgacacggctgtctactactgtgtcagacagtcggggtccgcctagtggcagggtcgtctcaattctactacgcttagggacgtcgtggggccaagggccacggtcaccgtctacccgtcactccctcacgccctacccgaacccgtaaacgggccccaacgttcccggttccccttcccccgtcgggcccgtccccgttccg

SEQ ID NO: 326702 - DNA, 557 bp, Homo sapiens
  misc_feature: GZ8MTXP02GAAGZ.44.53.E09.1.454.CMB.2.raw
  modified_base (302)..(302): a, c, t, g, unknown or other
  misc_feature (302)..(302): n is a, c, g, or t
  modified_base (419)..(419): a, c, t, g, unknown or other
  misc_feature (419)..(419): n is a, c, g, or t
  modified_base (490)..(490): a, c, t, g, unknown or other
  misc_feature (490)..(490): n is a, c, g, or t
  modified_base (505)..(505): a, c, t, g, unknown or other
  misc_feature (505)..(505): n is a, c, g, or t
  modified_base (511)..(511): a, c, t, g, unknown or other
  misc_feature (511)..(511): n is a, c, g, or t
tcagacagtatatacacgaccggtgctcgatttagagagagtgtgttgagctctgggagaggagccccagccttgggattcccaggtgttttcattcagtgatcaggactgaacacagaggactcaccatggagtttgggctgagctggtattttccttgctgctattttaaaaggtgtccagtgtgaggtgcagttggtggagtcgtgggggtaggtttggtaaagccgtggggagtcccttagactctcctgtgcagcctctggattcactttcagtacgctggatcgaccgtgggtccnccgaggctccggaggggaggggctgggagtggggtggaccgtatagaaaccaaagctaggacggtgggacagcagactacgctcgccacccggtagaaacgcagactcaaccatcanaagagatgaattacaaaagtagtacgtgtcctgtagtacagataggaacacgcctagaaccacgagacacncgaccgtatactacngttcgngggtattggttcaagttccggactacgggacctggtaccaccgtcc

SEQ ID NO: 326703 - DNA, 589 bp, Homo sapiens
  misc_feature: GZ8MTXP02GPGNF.44.53.E09.1.454.CMB.2.raw
  modified_base (301)..(301): a, c, t, g, unknown or other
  misc_feature (301)..(301): n is a, c, g, or t
  modified_base (415)..(415): a, c, t, g, unknown or other
  misc_feature (415)..(415): n is a, c, g, or t
  modified_base (420)..(420): a, c, t, g, unknown or other
  misc_feature (420)..(420): n is a, c, g, or t
  modified_base (437)..(437): a, c, t, g, unknown or other
  misc_feature (437)..(437): n is a, c, g, or t
  modified_base (447)..(447): a, c, t, g, unknown or other
  misc_feature (447)..(447): n is a, c, g, or t
  modified_base (453)..(453): a, c, t, g, unknown or other
  misc_feature (453)..(453): n is a, c, g, or t
tcagacagtatatacacgaccggtgctcgatttagagagagtgtgttgagctctgggagaggagccccagccttgggattcccaggtgttttcattcagtgatcaggactgaacacaggggactcaccatggagtttgggctgagctggattttccttgctgcttattttaaaaggtgtccagtgtgaggtgcagttggtggagtcgtgggggaggtttggtaaagccgtggggagtcccttagactctcctgtgcagcctctggattcactttcagtaacgcctggatgacctgggtccnccaggcctccgaggggaaggggctgggaggtggggttggccgtaagttacgaaccaaagcgtaggacggtggacagcagactacgctgccaccgtgaaagcagatcaccatcanaaganatgaattacgaaaagtntaacgggttntctcgngacagatacgaacacgaccgtagaaaccgaccgaacgacacgacgtaccgttacttacttacgtcgtcggtaggtacgttcggttacgacggtccggaccgtaacgggtacccgtggtaccctacccgttctaccg

SEQ ID NO: 326704 - DNA, 617 bp, Homo sapiens
  misc_feature: GZ8MTXP02I8JDO.44.53.E09.1.454.CMB.2.raw
  modified_base (281)..(281): a, c, t, g, unknown or other
  misc_feature (281)..(281): n is a, c, g, or t
  modified_base (301)..(301): a, c, t, g, unknown or other
  misc_feature (301)..(301): n is a, c, g, or t
  modified_base (458)..(458): a, c, t, g, unknown or other
  misc_feature (458)..(458): n is a, c, g, or t
  modified_base (539)..(539): a, c, t, g, unknown or other
  misc_feature (539)..(539): n is a, c, g, or t
tcagacagtatatacacgaccggtgctcgatttagagagagtgtgttgagctctgggagaggagccccagccttgggattcccaggtgttttcattcagtgatcaggactgaacacagaggactcaccatggagtttgggctgagctggattttcctgctgctattttaaaggtgtccagtgtgaggtgcagttggtggagtcgtgggggtaggtttggtaaagccgtggggacgtcccttagactctcctgtgcagcctctggattcactttcagtaacncctggatcgaccgtggtccncaggcctccgagggagggctggaggtgggtcgccgtagtagaaaccaaagctggacggtggacagcagactacgctcggaccacccggtagaaacgctaagacttaccaaccattcccacgaaagagatagaacttaaacaaaagtactaacgggtntactacgtgactagagtacggaaaactcgaccgtacgaaacgaaccggaaggaaccaacgacgtcccgtaattacttacgngtacggttgggacttcggtttacaacggtttacccgggaccgtaaaccggggaccctcgggtaccctaccggtttacc

SEQ ID NO: 326705 - DNA, 559 bp, Homo sapiens
  misc_feature: GZ8MTXP02I5X53.44.53.E09.1.454.CMB.2.raw
  modified_base (358)..(358): a, c, t, g, unknown or other
  misc_feature (358)..(358): n is a, c, g, or t
tcagacagtatatacacgaccggtgctcgatttagagagagtgtgttgggtttgggggaagcacctgtggttcttcctcctgctggtggcggctcccagatgggtcctgtctcagccgcagctgcgggagtcgggcccaggactggtgaagccttcggagaccctgtccctcacgtgcacggtctctggtgcctccatcgacagaagtaatttctactggggctggatccgccagcccccaggagaggggctgcagtggattgggagtctctattatagtgggaacacctactacaaccccgtccctcaacggtcgagtcaccatatccgtggacacgtcgaggacacagttttcccngaaacgtgagttctgtggccgccgccgacacgggctgtctactactgtgtcagacagtgggtcccgctatggcaggtcgtctcaattctactacgcttgggacgtcgtggggccaagggaccacggtcaccgtctccgtcactcctcacgccctccaccgaacgggcccacgtccggtccttcccccgtggccgcccgtcg

SEQ ID NO: 326706 - DNA, 724 bp, Homo sapiens
  misc_feature: GZ8MTXP02IAFP0.44.53.E09.1.454.CMB.2.raw
  modified_base (364)..(364): a, c, t, g, unknown or other
  misc_feature (364)..(364): n is a, c, g, or t
tcagacagtatatacacgaccggtgctcgatttagagagagtgtgttgggtttgggggaagcacctgtggttcttcctcctgctggtggcggctcccagatgggtcctgtctcagccgcagctgcgggagtcgggcccaggactggtgaagccttcggagaccctgtccctcacgtgcacggtctctggtgcctcatcgacagaagtaatttctactgggctggatccgcagccccaggagagggctgcagtggattgggagtctctatatagtgggaacacctactacaacccgtcctcaacggtcgagtcaccatatccgtggacacgtcgaggacactagtttcctagaaacgtgagttcngtgccgccgccactacggctgtctactactgtcgtcagacagtcgggcccgtcccgtagtcgggaccgtacgggtccggtacttacctaaactttccgttacgttaacgtccggtttacgggggtaaccggtttcggttaccgggggacccgtaaacggggggaaccccgtaaaccggggttcccgtaaaccccgggtttcccttccccggttaccgtaaccgttccccttacccgaaccggtaccccctttacccccgaaaaccccgtaaaacccgggggaacccccctaaaccgttaccccggggtttaccccgtttaccccccccggttcggggacccccgtcccccgttaccccgg

SEQ ID NO: 326707 - DNA, 618 bp, Homo sapiens
  misc_feature: GZ8MTXP02IMO1N.44.53.E09.1.454.CMB.2.raw
  modified_base (273)..(273): a, c, t, g, unknown or other
  misc_feature (273)..(273): n is a, c, g, or t
tcagacagtatatacacgaccggtgctcgatttagagagagtgtgttgggtttgggggaagcacctgtggttcttcctcctgctggtggcggctcccagatgggtcctgtctcagccgcagctgcgggagtcgggcccaggactggtgaagccttcggagaccctgtccctcacgtgcacggtctctggtgcctccatcgacagaagtaatttctacgtgggctggactcccgccacgccccaggagaggggctgcagtggattgggagtctntattagtagtgggaacacctactaccaacccgtcctacgaacggtcgagtccacatctcgtgacacgtgagacactagtttccagtaaacgtgattcgtgtcggccgccgcgacacggctcgtctacgtactgtgtcagacagtcgggtcccgcctagttggcgtagggttcctcgtactaacgtttctacgtacgtcgttaggggaccgtcgggtcggggaccgtaacggggtaaccctcggggtacctacccggttctcccttacaccttcccgtacaccgtccctacccgaacccgacgggccctacgttccgttcccttccccggtcggcccgtcccgtcg

SEQ ID NO: 326708 - DNA, 817 bp, Homo sapiens
  misc_feature: GZ8MTXP02H7FF3.44.53.E09.1.454.CMB.2.raw
tcagacagtatatacacgaccggtgctcgatttagagagagtgtgttgggtttgggggaagcacctgtggttcttcctcctgctggtggcggctcccagatgggtcctgtctcagccgcagctgcgggagtcgggcccaggactggtgaagccttcggagaccctgtccctcacgtgcacggtctccgtggtcgcctccatacgacaagtaaagtttaactttctacggtgggtcgtggacgtcccgccgaccgaccccgagggagggacgggtctgcgtaggtaggtaggttgggacttcttacttaattaagttagggtacggaaaccctaccgttaacctaaaccccgtaccccgtcccctaacggaaccggtcgtacgtacccacctaattaccgttccggtaggacctaccgggtcggaacggacctaacgtttaccgttttccgtaaggtaaacggttcgtacgtttcgttgggtaccggccccgtcccggccgtaccgaccggtcttacgttacccttaacgtttacgttggttccgtagaaccgtacgtagggtttcccggggtacccctacgtggtacggtcggtacgggttccctcttaacttaccgtttaccgtaaacgttccgtcggggtttaccgggccgttcgggtccggggaaccgaacggggacccgtaacggttccctacccgttccctttacccactccttaccccgtagacccgtacccccgaaccgtaaacccgggacggtaacccccgttacgttcccggtccccctttccccggccgggtccccttcccggtccg

SEQ ID NO: 326709 - DNA, 642 bp, Homo sapiens
  misc_feature: GZ8MTXP02HGOUC.44.53.E09.1.454.CMB.2.raw
  modified_base (408)..(408): a, c, t, g, unknown or other
  misc_feature (408)..(408): n is a, c, g, or t
tcagacagtatatacacgaccggtgctcgatttagagagagtgtgttgggtttgggggaagcacctgtggttcttcctcctgctggtggcggctcccagatgggtcctgtctcagccgcagctgcgggagtcgggcccaggactggtgaagccttcggagaccctgtccctcacgtgcacggtctctggtgcctccatcgacagaagtaatttctactggggctggatccgccacgccccaggagaggggctgcagtggattgggagtctctattatagtgggaacacctactacaacccgtcctcaacggtcagtcaccatatccgtgacacgtcgaggacactacgtttcccagaaacgtgtacgttctgtggcccgccgcccgactacggctcgtctactactgngtcagacgagtggtcccgcctagtggcagggttcgtctactaacgtttctaccgttacgcgtttacggggtacgtccgtacgggggacccaaacggggtacccctaacgggtcctacccggtccttacccgtccaacgttcccctacgaccgtccccgtacccgaacccgaaaccggggtccccacgtttccccgggtcccctttccccccgtcggccccgttccccttcccgg

SEQ ID NO: 326710 - DNA, 595 bp, Homo sapiens
  misc_feature: GZ8MTXP02I6SLZ.44.53.E09.1.454.CMB.2.raw
  modified_base (429)..(429): a, c, t, g, unknown or other
  misc_feature (429)..(429): n is a, c, g, or t
  modified_base (580)..(580): a, c, t, g, unknown or other
  misc_feature (580)..(580): n is a, c, g, or t
tcagacagtatatacacgaccggtgctcgatttagagagagtgtgttgggtttgggggaagcacctgtggttcttcctcctgctggtggcggctcccagatgggtcctgtctcagccgcagctgcgggagtcgggcccaggactggtgaagccttcggagaccctgtccctcacgtgcacggtctctggtgcctccatcgacagaagtaattctactggggctggatccgcagccccaggagagggctgcagtggattgggagtctctattatagtgggaacacctactaccaacccgtccctcaacggtcgagtcaccatatccgtggacacgtcgaggacactagtttcccctgaaacgtgagtttctggtcggcccgccgccgacacgggctcgtctacgtactgtgtcagacagtcgggtacccnctagtggacagggtctctacaatttcctacttacgcgttgggaccgtcgtcgggggaccaaggggaccctacgggtcaccggttcctcctcactccctcaacggtccctaccgaccaacggggccccaagttcccggtccctttcccccgnggcccgacccttcgg

SEQ ID NO: 326711 - DNA, 613 bp, Homo sapiens
  misc_feature: GZ8MTXP02JL7XH.44.53.E09.1.454.CMB.2.raw
tcagacagtatatacacgaccggtgctcgatttagagagagtgtgttgggtttgggggaagcacctgtggttcttcctcctgctggtggcggctcccagatgggtcctgtctcagccgcagctgcgggagtcgggcccaggactggtgaagccttcggagaccctgtccctcacgtgcacggtctctggtgcctccatcgacagaagtaatttctacgtggggctggatccgccacgccccaggagagggctgcaggtggagtgggagtctctatataggtgggaactacctactaccaaccccgtcctacgaacggtcgagtccaccatactccgtgacacgtcgaggacacgtacgtttcccagaaacgtgagttctggtcggcccgcgccgacgacggtcctcgtcttacgtactggttcgtcgagacgtagtcggggtcccacttaggcgcgtaagggttctcctatactttcgacttaccgcgttcggggaacttcgtccgggggacctaaggggaccctacggtccaccgtcctacctcgactcccgtcaacgtccctacccgaacgaacggcccacgttccggtcccttccccgcggccctcctcg

SEQ ID NO: 326712 - DNA, 592 bp, Homo sapiens
  misc_feature: GZ8MTXP02FNCQT.44.53.E09.1.454.CMB.2.raw
  modified_base (575)..(575): a, c, t, g, unknown or other
  misc_feature (575)..(575): n is a, c, g, or t
tcagacagtatatacacgaccggtgctcgatttagagagagtgtgttgggtttggggggaagcacctgtggttcttcctcctgctggtggcggctcccagatgggtcctgtctcagccgcagctgcgggagtcgggcccaggactggtgaagccttcggagaccctgtccctcacgtgcacggtctctggtgcctccatcgacagaagtaatttctactggggctggatccgccagcccccaggagagggctgcagtggatgggagtctctattatagtgggaacacctactacaacccgtcctcaacggtcgagtcaccatatccgtggacacgtcgaggacacagttttcccagaaacgtgagttctgtggcccgccgccgacacggctgtcctactactgtgtcaaggacagtcgggtaccctcctagtcggactaggtccgtctacaaatttctactacgtctttggggacctcgtggggaccaaggggccacggtcaccgtctccgtcacgttccacacgcccctaccaaccgaacgggcccctaaagtcccgggttccctttcccccgnggccccgtccccctcgg

SEQ ID NO: 326713 - DNA, 565 bp, Homo sapiens
  misc_feature: GZ8MTXP02FR3JS.44.53.E09.1.454.CMB.2.raw
  modified_base (224)..(224): a, c, t, g, unknown or other
  misc_feature (224)..(224): n is a, c, g, or t
  modified_base (323)..(323): a, c, t, g, unknown or other
  misc_feature (323)..(323): n is a, c, g, or t
  modified_base (548)..(548): a, c, t, g, unknown or other
  misc_feature (548)..(548): n is a, c, g, or t
tcagacagtatatacacgaccggtgctcgatttagagagagtgtgttgggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactgganccagcggtaatattcttagtcttaactttgtctcctggtatcaacatcatccaggtaaacgcccccaaactcatcatctatgagcctataagagccctnagggtttctaatcgcttccactcgcctccaagtccggacacgacgcctcctagacaactctctgggctccagggctgaggacgaggtctagtatttaattagtttgttgctactagtattgttcgtcacatcactttagtcgttcgtttacgggaagttcgggaaactacggtaccgtaaccgttctaacgggtccaggaaccccaaacgggcccaaacccccgntaccgtctactttcccg

SEQ ID NO: 326714 - DNA, 579 bp, Homo sapiens
  misc_feature: GZ8MTXP02JPQ1X.44.53.E09.1.454.CMB.2.raw
  modified_base (351)..(351): a, c, t, g, unknown or other
  misc_feature (351)..(351): n is a, c, g, or t
  modified_base (365)..(365): a, c, t, g, unknown or other
  misc_feature (365)..(365): n is a, c, g, or t
tcagacagtatatacacgaccggtgctcgatttagagagagtgtgttgggtttgggggaagcacctgtggttcttcctcctgctggtggcggctcccagatgggtcctgtctcagccgcagctgcgggagtcgggcccaggactggtgaagccttcggagaccctgtccctcacgtgcacggtctctggtgcctccatcgacagaagtaatttctactggggctggatccgccagccccaggagaggggctgcagtggattgggagtctctattatagtgggaacacctactacaacccgtcctcaacggtcagtcacatatccgtgacacgtcgaggacactagtttccngaaacgtgagttcngtggccgcgccgacacggctgtctactactgtgtcagacagtcgggtccgctagtcggtcgaggtcgtctacgaatttcgtactacgtcttggggactcgtagggggcctaaggggaccacgggtcaccgtctacccgttcacgtcctacacggccctaccaccgaacgggtccccacgttcccggtccttcccccgtggccccgtcccgtccg

SEQ ID NO: 326715 - DNA, 572 bp, Homo sapiens
  misc_feature: GZ8MTXP02I38DC.44.53.E09.1.454.CMB.2.raw
  modified_base (328)..(328): a, c, t, g, unknown or other
  misc_feature (328)..(328): n is a, c, g, or t
  modified_base (353)..(353): a, c, t, g, unknown or other
  misc_feature (353)..(353): n is a, c, g, or t
  modified_base (416)..(416): a, c, t, g, unknown or other
  misc_feature (416)..(416): n is a, c, g, or t
  modified_base (422)..(422): a, c, t, g, unknown or other
  misc_feature (422)..(422): n is a, c, g, or t
tcagacagtatatacacgaccggtgctcgatttagagagagtgtgttgggtttgggggaagcacctgtggttcttcctcctgctggtggcggctcccagatgggtcctgtctcagccgcagctgcgggagtcgggcccaggactggtgaagccttcggagaccctgtccctcacgtgcacggtctctggtgcctccatcgacagaagtaattctactggggctggatccgccagcccccaggagaggggctgcagtggattgggagtctctattatagtgggaacacctactacaacccgtcctacaacggtcagtcaccatatccgnggacacgtcgagacactagtttccngaacgtgagttctgtgccgcgccgacacggctgtctactactgtgtcagtacagtcgggtccncctagnggcagggtccgtctactaatttcctaacttacggcttgggggacctcgtgggggacctaagggggaccacgggtccacgtcctcctcatccctcacgccctcccacgaacgggccccagtccggtccttcccccgtggcccgtaccctcg

SEQ ID NO: 326716 - DNA, 695 bp, Homo sapiens
  misc_feature: GZ8MTXP02G1U0P.44.53.E09.1.454.CMB.2.raw
  modified_base (190)..(190): a, c, t, g, unknown or other
  misc_feature (190)..(190): n is a, c, g, or t
  modified_base (271)..(271): a, c, t, g, unknown or other
  misc_feature (271)..(271): n is a, c, g, or t
  modified_base (287)..(287): a, c, t, g, unknown or other
  misc_feature (287)..(287): n is a, c, g, or t
tcagacagtatatacacgaccggtgctcgatttagagagagtgtgttgggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacaggtcggtcaccatctcctgcacgtggacgccagcggttaatattcttagtcttaacttgtctctgtatcaacntcatccaggtaaaccnccccaaactcatcatctatgacgctaagtaagacggcctgtacgggtttctaactcgtcttcctcgtcggctaccgaagtctacgggcaaccgacggtccctcccgtacgaccctattcctcgtcgggtcccttccgaggtcgtaggacgggaccggaggtctacgtactttaaccgtacgtcgaccgtacgtccttactaacttaacgtaaaccgtaagaccgtaacgaccgaaccggtaccccttaaccccgtttagttaccggtttaccgtttaaaccggggtaaaccgttaacgggggaaccccgtaaacgggttaccccgtaacccggtttaccggtaacggttacccgaacccggtaaccccgaaaccgggtacccccctaaaaccccggtcgtttacccgg

SEQ ID NO: 326717 - DNA, 573 bp, Homo sapiens
  misc_feature: GZ8MTXP02FXOJY.44.53.E09.1.454.CMB.2.raw
  modified_base (434)..(434): a, c, t, g, unknown or other
  misc_feature (434)..(434): n is a, c, g, or t
  modified_base (439)..(439): a, c, t, g, unknown or other
  misc_feature (439)..(439): n is a, c, g, or t
tcagacagtatatacacgaccggtgctcgatttagagagagtgtgttgagctctgggagaggagccccagccttgggattcccaggtgttttcattcagtgatcaggactgaacacagaggactcaccatggagtttgggctgagctggattttccttgctgctattttaaaaggtgtccagtgtgaggtgcagttggtggagtctgggggaggtttggtaaagcctggggagtcccttagactctcctgtgcagcctctggattcactttcagtaacgcctggatgacctgggtccgcaggctccgagggaggggctggaggtgggtgccgtattacgaaccaaagctggacggtggacagcagactacgctgccaccgtgaaacgcagacttcaccatcacaaagagaatgaattaacaaaagattacggtntactnagacagatagaacacgaccagaaaccgacggacgacacgtacgtccgtacttacttacgtcgtacgtacgggtactttggttacctaacggttcccgggaccgacggggtacccgttggtaccctacccggttc

SEQ ID NO: 326718 - DNA, 573 bp, Homo sapiens
  misc_feature: GZ8MTXP02JHN47.44.53.E09.1.454.CMB.2.raw
  modified_base (523)..(523): a, c, t, g, unknown or other
  misc_feature (523)..(523): n is a, c, g, or t
  modified_base (562)..(562): a, c, t, g, unknown or other
  misc_feature (562)..(562): n is a, c, g, or t
tcagacagtatatacacgaccggtgctcgatttagagagagtgtgttgggtttgggggaagcacctgtggttcttcctcctgctggtggcggctcccagatgggtcctgtctcagccgcagctgcgggagtcgggcccaggactggtgaagccttcggagaccctgtccctcacgtgcacggtctctggtgcctccatcgacagaagtaatttctactggggctggatccgccagccccaggagaggggctgcagtggattgggagtctctattatagtgggacacctactacaacccgtcctcaacggtcgagtcaccatactccgtgacacgtcgaggacactagtttccctagaacgtgagttctgtggccgcgccgacacggctgtctactactgtcgtcagacagtcgggtcccgcctagtcggcagggtccgtctacaaattcgtacttacgcgtttaggggacttcgtggggaccctaaggggacccacgggtccaccggttctccgttcactccncacgccctaccaccgacggcccagtccggtcctccccgngcccgtcctcg

SEQ ID NO: 326719 - DNA, 648 bp, Homo sapiens
  misc_feature: GZ8MTXP02F77BB.44.53.E09.1.454.CMB.2.raw
  modified_base (355)..(355): a, c, t, g, unknown or other
  misc_feature (355)..(355): n is a, c, g, or t
  modified_base (434)..(434): a, c, t, g, unknown or other
  misc_feature (434)..(434): n is a, c, g, or t
tcagacagtatatacacgaccggtgctcgatttagagagagtgtgttgggtttggggggaagcacctgtggttcttcctcctgctggtggcggctcccagatgggtcctgtctcagccgcagctgcgggagtcgggcccaggactggtgaagccttcggagaccctgtccctcacgtgcacggtctctggtgcctccatcgacagaagtaatttctactggggctggatccgccacgccccaggagaggggctgcagtggatgggagtctctattatagtgggaacaccgtactacaacccgtcctacaacggtcgagtcacatactcgtgacacgtcgaggacactagtttccngaaacgtgtagttctgtggccgcgcgacacggctgtctactactgtgtcagacagtcgggtccgaccgttagtcggcgnggtcgtctcgtaaactttcctaacgttaccggtctttagggggtaccgtccgggttacgggggacccgtaaagggggacccgtaaccgggtccgaacccgggttcctcccgttaccacttcccttacgaacgtcccctacccgaacccgaaaccgggggtccctaaaccgttcccggttccccttcccccgtcgggtcccgtccccgttaccgg

SEQ ID NO: 326720 - DNA, 608 bp, Homo sapiens
  misc_feature: GZ8MTXP02H9PJ2.44.53.E09.1.454.CMB.2.raw
tcagacagtatatacacgaccggtgctcgatttagagagagtgtgttgggtttgggggaagcacctgtggttcttcctcctgctggtggcggctcccagatgggtcctgtctcagccgcagctgcgggagtcgggcccaggactggtgaagccttcggagaccctgtccctcacgtgcacggtctctggtgcctccatcgacagaaagtaatttctactggggctggatccgccacgccccaggaggagggctgcagtggagttgggatctctattagtagtgggaacacctactaccaaccccgtcctacgaacggtcgacgtcaccatactccgtgacacgtcgaggacactagtttcccagaagtgagttctgtcggcccgccgccgacacgggtctgtacctactacgtgtcgtcagactacgtcgggtcccgctagtcggctaggtctcgtactacttctacgtacgcgttcgggacgtccgtggggaccgaacgggaccgacggtccgacccgtcgtccctcgactcccttacacgccctaccgaaccgaaccgggcccctacgttcccggttcccttcccccgtcggtcccgtcccgtccg

SEQ ID NO: 326721 - DNA, 530 bp, Homo sapiens
  misc_feature: GZ8MTXP02JROT6.44.53.E09.1.454.CMB.2.raw
  modified_base (301)..(301): a, c, t, g, unknown or other
  misc_feature (301)..(301): n is a, c, g, or t
  modified_base (396)..(396): a, c, t, g, unknown or other
  misc_feature (396)..(396): n is a, c, g, or t
  modified_base (400)..(400): a, c, t, g, unknown or other
  misc_feature (400)..(400): n is a, c, g, or t
  modified_base (404)..(404): a, c, t, g, unknown or other
  misc_feature (404)..(404): n is a, c, g, or t
  modified_base (415)..(415): a, c, t, g, unknown or other
  misc_feature (415)..(415): n is a, c, g, or t
  modified_base (421)..(421): a, c, t, g, unknown or other
  misc_feature (421)..(421): n is a, c, g, or t
  modified_base (425)..(425): a, c, t, g, unknown or other
  misc_feature (425)..(425): n is a, c, g, or t
  modified_base (429)..(429): a, c, t, g, unknown or other
  misc_feature (429)..(429): n is a, c, g, or t
  modified_base (443)..(443): a, c, t, g, unknown or other
  misc_feature (443)..(443): n is a, c, g, or t
  modified_base (451)..(451): a, c, t, g, unknown or other
  misc_feature (451)..(451): n is a, c, g, or t
  modified_base (466)..(466): a, c, t, g, unknown or other
  misc_feature (466)..(466): n is a, c, g, or t
  modified_base (480)..(480): a, c, t, g, unknown or other
  misc_feature (480)..(480): n is a, c, g, or t
tcagacagtatatacacgaccggtgctcgatttagagagagtgtgttgagctctgggagaggagccccagccttgggattcccaggtgttttcattcagtgatcaggactgaacacagaggactcaccatggagtttgggctgagctggattttccttgctgctattttaaaaggtgtccagtgtgaggtgcagttggtggagtcgtgggggaggtttggtaaagccgtggggagtcccttagactctcctgtgcagcctctggattcactttcagtaacgcctggatgaccgtgggtccnccaggctccgagggaggctggagtgggtgccgtatagaaccaaagctggacggtggacagcagactacgctcgcaccggtagaaagcagctcacntcanaagnatgatagaaantacgtntacnctancagactaggaaacncgaccganaaccgacgagacacncgaccgtatatacngtacgtgacttcggttcaagttccgggacacgggaccctggacctcgtcc

SEQ ID NO: 326722 - DNA, 617 bp, Homo sapiens
  misc_feature: GZ8MTXP02JZW8O.44.53.E09.1.454.CMB.2.raw
  modified_base (460)..(460): a, c, t, g, unknown or other
  misc_feature (460)..(460): n is a, c, g, or t
  modified_base (566)..(566): a, c, t, g, unknown or other
  misc_feature (566)..(566): n is a, c, g, or t
tcagacagtatatacacgaccggtgctcgatttagagagagtgtgttgggtttgggggaagcacctgtggttcttcctcctgctggtggcggctcccagatgggtcctgtctcagccgcagctgcgggagtcgggcccaggactggtgaagccttcggagaccctgtccctcacgtgcacggtctctggtgcctccatcgacagaagtaatttctacgtgggctggactccgccacgcccccaggagagggctgcagtggagtgggagtctactattagtagtacgggaactacctactaaccaaccccgtccctacgaacggtcgagtccacctatacgtccgtaggaccacggtacgaggactacgtacgtttcccgtagtaaaccgtgtagttcgtcggtcgccgccgccgacacggtctgtctacgtactgtcgtacaggactaggtcgggtcccnctagtcggcagggttcgtctactaacttctacgtacgtcggttgggaccgtcggtcggggaacacgggacccgtacggtcctaccgtccttccacacgttcccacncgtccgaccaccgacggccgacgtccgtccgtcccgtccgccgtccgtccg

SEQ ID NO: 326723 - DNA, 593 bp, Homo sapiens
  misc_feature: GZ8MTXP02F5N2U.44.53.E09.1.454.CMB.2.raw
  modified_base (358)..(358): a, c, t, g, unknown or other
  misc_feature (358)..(358): n is a, c, g, or t
  modified_base (429)..(429): a, c, t, g, unknown or other
  misc_feature (429)..(429): n is a, c, g, or t
  modified_base (581)..(581): a, c, t, g, unknown or other
  misc_feature (581)..(581): n is a, c, g, or t
tcagacagtatatacacgaccggtgctcgatttagagagagtgtgttgggtttgggggaagcacctgtggttcttcctcctgctggtggcggctcccagatgggtcctgtctcagccgcagctgcgggagtcgggcccaggactggtgaagccttcggagaccctgtccctcacgtgcacggtctctggtgcctccatcgacagaagtaatttctactgggctggatccgccagccccaggagaggggctgcagtggattgggagtctctattatagtgggaacacctactaccaacccgtcctacaacggtcgagtcaccatactccgtggacacgtcgaggacactagttttcccngaaacgtgagttctgtcggccgcgccgacacggctgtcctacgtactgtgtcagtacagttcggggtcccnccgtagtcggccagggttccgtctctaaacttctactacgtcgtttggggacttcgtcgggggaccaaggggaccacggtccgaccgtctaccgtcacttcctacacgccctaccgacctaacgggccctacgtccggttcccttcccccgnggcccgccctcg

SEQ ID NO: 326724 - DNA, 557 bp, Homo sapiens
  misc_feature: GZ8MTXP02GE3BR.44.53.E09.1.454.CMB.2.raw
  modified_base (224)..(224): a, c, t, g, unknown or other
  misc_feature (224)..(224): n is a, c, g, or t
  modified_base (284)..(284): a, c, t, g, unknown or other
  misc_feature (284)..(284): n is a, c, g, or t
  modified_base (542)..(542): a, c, t, g, unknown or other
  misc_feature (542)..(542): n is a, c, g, or t
tcagacagtatatacacgaccggtgctcgatttagagagagtgtgttgggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactgganccagcggtaatattcttagtcttaactttgtctctgtatcaacatcatccaaggtaaacncccccaaactcatcatctatgagcctaataagacgccctcgtagggtttctaatcgtacttccactcgcctacaagtccgacaccgaccgccctccctagaacaatctcgtcgggcctcccgaggctaggaggacgagctagtattattattgttgctcagtattgttcgtcgctatctaacttatgttcgttacggaagtcgggaaacctaacggtccaccgtcgtaaggtccaacgcccgaaacggcccaaacccnctacgtccacttccg

SEQ ID NO: 326725 - DNA, 552 bp, Homo sapiens
  misc_feature: GZ8MTXP02H8A4M.44.53.E09.1.454.CMB.2.raw
  modified_base (421)..(421): a, c, t, g, unknown or other
  misc_feature (421)..(421): n is a, c, g, or t
  modified_base (430)..(430): a, c, t, g, unknown or other
  misc_feature (430)..(430): n is a, c, g, or t
  modified_base (501)..(501): a, c, t, g, unknown or other
  misc_feature (501)..(501): n is a, c, g, or t
  modified_base (508)..(509): a, c, t, g, unknown or other
  misc_feature (508)..(509): n is a, c, g, or t
  modified_base (546)..(546): a, c, t, g, unknown or other
  misc_feature (546)..(546): n is a, c, g, or t
tcagacagtatatacacgaccggtgctcgatttagagagagtgtgttgggtttgggggaagcacctgtggttcttcctcctgctggtggcggctcccagatgggtcctgtctcagccgcagctgcgggagtcgggcccaggactggtgaagccttcggagaccctgtccctcacgtgcacggtctctggtgcctccatcgacagaagtaatttctactgggctggatccgccacgccccaggagagggctgcagtggattgggatctctatatagtaggaacacctactaacacccgtccctcaacgtcgacgtcaccatactccgtggacacgtcgaggaccactacgtttccctgaaacgtgagttctgtcggccgccgccgacacggctgtctactactgtgtcagacagtggtcccnctagtcggnagggtctctactaagttctactacgctttggggactcgtgggggaccaagggaccacggtcaccgtctccncactccnncgccaccacgacggccacgtccgtcctcccgcggccncctacg

SEQ ID NO: 326726 - DNA, 522 bp, Homo sapiens
  misc_feature: GZ8MTXP02JLUW0.44.53.E09.1.454.CMB.2.raw
  modified_base (189)..(189): a, c, t, g, unknown or other
  misc_feature (189)..(189): n is a, c, g, or t
  modified_base (402)..(402): a, c, t, g, unknown or other
  misc_feature (402)..(402): n is a, c, g, or t
tcagacagtatatacacgaccggtgctcgatttagagagagtgtgttgggtttggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactggagccagcggtaatattcttagtcttaactttgtctcctggtatcaacatcatccaggtaaacgcccccaaatcatcatctatgaggcctataagagccctgaggggtttctaatcgcttccactgcctcaagtccgcacacggcctcctgacaatctcgtcgggctccaggctggagacgngctgattattattgtgctcagtattgttcgcgctatctactttatgttcgtacggtaacgtgggaaccaaaggtccaacgtcctacggtcacgcccgaaggcccaacccatcgtcactcc

SEQ ID NO: 326727 - DNA, 811 bp, Homo sapiens
  misc_feature: GZ8MTXP02GESI0.44.53.E09.1.454.CMB.2.raw
tcagacagtatatacacgaccggtgctcgatttagagagagtgtgttgggtttgggggaagcacctgtggttcttcctcctgctggtggcggctcccagatgggtcctgtctcagccgcagctgcgggagtcgggcccaggactggtgaagccttcggagaccctgtccctcacgtgcacggtctctggtcgcctccatcgacagaagtattctacgtgggctggactccgccacgccccgaggaggagggctgcgtaggtggtagttgggacgtcttactaagttagtaaggtacgggaaacctaccctaaccgtaacccgtaaacccccgtccccgtacgaaccggtcgaacggtacccaaccgtaataccgtacccggtaggaacccgtaaccgggttacggaacggtaacctacgttacgtttttacccgaaggtaaacgtcggtacgtttcgtacggtccggacccgtccgccgtacgacgtcgtacgttcctacgtactgtactacgacgtactacggtccgggtcccgcgttagtcggccgttaggttccgttactacgttaactttaccgtacgttaccgtacgggttaaccggggtccgtaccgggtaccgggggaaccctaaacgggggtaccccgtacggggttacccctacccgggtccttaaccccggtctaacccgttcccgtaccgtaaccgtaccccctacccggtaaaaccccgggaacccggggtccccttaaccggttcccccgggttacccccgtttccccggacccgggtccccgtcccccgttacccgg

SEQ ID NO: 326728 - DNA, 560 bp, Homo sapiens
  misc_feature: GZ8MTXP02FIN2B.44.53.E09.1.454.CMB.2.raw
  modified_base (409)..(409): a, c, t, g, unknown or other
  misc_feature (409)..(409): n is a, c, g, or t
  modified_base (423)..(423): a, c, t, g, unknown or other
  misc_feature (423)..(423): n is a, c, g, or t
  modified_base (433)..(433): a, c, t, g, unknown or other
  misc_feature (433)..(433): n is a, c, g, or t
  modified_base (447)..(447): a, c, t, g, unknown or other
  misc_feature (447)..(447): n is a, c, g, or t
tcagacagtatatacacgaccggtgctcgatttagagagagtgtgttgagctctgggagaggagccccagccttgggattcccaggtgttttcattcagtgatcaggactgaacacagaggactcaccatggagtttgggctgagctggattttccttgctgctatttaaaaggtgtccagtgtgaggtgcagttggtggagtcgtgggggaggtttggtaaagccgtggggagtcccttagactctcctgtgcagcctctggattcactttcagtaacgcctggatgacctgggtccgcaggctccgagggaggggctggagtgggttggccgtattagaaccaaagctggacggtgggacagcagactacgctgcacccgtgaaacgcagattcaccatctcaaganatgattacaaaagntacggtgtcnctgcagatacgaancgcctgaaaccaccggaaggacacgacgcccgttactaattacctggttctggggtactgggtttaccaagttcggggacccacgggggaacccctgggtaccacccggttcc

SEQ ID NO: 326729 - DNA, 589 bp, Homo sapiens
  misc_feature: GZ8MTXP02JY8WG.44.53.E09.1.454.CMB.2.raw
  modified_base (225)..(225): a, c, t, g, unknown or other
  misc_feature (225)..(225): n is a, c, g, or t
  modified_base (237)..(237): a, c, t, g, unknown or other
  misc_feature (237)..(237): n is a, c, g, or t
tcagacagtatatacacgaccggtgctcgatttagagagagtgtgttggggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactgganccagcggtaatnttcttagtcttaacttgtctctggtatcaacatcatccaaggtaaacgcccccaaactcatcatctatgaggcctaataacgacgccctcgtaggggtttctaatcgtcttccactcgcctacaacgtcccggacaccgaccggccctcctagacaatctcgtcggtcctaccgagggctaggaacggacggaggtctagtaatttattactttgttgtctactagtagtcggtttcgtcgctactctaacttattcgtcgttacggtaaggtacgggacctaaggtacctaccggtccgtacggtccacggcccgaaacggaccccaaccccacgtcgtacctacttcccg

SEQ ID NO: 326730 - DNA, 615 bp, Homo sapiens
  misc_feature: GZ8MTXP02HU7G1.44.53.E09.1.454.CMB.2.raw
  modified_base (261)..(261): a, c, t, g, unknown or other
  misc_feature (261)..(261): n is a, c, g, or t
  modified_base (408)..(408): a, c, t, g, unknown or other
  misc_feature (408)..(408): n is a, c, g, or t
  modified_base (454)..(454): a, c, t, g, unknown or other
  misc_feature (454)..(454): n is a, c, g, or t
tcagacagtatatacacgaccggtgctcgatttagagagagtgtgttgagctctgggagaggagccccagccttgggattcccaggtgttttcattcagtgatcaggactgaacacagaggactcaccatggagtttgggctgagctggattttccttgctgctattttaaaaggtgtccagtgtgaggtgcagttggtggagtcgtgggggtaggtttggtaaagccgtggggatcccttagactctcctgtgcagcctntggattcacttcagtaacgcctggatgaccgtgggtccgccgaggcctccggaggggaagggcgtgggaggtggggttcggcgttaattacgaaaccgaaagtccgtggacggtggacagacagactacgctcgctaccgagaacgnagatccactatactacaagagatagaattacgaaaagtctacggtntactcgtagacgtagatacgaacagaccgtaagaaccgacggaacgacgaacgacggtaccttattacgttaacgtggttaccggtaggggttacttcggtttactaacgggttccgggaccgtaaccggggaacccgttcggtacccgtaccggttcccc

SEQ ID NO: 326731 - DNA, 579 bp, Homo sapiens
  misc_feature: GZ8MTXP02F0TY9.44.53.E09.1.454.CMB.2.raw
  modified_base (299)..(299): a, c, t, g, unknown or other
  misc_feature (299)..(299): n is a, c, g, or t
  modified_base (430)..(430): a, c, t, g, unknown or other
  misc_feature (430)..(430): n is a, c, g, or t
  modified_base (438)..(438): a, c, t, g, unknown or other
  misc_feature (438)..(438): n is a, c, g, or t
tcagacagtatatacacgaccggtgctcgatttagagagagtgtgttgagctctgggagaggagccccagccttgggattcccaggtgttttcattcagtgatcaggactgaacacagaggactcaccatggagtttgggctgagctggattttccttgctgctatttaaaggtgtccagtgtgaggtgcagttggtggagtcgtgggggaggtttggtaaagccgtggggagtcccttagactctcctgtgcagcctctggattcactttcagtaacgcctggatgacctgggtcccnccaggcctccgaggggaggggctggagtgggtgccgtattagaaaccaaagctagacggtgggacagcagactacgctcgcacccggtagaaagcagattcaccatcacaaagagatgaattacaaaagtntaacggtntctctgcagatagaaacacgcctagaaccaccggagacacgacgccgtactaattacgtcgttcgtaggggtactttggggtttacaacggtttccggggaccgtaacggggtaacccgttcgggtccctaccggttcccg

SEQ ID NO: 326732 - DNA, 569 bp, Homo sapiens
  misc_feature: GZ8MTXP02HCCJW.44.53.E09.1.454.CMB.2.raw
  modified_base (178)..(178): a, c, t, g, unknown or other
  misc_feature (178)..(178): n is a, c, g, or t
  modified_base (303)..(303): a, c, t, g, unknown or other
  misc_feature (303)..(303): n is a, c, g, or t
  modified_base (408)..(408): a, c, t, g, unknown or other
  misc_feature (408)..(408): n is a, c, g, or t
  modified_base (410)..(410): a, c, t, g, unknown or other
  misc_feature (410)..(410): n is a, c, g, or t
  modified_base (431)..(431): a, c, t, g, unknown or other
  misc_feature (431)..(431): n is a, c, g, or t
  modified_base (435)..(435): a, c, t, g, unknown or other
  misc_feature (435)..(435): n is a, c, g, or t
  modified_base (442)..(442): a, c, t, g, unknown or other
  misc_feature (442)..(442): n is a, c, g, or t
tcagacagtatatacacgaccggtgctcgatttagagagagtgtgttgagctctgggagaggagccccagccttgggattcccaggtgttttcattcagtgatcaggactgaacacagaggactcaccatggagtttgggctgagctggattttccttgctgactaattttaaaaggngtccagtgtgaggtgcagttggtggagtcgtgggggtaggtttggtaaagccgtggggattcccttagcttctcctgtgcagcctcgtggattcactttcagtaacgcctggatgaccgtggccncgaggctccgagggaggctggagtgggttgcgtataagaaccaaagctggaggtcggacagcagactagctgaccaccgtgaaagcagatcaccatcgacaagananagaattacaaaaagctaggtntctngacaganagaacacgtaccgaacgaaccgaacgaagacctaacgacgtacctacttagttactggtacgtagggtacttcggtttacaacggttcccggaacgtaccggtaaccgtcggtacccgtaccgtccg

SEQ ID NO: 326733 - DNA, 609 bp, Homo sapiens
  misc_feature: GZ8MTXP02FVJDK.44.53.E09.1.454.CMB.2.raw
  modified_base (262)..(262): a, c, t, g, unknown or other
  misc_feature (262)..(262): n is a, c, g, or t
  modified_base (300)..(300): a, c, t, g, unknown or other
  misc_feature (300)..(300): n is a, c, g, or t
  modified_base (322)..(322): a, c, t, g, unknown or other
  misc_feature (322)..(322): n is a, c, g, or t
tcagacagtatatacacgaccggtgctcgatttagagagagtgtgttgagctctgggagaggagccccagccttgggattcccaggtgttttcattcagtgatcaggactgaacacagaggactcaccatggagtttgggctgagctggattttccttgctgctaattttaaaaggtgtccagtgtgaggtgcagttggtggagtcgtgggggaggtttggtaaagccgtggggagtccctagactctcctgtgcagcctcnggattcactttcagtaacgcctggatgacctgggtccncaggctccgagggagggctggngtgggttggccgtagttaagaaaccaaagctaggacggtagggacagcagactagctgcaccgtgaaacggcaagacttcacccatctacaaagagaatagaattacaaaaagtagtaacggtgttactctgacagaataggaaacagcctaaggaaaccaacggacggaacacgacgtacccgtcgttaattaacctggttccgtacggggtaattgggttttaccgaaggtttcccggggacgtaaccgggggtaaccccttcggggtaccccaccggtttcccc

SEQ ID NO: 326734 - DNA, 645 bp, Homo sapiens
  misc_feature: GZ8MTXP02HU0RS.44.53.E09.1.454.CMB.2.raw
  modified_base (225)..(225): a, c, t, g, unknown or other
  misc_feature (225)..(225): n is a, c, g, or t
  modified_base (236)..(236): a, c, t, g, unknown or other
  misc_feature (236)..(236): n is a, c, g, or t
  modified_base (459)..(459): a, c, t, g, unknown or other
  misc_feature (459)..(459): n is a, c, g, or t
tcagacagtatatacacgaccggtgctcgatttagagagagtgtgttggggtttgggggggtcacaagaggcagcgctctcgggacgtctccaccatggcctgggctctgctgctcctcactcctcctcacccaggacacagggtcctgggcccagtctgccctgactcagcctgcctccgtgtctgggtcgcctggacagtcggtcaccatctctgcactgganccagcgtaatnttcttagtcttaacttgtctcctgtatcaacatcataccaaggtaaaccgacccccaaactcatcatctatgacgtcctaataacgacgtccctgtacggggtttactaatcgtcttccactcgccctacgaacgtccggacaccgacgtccctcctacgacaactctcgtcgtctccgagcgtggagacgagctagatttatatttgttagcttcgtaagtnttaggttcgtccgtactacttcctattttacgtcgtttacggtttaacggtaaacgggttaccggggtaaacctaaacgggtacccgttaaacccggttacccgtaacggttacccgaaccggtaacccgtaaaacccgggaaccccctaaacccccgacgtttaccgtaccgttacctttccccg

SEQ ID NO: 326735 - DNA, 583 bp, Homo sapiens
  misc_feature: GZ8MTXP02JR137.44.53.E09.1.454.CMB.2.raw
  modified_base (246)..(246): a, c, t, g, unknown or other
  misc_feature (246)..(246): n is a, c, g, or t
  modified_base (308)..(308): a, c, t, g, unknown or other
  misc_feature (308)..(308): n is a, c, g, or t
  modified_base (322)..(322): a, c, t, g, unknown or other
  misc_feature (322)..(322): n is a, c, g, or t
  modified_base (378)..(378): a, c, t, g, unknown or other
  misc_feature (378)..(378): n is a, c, g, or t
  modified_base (431)..(431): a, c, t, g, unknown or other
  misc_feature (431)..(431): n is a, c, g, or t
tcagacagtatatacacgaccggtgctcgatttagagagagtgtgttgggtttggggggaagcacctgtggttcttcctcctgctggtggcggctcccagatgggtcctgtctcagccgcagctgcgggagtcgggcccaggactggtgaagccttcggagaccctgtcccctcacgtgcacggtctctggtgcctccatcgacagaagtaatttctactggggctggatccgccagccccagganaggggctgcagtggattgggagtctctattatagtgggaacacctactacaacccgtccctnaacggtcagtcacntatccgtggacacgtcgaggacacagttttcccctgaaaagtgagttctgtggccncgccgacacggctgtctctactgtgtcagacatggtaccgccctaatggacgngtcgtctactaatttactacgtacgtcgttacggggacgtcgtggggaccgaaacgggaccacggtccaccgtctcctcactcctacgacgccctacccaaccgaaacgggcccgtacgtccggttccttcccccgtcggcccgacccgtcg

SEQ ID NO: 326736 - DNA, 639 bp, Homo sapiens
  misc_feature: GZ8MTXP02IUY36.44.53.E09.1.454.CMB.2.raw
  modified_base (434)..(434): a, c, t, g, unknown or other
  misc_feature (434)..(434): n is a, c, g, or t
tcagacagtatatacacgaccggtgctcgatttagagagagtgtgttgggtttgggggaagcacctgtggttcttcctcctgctggtggcggctcccagatgggtcctgtctcagccgcagctgcgggagtcgggcccaggactggtgaagccttcggagaccctgtccctcacgtgcacggtctctggtgcctccatcgacagaagttaatttctacgtggggctggatccgccacgccccgaggaggaggggctgcaggtggagttgggatctctattatagtggaacacctactaccaaccccgtcctacgaacggtcgagtcacatactccgtggacacgtcgagacactacgtttccagaagtgagttctgtcgccgccgccgacgacggcttcgtcctactacgtgtcgtcaagacagtcgggtcccnccgttagtcggcgtaggtccgtactactaaatttcctaacgttacgcgtttcgggggaccttcgggtcggggaccgtaaaggggccctaccgggtacctacccgtccttccctcgtacctcccgtacaccggtcccctacccgacccgaaaccgggtcccctacggttcccggtaccccttcccccggcggccccgtcccgttcg

SEQ ID NO: 326737 - DNA, 637 bp, Homo sapiens
  misc_feature: GZ8MTXP02G5X7P.44.53.E09.1.454.CMB.2.raw
  modified_base (339)..(339): a, c, t, g, unknown or other
  misc_feature (339)..(339): n is a, c, g, or t
  modified_base (386)..(386): a, c, t, g, unknown or other
  misc_feature (386)..(386): n is a, c, g, or t
  modified_base (424)..(424): a, c, t, g, unknown or other
  misc_feature (424)..(424): n is a, c, g, or t
  modified_base (448)..(448): a, c, t, g, unknown or other
  misc_feature (448)..(448): n is a, c, g, or t
tcagacagtatatacacgaccggtgctcgatttagagagagtgtgttgggtttggggggaagcacctgtggttcttcctcctgctggtggcggctcccagatgggtcctgtctcagccgcagctgcgggagtcgggcccaggactggtgaagccttcggagaccctgtccctcacgtgcacggtctctggtgcctcatcgacagaagtatttctacgtggggctggactccgccacggcccccgagggacggaggggctgcaggtggtagttgggatcgtctattagtagtgggaacacctactaccaaccccgtcctacacggtcgacgtcacatacnccggtgacacgcgaggacacgtacgtttccagaaacgtgtagttcgngtcggccgccgccgacgacggctcgtactactactgtntcaagaactggtccggggttcccnccgtttagcggtacgtacggttcgtactacttaaatttccaacgttacgtcgttacgggggaccgtcggtacgggggaccgaaacggggacccctacgggtacccgtaccctccgttcctacaccgttcccacgacgtcccaccaaccggacggccctacggtccgtccctcccgtggccccgctccgg

SEQ ID NO: 326738 - DNA, 725 bp, Homo sapiens
  misc_feature: GZ8MTXP02JS5HI.44.53.E09.1.454.CMB.2.raw
  modified_base (180)..(180): a, c, t, g, unknown or other
  misc_feature (180)..(180): n is a, c, g, or t
  modified_base (306)..(306): a, c, t, g, unknown or other
  misc_feature (306)..(306): n is a, c, g, or t
  modified_base (409)..(409): a, c, t, g, unknown or other
  misc_feature (409)..(409): n is a, c, g, or t
tcagacagtatatacacgaccggtgctcgatttagagagagtgtgttgagctctgggagaggagccccagccttgggattcccaggtgttttcattcagtgatcaggactgaacacagaggactcaccatggagtttgggctgagctggtattttccttgctgtcttaattttaaaaggngtccagtgtgaggtgctaggttggtggagtcgtgggggtaggtttaggtaagccgtggggactccttagctctcctgtgcagcctctggattcactttcagtaacgctggatcgaccgtgggtccncgacggcctaccggaggggacgggcgtgggtaggttggggttcggaccgtaagttaacgaaaccctaaaggtcgtaggacgggtcggacagacagacctacgntcgaccaccggtagaaacggcagtacttaccgacctataccgtaacgaaagtacgaaagtacgtaaacttaaacggaaaacgtacgttaccggttacgttacctcgtacgaccgaagtaacgtacgggaaaaccacggtacccgtaaggaaaaccccggaccggaacgggaacccaaccgaacggttacccgttacttaaccgtttaagtcggttaccgggttagggttaacgtttcgggtttaccgtaacgggtttaccccggggtaccggtaaaccgggtacccgttaccggttacccggtacccgtttccccg

SEQ ID NO: 326739 - DNA, 743 bp, Homo sapiens
  misc_feature: GZ8MTXP02IJD7T.44.53.E09.1.454.CMB.2.raw
  modified_base (179)..(179): a, c, t, g, unknown or other
  misc_feature (179)..(179): n is a, c, g, or t
  modified_base (286)..(286): a, c, t, g, unknown or other
  misc_feature (286)..(286): n is a, c, g, or t
  modified_base (454)..(454): a, c, t, g, unknown or other
  misc_feature (454)..(454): n is a, c, g, or t
tcagacagtatatacacgaccggtgctcgatttagagagagtgtgttgagctctgggagaggagccccagccttgggattcccaggtgttttcattcagtgatcaggactgaacacagaggactcaccatggagtttgggctgagctggattttccttgctgcttaattttaaaaggtntccagtgtgaggtgcagttggtggagtcgtgggggaggtttggtaaagccgtggggactcccttagactctcctgtgcagcctctggattctactttcacgttaacnccgtggatcgaccgtgggtcccgcgaggcctaccggaggggaagggcgtggaggttggggtcgtaccgttaattaacggaaaccgtaaagcgtacggacgggtacggacagcaaggactacggctcggacacccggtagaaacggcagtacttccgaacataccgtanaaacgtaagattaacgtaattaaaccgaaaaagtacgttaacgggtcgttacttaccggttagaccgttaaaggaacgttacgggaaaacctacgggacccttaaacgggaaaacccgaacccgggaaaggaacccaaacggtaacccggtacccggttaactttaaccgttaccgtacgggttaccgttacgggggtacttttacgggttaccgttaacgggttaccgggtacccggggtaaaccgggttaacccggttcggttaaccccgttaacccggtttccccg

SEQ ID NO: 326740 - DNA, 578 bp, Homo sapiens
  misc_feature: GZ8MTXP02GWJG5.44.53.E09.1.454.CMB.2.raw
  modified_base (225)..(225): a, c, t, g, unknown or other
  misc_feature (225)..(225): n is a, c, g, or t
tcagacagtatatacacgaccggtgctcgatttagagagagtgtgttgggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcacgtgganccaggcggtaaatatttcttagttcttaactttgtctcctggtatcacatcatcaagtaacgccccaactcatcatctatgacggtcctaataagacgccctacgtaggggtttactaagtcgtcttccactcgccctacgaacgtccggacaccgaccggtccctcctagacaatctcgtcgggctcccgaggcgtggacgggacgaggctagtactttacgactgcacgtctactattacgaacgaacgacacgacacgtacccttacctagttcgtacgttacggaacgtcggaaccgacgtcccgacgtctacggaacacgacccgacgacccaacccgtctacgtccc

SEQ ID NO: 326741 - DNA, 613 bp, Homo sapiens
  misc_feature: GZ8MTXP02FKV5H.44.53.E09.1.454.CMB.2.raw
tcagacagtatatacacgaccggtgctcgatttagagagagtgtgttgggtttgggggaagcacctgtggttcttcctcctgctggtggcggctcccagatgggtcctgtctcagccgcagctgcgggagtcgggcccaggactggtgaagccttcggagaccctgtccctcacgtgcacggtctcgtggtgcctccatcgacagaagttaatttctacgtggggctggactccgccacgcccccgaggaggaggggctgcaggtggagttgggagtctctattatagtgggaacacctactaccaaccccgtccctacaacggtcgacgtccacctatactccgtggacacgtcgagacacgtagtttcctagaaacgtgagttctcggtcggcccgccgccgacgaccggtctacgtccttactacgtggttgtcgagactagtcgggtcccgccgtagtcgcgtacgtcgtctactaattctacgtacgcgttgggacgtcgtggggaccaaggggacccacggtcctaccggtctccgtactactccgtcaccgtccctaccgaccgaaccggccctacgttccgtccctccccgtcggcccgtcctcg

SEQ ID NO: 326742 - DNA, 622 bp, Homo sapiens
  misc_feature: GZ8MTXP02IO9QR.44.53.E09.1.454.CMB.2.raw
  modified_base (446)..(446): a, c, t, g, unknown or other
  misc_feature (446)..(446): n is a, c, g, or t
  modified_base (556)..(556): a, c, t, g, unknown or other
  misc_feature (556)..(556): n is a, c, g, or t
tcagacagtatatacacgaccggtgctcgatttagagagagtgtgttgggtttggggggaagcacctgtggttcttcctcctgctggtggcggctcccagatgggtcctgtctcagccgcagctgcgggagtcgggcccaggactggtgaagccttcggagaccctgtccctcacgtgcacggtctctggtgcctccatcgacagaagtaatttctacgtgggggctgggactccgccacgcccccgagggaggaggggctgcgaggtggagttgggagtctctatatagtggaacacctactacaacccgtccctacacggtcagtcaccatactcgtgacacgtcgaggacactagtttccagtaacgtgtagttctggtcgcccgccgccgacacggcctcgtctactactgtcgtcagaactggtcgggtcccgtcttacgnggccgtacgggtcgtctacgtaacttccgtaacgttcggacctttggggaccgttcggtcgggggaaccgtacggggaccacgggtaccgtacctcgtcctactctcccnctacgccctacccaccgaacggcccctacgtccggttccccgttcccgacggccccgtcccgtccg

SEQ ID NO: 326743 - DNA, 669 bp, Homo sapiens
  misc_feature: GZ8MTXP02HI7PG.44.53.E09.1.454.CMB.2.raw
tcagacagtatatacacgaccggtgctcgatttagagagagtgtgttgggtttgggggaagcacctgtggttcttcctcctgctggtggcggctcccagatgggtcctgtctcagccgcagctgcgggagtcgggcccaggactggtgaagccttcggagaccctgtccctcacgtgcacggtctctggtgcctccatcgacagaagtaatttctacgtggggctggatccgccacgccccgaggaggagggctgcaggtggagttgggatctctattagtagtagggaacacctactacaaccccgtcctacgacggtcagtcacatactcgtgacacgtcgagacactcgtttccagaacgtgattctgtggcccgccgccgacacggtctacgtccttaactactgtctacaacgtacaggtccggggttccctcgtaggttcgggcgttagggtccgttactacgtactttacctacgttaacgcgtttacggggacctcggtacgggggaccgaaacggggtacccaccgggttaccacccggttcccttacccgtcctaaacgtttcccgaccaaccgttcccccaccgtaaccccggaaacgggtcccccaacggttcccccggttaccccttcccccgttcggccccgttaccccgtccgg

SEQ ID NO: 326744 - DNA, 600 bp, Homo sapiens
  misc_feature: GZ8MTXP02F613M.44.53.E09.1.454.CMB.2.raw
  modified_base (269)..(269): a, c, t, g, unknown or other
  misc_feature (269)..(269): n is a, c, g, or t
  modified_base (274)..(274): a, c, t, g, unknown or other
  misc_feature (274)..(274): n is a, c, g, or t
  modified_base (408)..(408): a, c, t, g, unknown or other
  misc_feature (408)..(408): n is a, c, g, or t
tcagacagtatatacacgaccggtgctcgatttagagagagtgtgttgggtttgggggaagcacctgtggttcttcctcctgctggtggcggctcccagatgggtcctgtctcagccgcagctgcgggagtcgggcccaggactggtgaagccttcggagaccctgtccctcacgtgcacggtctctggtgcctccatcgacagaagtaatttctactggggctggatccgccagccccaggagaggggctgcagtggattgggatctntatanagtgggaacacctactacaacccgtccctacaacggtcgagtcaaccatatccgtggacacgtcgaggacacagtttcccagaaagtgtattctgtcggcccgcgccgacacgggctgtcctaactactgtgtnagacagtcgggtccgctagtggacagggtctctactaaatttctaacgtacgtcgtttaggggaaccgttcgtacgggggacccaaaggggaccaacgggtccaaccgtctcctcactcctcacgccctaccaaccgaaacgggccccaaacgttcccggtccctttccccccggtcggacccgtcccgtcg

SEQ ID NO: 326745 - DNA, 815 bp, Homo sapiens
  misc_feature: GZ8MTXP02H0Q2I.44.53.E09.1.454.CMB.2.raw
tcagacagtatatacacgaccggtgctcgatttagagagagtgtgttgagctctgggagaggagcccccagccttgggattcccaggtgttttcattcagtgatcaggactgaacacagaggactcaccatggagtttgggctgagctggtattttccttgctgcttaattttaaaaggtgtccagttgtgaggtgctaggttggtggaggttcggtggggggtaggtttagggtaaaggtccggtgggggacgttccccttaaggaccttccgttcctggtcgcacgtccttcgtggtacttctactttcaacgtaaccgcctaggactcgaccgtcgggtcccgccgaggcccgtaccgggaggggaacggggcttagggagggtttcggggttacggtacccggtttaagttaaacggaaacccgtaaaaggtccgtaggggtaacggggtcgggaacgaggaccgtaaggactaaccggtccgtcggacccgtaaacccgggtaaaggaaaacgggtccaacggttaacttacccaaacctacgttaccctaacgaaaaggtaacgaagttaaccgtaaagtttaaaacgaaaaacggtacggtttaacggtcgttaccgttcgtacggacgaagtacgtaaacggaaccgaacggtaccctaaacggaaacccgaaaccgggaacggaacctaaacgtacccggtacttacggttaactttaccggtggtacggttagggtacgtttcggttaccgtaacgggttccgggaaccggtaccgggtacccggttcgtacctaccggtttccc

SEQ ID NO: 326746 - DNA, 603 bp, Homo sapiens
  misc_feature: GZ8MTXP02I8TGY.44.53.E09.1.454.CMB.2.raw
  modified_base (357)..(357): a, c, t, g, unknown or other
  misc_feature (357)..(357): n is a, c, g, or t
  modified_base (537)..(537): a, c, t, g, unknown or other
  misc_feature (537)..(537): n is a, c, g, or t
tcagacagtatatacacgaccggtgctcgatttagagagagtgtgttgggtttgggggaagcacctgtggttcttcctcctgctggtggcggctcccagatgggtcctgtctcagccgcagctgcgggagtcgggcccaggactggtgaagccttcggagaccctgtccctcacgtgcacggtctctggtgcctccatcgacagaagtaatttctactgggctggatccgccagccccaggagagggctgcagtggattgggagtctctattagtaggtgggaacacctactaccaaccccgtccctacaacggtcagtcacatactccgtggacacgtcgagacactagtttcccngaaacgtgacgttctgtcggcccgccgccgtacgacggctgtctactactgtcgtcgagacgagtcgggtcccgtctagtggcagggtccgtctacgtaattcgtaactacgtcgtttggggaccgtcgtggggaccgtaacggggaccacgggtccaccgttctcctcacttccctacncgccctacccgaccgtaaacgggccccaacgttccggtcccttcccccgtcggcccgtaccctccg

SEQ ID NO: 326747 - DNA, 681 bp, Homo sapiens
  misc_feature: GZ8MTXP02JMSL0.44.53.E09.1.454.CMB.2.raw
  modified_base (257)..(257): a, c, t, g, unknown or other
  misc_feature (257)..(257): n is a, c, g, or t
  modified_base (301)..(301): a, c, t, g, unknown or other
  misc_feature (301)..(301): n is a, c, g, or t
tcagacagtatatacacgaccggtgctcgatttagagagagtgtgttgagctctgggagaggagccccagccttgggattcccaggtgttttcattcagtgatcaggactgaacacagaggactcaccatggagtttgggctgagctggattttcctgctgtctattttaaaaggtgtccagtgtgaggtgctagttggtggagtcgtgggggaggtttggtaaagccgtggggagtcccttagactctcctgtgcngcctcgtggattcacttcagtaacgcctggatgacctgggtccncgaggctccgagggaggggctggaggtgggtggccgtagtagaaacaaagctggacggtggacagcgaagactacgctcggcaaccccggtaggaaaacgcagtaacttccaaacctatacctacgaaaaggataaacgtagtaacttaaacgaaaaagtacgttaaacgggtcgttaaccgtcttacggaccaagtaacttacgggaaaactacggacccttaggaaaacccaaccgggagaaccaaccgaacggaccccgtttagtaaccgtttacctaaggttcggttaggggtaacgtttcggtttaacggaacggtttcccggggaaccgtaaacgggggcccccttcgggggttaccccacccgggtttccccg

SEQ ID NO: 326748 - DNA, 650 bp, Homo sapiens
  misc_feature: GZ8MTXP02IQRPZ.44.53.E09.1.454.CMB.2.raw
  modified_base (300)..(300): a, c, t, g, unknown or other
  misc_feature (300)..(300): n is a, c, g, or t
  modified_base (456)..(456): a, c, t, g, unknown or other
  misc_feature (456)..(456): n is a, c, g, or t
  modified_base (517)..(517): a, c, t, g, unknown or other
  misc_feature (517)..(517): n is a, c, g, or t
tcagacagtatatacacgaccggtgctcgatttagagagagtgtgttgagctctgggagaggagccccagccttgggattcccaggtgttttcattcagtgatcaggactgaacacagaggactcaccatggagtttgggctgagctggattttcctgctgctattttaaaaggtgtccagtgtgaggtgcagttggtggagtcgtgggggaggtttggtaaagccgtggggatcccttagactctcctgtgcagcctctggattcactttcagtaacgcctggatcgaccgtgggtccnccgaggcctaccggaaggggaacggggtcgtaggggaggttggggttcggacccggttaagttaacggaaacccgaaagcgtagggacggtggggacaggcaagactacgctcggccacccggtagaaacggcagtacttcacctatctacaaganatagtaacttaacaaaacggtagtacggtacgtctacgttggactaagagttacggaaacncggacccgtaagaaaccgaccggaagaaccacgacgtccgtattacttaccgtggtacgttacggggtatttcggttactaacggttcccgggaacgtaccgggtaacccttcggtacccttacccgttcccg

SEQ ID NO: 326749 - DNA, 655 bp, Homo sapiens
  misc_feature: GZ8MTXP02IB56J.44.53.E09.1.454.CMB.2.raw
  modified_base (305)..(305): a, c, t, g, unknown or other
  misc_feature (305)..(305): n is a, c, g, or t
  modified_base (427)..(427): a, c, t, g, unknown or other
  misc_feature (427)..(427): n is a, c, g, or t
tcagacagtatatacacgaccggtgctcgatttagagagagtgtgttgagctctgggagaggagccccagccttgggattcccaggtgttttcattcagtgatcaggactgaacacagaggactcaccatggagtttgggctgagctggattttccttgctgctattttaaaaggtgtccagtgtgaggtgcaggttggtggagtcgtgggggaggttttaggaaagccgtggggacgtcccttagactctctgtgcagcctctggattcactttcagtaacgcctggatcgaccgtgggtcccnccaggcctccgagggagggctggagtggggtgaccgttatacgaaaccaaagcgtagacggtggacagcagactacgcgtgccaccggtagaaacggtcagtacttccaactatctacaagngaattgaattaacaaaaggtctaagggtctactcgtcgacgaatacgtagaaaaccgcgtaccctaaggaaaccgaccggaaaggtaaccacgaacgtacccggttattaaacctttacgttacggtacggttagggtacgtttccgggtttcaaaaccggtttccccgggggtaacccgtaaaacgggggtaaccccctttcgggtacccctaaccccggtttcccg

SEQ ID NO: 326750 - DNA, 638 bp, Homo sapiens
  misc_feature: GZ8MTXP02FG7NS.44.53.E09.1.454.CMB.2.raw
  modified_base (427)..(427): a, c, t, g, unknown or other
  misc_feature (427)..(427): n is a, c, g, or t
tcagacagtatatacacgaccggtgctcgatttagagagagtgtgttgggtttggggggaagcacctgtggttcttcctcctgctggtggcggctcccagatgggtcctgtctcagccgcagctgcgggagtcgggcccaggactggtgaagccttcggagaccctgtcccctcacgtgcacggtctctggtgcctccatcgacagaagtaattctacgtgggctggactccgccacgccccgaggagagggctgcaggtggagttgggagtctctattatagtgggaaccacctactaccaaccccgtcctacgaacggtcgagtccaaccatactccgtggacacgtacgaggacacgtacgttttcccagaaagtgtagttctggtcgcccgccgccgacgacggctgtactactactgtcgtnagacagtcgggtccctccgtagtcggcgtaggtcgtctacgtaacttctactacgtcgtttaggggacgtcggtacggggaccaacggggtaccacgggtcctaccgtcctacctacacttcccgtacacccgtacccgtacccgaaccgtaaccggggaaaccctcggttcccgggttccccttcccccgtacggccccgtcccgtccgg

SEQ ID NO: 326751 - DNA, 617 bp, Homo sapiens
  misc_feature: GZ8MTXP02G6J0S.44.53.E09.1.454.CMB.2.raw
  modified_base (367)..(367): a, c, t, g, unknown or other
  misc_feature (367)..(367): n is a, c, g, or t
  modified_base (442)..(442): a, c, t, g, unknown or other
  misc_feature (442)..(442): n is a, c, g, or t
  modified_base (542)..(542): a, c, t, g, unknown or other
  misc_feature (542)..(542): n is a, c, g, or t
tcagacagtatatacacgaccggtgctcgatttagagagagtgtgttgggtttgggggaagcacctgtggttcttcctcctgctggtggcggctcccagatgggtcctgtctcagccgcagctgcgggagtcgggcccaggactggtgaagccttcggagaccctgtccctcacgtgcacggtctctggtgcctccatcgacagaagtatttctactgggctggatccgccagccccaggagaggggctgcagtggattgggagtctctattatagtgggaacacctactaccaacccgtccctcaacggtcgagtcaccatatccgtcggacacgtcgaggacaacagtttccctgaaacgtgatntgtgcccgacgcccgacacgggtctgtcttactactgtcgtcagacagtcgggttcccgacctatgggcagggtntccgttactattcctacttaccgtcgttcgggactcggttaggggccgtacgggaccgacccggttctacccggtccttcctccggtactacccttcccnccgtcccgacccctaccggaaccggtaacccgtacgtcccggtttcccgtcccccgttccggccccgccgtccgg

SEQ ID NO: 326752 - DNA, 695 bp, Homo sapiens
  misc_feature: GZ8MTXP02HTK9K.44.53.E09.1.454.CMB.2.raw
  modified_base (459)..(459): a, c, t, g, unknown or other
  misc_feature (459)..(459): n is a, c, g, or t
tcagacagtatatacacgaccggtgctcgatttagagagagtgtgttgagctctgggagaggagccccagccttgggattcccaggtgttttcattcagtgatcaggactgaacacagaggactcaccatggagtttgggctgagctggattttcctgctgcttattttaaaaggtgtccagtgtgaggtgctaggttggtggagtcggtgggggtaggtttaggtaaagccgtggggactcccgttagactctcctgtgcagcctcgtggacttctactttcgacgtaaccgccgtggatcgaccgtcgggtcccgccgaggtccgtaccggaggggaacggggcgtgggaggttggggttcggacccgttaattaacgaaaccgaaaggcgtaggacggtaggacagcaagctacgctcgacaccgtagaaacgcagacttaccactatcacaaagngatagaacttaacgaaaagtcgtacggtgtacctcgtagacgtaaggtaactaacggaaacgtaacgaccgtaaacgaaaccgtaccggaaacggaaaccaacgtaccggtacccttaacgtttaacttaccgttagggttaccggttagggttaaacgtttccgggtttacgaaccgggtttcggggaacccgttaaccggggtaaaccttcggggtaaccctacccggtttccc

SEQ ID NO: 326753 - DNA, 636 bp, Homo sapiens
  misc_feature: GZ8MTXP02FM715.44.53.E09.1.454.CMB.2.raw
  modified_base (259)..(259): a, c, t, g, unknown or other
  misc_feature (259)..(259): n is a, c, g, or t
  modified_base (465)..(465): a, c, t, g, unknown or other
  misc_feature (465)..(465): n is a, c, g, or t
tcagacagtatatacacgaccggtgctcgatttagagagagtgtgttgagctctgggagaggagccccagccttgggattcccaggtgttttcattcagtgatcaggactgaacacagaggactcaccatggagtttgggctgagctggattttccttgctgctattttaaaaggtgtccagtgtgaggtgcagttggtggagtcgtgggggtagtttggaaagccgtggggatcccttagactctcctgtgcagcctntggacttcactttcagtaaccgcctaggatcgaccgtgggtccgccaggcctccggaggggacgggctgggaggtggggttcggaccgtagttaacggaaacccgtaaagcgtaggacgggtgggacagcagactacgctgccacccggtagaaacggcaagacttaccgaaccatctacgaagagtactagaattaacaaaagtntaacggtgtctcgtagacagtataggaaacacgaccgtagaaccgacggaaggaccacgtacgtacccgttataacgttacgtagttaccgtagggtactttcgggtttacgtaaccggtttcccggggaccgtaaccggggtacccgttcggtaccctaccggtttcccg

SEQ ID NO: 326754 - DNA, 598 bp, Homo sapiens
  misc_feature: GZ8MTXP02GEOB6.44.53.E09.1.454.CMB.2.raw
tcagacagtatatacacgaccggtgctcgatttagagagagtgtgttgggtttggggggaagcacctgtggttcttcctcctgctggtggcggctcccagatgggtcctgtctcagccgcagctgcgggagtcgggcccaggactggtgaagccttcggagaccctgtccctcacgtgcacggtctctggtgcctccatcgacagaagtaatttctactggggctggatccgccagccccaggagagggctgcgagtggatgggagtctctattatagtgggaacacctacaaccacccgtccacaacggtcagtcacatatccgtagacacgtcgaggacacgtagtttcctagaaacgtgtagttctgtcgcccgcgccgacacggtctgtcctacgtactgtcgtcagactagtcggtccgcctagtcggacgtaggtcgtactacgtaattcgtaacgttacgccgtttgggaccgttcgtacggggacctaacggggaccacgggtctaccggttccacctacacgttccctacaccgcctaccgaaccgaacggtccctacgtccggtccctccccgtcggccctcccgtcg

SEQ ID NO: 326755 - DNA, 604 bp, Homo sapiens
  misc_feature: GZ8MTXP02JVLLS.44.53.E09.1.454.CMB.2.raw
  modified_base (355)..(355): a, c, t, g, unknown or other
  misc_feature (355)..(355): n is a, c, g, or t
  modified_base (361)..(361): a, c, t, g, unknown or other
  misc_feature (361)..(361): n is a, c, g, or t
  modified_base (410)..(410): a, c, t, g, unknown or other
  misc_feature (410)..(410): n is a, c, g, or t
tcagacagtatatacacgaccggtgctcgatttagagagagtgtgttgggtttgggggaagcacctgtggttcttcctcctgctggtggcggctcccagatgggtcctgtctcagccgcagctgcgggagtcgggcccaggactggtgaagccttcggagaccctgtccctcacgtgcacggtctctggtgcctccatcgacagaagtaattctactggggctggatccgccagccccaggagagggctgcagtggattgggatctctatatagtgggaacacctactacacccgtcctcaacggtcagtcaccatatcgtggacacgtcgagacactagtttccctagaaagtnagttcngtgccgcgccgacacggctgctactactgtgtcagacagtcgggtcccncgtagtggcagggtccgtctactacttctacgtacgtcgttggggactcgtagggggccaaacggggtccgacggtcctacccggtcttcccgttaccactacccgtcaacggtccccttaccgaaccccgaacggggaaccccctaacgtcccgggttacccttccccccgtacggggcccaccccgttccgg

SEQ ID NO: 326756 - DNA, 643 bp, Homo sapiens
  misc_feature: GZ8MTXP02HSP6R.44.53.E09.1.454.CMB.2.raw
  modified_base (283)..(283): a, c, t, g, unknown or other
  misc_feature (283)..(283): n is a, c, g, or t
tcagacagtatatacacgaccggtgctcgatttagagagagtgtgttgggtttggggggaagcacctgtggttcttcctcctgctggtggcggctcccagatgggtcctgtctcagccgcagctgcggggagtcgggcccaggactggtgaagccttcggagaccctgtccctcacgtgcacggtctctggtgcctccatcgacagaagttaatttctacgtggggctggactccgccacgcccccgagggagacggggctgcgagtggtagttgggagtctntattataggtggaacctacctactaccaccccgtccctacgacggtcgacgtcacatactccggtgacacgtgagacactacgtttccagaacgtgtagttcgtcgtcgcccgccgccggacgaccggtcgtcgttactactacgtcgtgtacaacgactaggtcggggtccctccttaggtcggacgtcgggtcctactacttaaatttcctaacgttccggtcgtttaggggaccggtcggtcgggggacccggtaacgggacccgtacgggtacctccgttcctccgtactcctccgtacacgccctaccgaccgacggccctacgtccggtttccctccccgtcggcctccgtccg

SEQ ID NO: 326757 - DNA, 596 bp, Homo sapiens
  misc_feature: GZ8MTXP02GAVJZ.44.53.E09.1.454.CMB.2.raw
  modified_base (589)..(589): a, c, t, g, unknown or other
  misc_feature (589)..(589): n is a, c, g, or t
tcagacagtatatacacgaccggtgctcgatttagagagagtgtgttgggtttgggggaagcacctgtggttcttcctcctgctggtggcggctcccagatgggtcctgtctcagccgcagctgcgggagtcgggcccaggactggtgaagccttcggagaccctgtccctcacgtgcacggtctctggtgcctccatcgacagaagtaattctactggggctggatccgccagccccaggagagggctgcagtggattgggagtctctattatagtgggaacacctactacaacccgtcctacaacggtcgagtcacatatcgtgacacgtcgaggacactagtttccctagaaacgtgacgttctgtggccgccgccgacacggtctgtctactactgttcgtacagactagtggggtcccactagttcgcgtggtcgtctactaattctactacgtcttaggggactcggtacgggggtaccaaaggggtaccaccggtaccgacccgttcctacctcacgtccctcgaccgtccctaccacccgaacgggcccctaacgtcccggttccttcccccgaggccccncccgtcg

SEQ ID NO: 326758 - DNA, 650 bp, Homo sapiens
  misc_feature: GZ8MTXP02FN6M7.44.53.E09.1.454.CMB.2.raw
  modified_base (636)..(636): a, c, t, g, unknown or other
  misc_feature (636)..(636): n is a, c, g, or t
tcagacagtatatacacgaccggtgctcgatttagagagagtgtgttgggtttggggggaagcacctgtggttcttcctcctgctggtggcggctcccagatgggtcctgtctcagccgcagctgcgggagtcgggcccaggactggtgaagccttcggagaccctgtccctcacgtgcacggtctctggtgcctccatcgacagaagttaattctacgtggggctggactccgccacgccccgaggaggaggggctgcgaggtggagttggggagtctctattagtaggtagggaacacctactaaccgaaccccgtccctacgaacggtcgagtccaccatactccgtggacacgtcgacggacactacgtttcctagaacgtgtagtctggtcgcccgcgcccgacacggtctgtccttaactacgtgtacgtcgagactaggttcgggtcccgactagtcggcgtaggtcgtactactactttaccgacttacggtcgttacgggaaccgttcggtacgggggaccgaacgggggaacctacgggtacctacccggtcctaccctacgtacctcccgtacaccgttcccaccgacccaaacggggccctacggttcccgtcccgttccccgnggccctacccgtcg

SEQ ID NO: 326759 - DNA, 674 bp, Homo sapiens
  misc_feature: GZ8MTXP02JL5E8.44.53.E09.1.454.CMB.2.raw
  modified_base (353)..(353): a, c, t, g, unknown or other
  misc_feature (353)..(353): n is a, c, g, or t
  modified_base (399)..(399): a, c, t, g, unknown or other
  misc_feature (399)..(399): n is a, c, g, or t
tcagacagtatatacacgaccggtgctcgatttagagagagtgtgttgggtttgggggaagcacctgtggttcttcctcctgctggtggcggctcccagatgggtcctgtctcagccgcagctgcgggagtcgggcccaggactggtgaagccttcggagaccctgtccctcacgtgcacggtctctggtgcctccatcgacagaagtaatttcactggggctggatccgccagcccccaggagaggggctgcagtggattgggatctctattatagtgggaacacctactacaacccgtcctacaacggtcagtcacatatccgtggacacgtcgaggacactagtttcccngaaacgtgagttctgtggccgccgcgacacggctgctactactgtntcagaccagtcggggtacccgcctaagtggactagggttcgtctacgtaactttctaacgtaccgtcgtttacgggggaaccgttccggttcgggggacccctaaaaggggggtaccccaaccggggttcccgtaaaccccgggttccttaccccgttacgtaaccttccccgtcgtaaacccggtccccttacccgaacccggaaacggggtccccctaaggttccccgggttacccctttccccccggtacgggccccgttccccgttaccgg

SEQ ID NO: 326760 - DNA, 679 bp, Homo sapiens
  misc_feature: GZ8MTXP02HYREB.44.53.E09.1.454.CMB.2.raw
  modified_base (274)..(274): a, c, t, g, unknown or other
  misc_feature (274)..(274): n is a, c, g, or t
  modified_base (446)..(446): a, c, t, g, unknown or other
  misc_feature (446)..(446): n is a, c, g, or t
tcagacagtatatacacgaccggtgctcgatttagagagagtgtgttgggtttgggggaagcacctgtggttcttcctcctgctggtggcggctcccagatggatcctgtctcagccgcagctgcgggagtcgggcccaggactggtgaagccttcggagaccctgtccctcacgtgcacggtctctggtgcctccatcgacagaagtaattctactggggctggatccgccacgccccaggagagggctgcagtggatgggagtctctattanagtgggaacacctactaccaaccccgtcctacaacggtcgagtaccaccaatactccgtagacacgtcgaggactacgtacgttttccagtaagtgtagttcgtaggtcggcccgccgaccgacacggcttcgtactactaccgtgtctacacgactaggtccggggtaccncgttagcgggtacgtacgggttcctactaccgttaaatttccgttaaccgtacggtcggttacgggaaccgttcgggtacgggggaaccgaacgggggtaccctaaccgggttccaaccccggtttctcccgttaaccaccgttaccaccgacccgtaccccgtaccgaaaccggtaacccggtaccctaccggttccccggttaccccgttcccccggcggttccccgcccg

SEQ ID NO: 326761 - DNA, 626 bp, Homo sapiens
  misc_feature: GZ8MTXP02FLZF2.44.53.E09.1.454.CMB.2.raw
  modified_base (191)..(191): a, c, t, g, unknown or other
  misc_feature (191)..(191): n is a, c, g, or t
  modified_base (225)..(225): a, c, t, g, unknown or other
  misc_feature (225)..(225): n is a, c, g, or t
  modified_base (237)..(237): a, c, t, g, unknown or other
  misc_feature (237)..(237): n is a, c, g, or t
  modified_base (284)..(284): a, c, t, g, unknown or other
  misc_feature (284)..(284): n is a, c, g, or t
tcagacagtatatacacgaccggtgctcgatttagagagagtgtgttgggtttggggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactgganccagcggtaatnttctagtcttaacttgtctcctggtatcaacatcatccaagtaaacncccccaaatcatcatctatgaggcctataagacgtccctcgtaggggtttactagtcgtcttacccactcgacctaccgaacggtcccggacaccgaccggccctacccgtagactaactctcgtcgggcctacccgaggctacggaggacgacggtcttagtatttagttagttcggttcgtctacgtagacgtttcggttcgcgactagtacctaactttagttcgtacgtttcgggaaacgttacggggtaaaccctaacgggtaccaccggtttaccgtacggtaccgacgaacccggaaacgacccccgaaaccctcgtacggtaccacgtttcccg

SEQ ID NO: 326762 - DNA, 715 bp, Homo sapiens
  misc_feature: GZ8MTXP02HLNI0.44.53.E09.1.454.CMB.2.raw
  modified_base (201)..(201): a, c, t, g, unknown or other
  misc_feature (201)..(201): n is a, c, g, or t
  modified_base (571)..(571): a, c, t, g, unknown or other
  misc_feature (571)..(571): n is a, c, g, or t
tcagacagtatatacacgaccggtgctcgatttagagagagtgtgttgagctctgggagaggagccccagccttgggattcccaggtgttttcattcagtgatcaggactgaacacagaggactcaccatggagtttgggctgagctggtattttccttgctgctattttaaaaggtgtccagtgtgaggtgcaggttggnggagtcgtgggggaggtttggtaaagccgtggggacgtcccttagactctcctgtgcagcctcgtggattctactttcagtaacgcctggatcgaccgtcgggtccgccgaggcctccggaaggggacggggctagggaggttcggggttggacccgttaagttaacgaaaccaaaaggtcgtagggaacggtccggggaaccaggaccaaggtactaaccggctcggacccgtaacccggtaaggaaaacgggtcaacggtactttacccgaacctagtccctaacgaaaggacgtaataggtaacttaaacgaaaaagttacgttaccgggttagttcctacgtagacgtaagtactaagggaaaccncgtaccctaagaaacccgacggaacggactaacgaccgtaccgtactactttacgtcgttacgttagggggacttttcgggttacctaacggttaccggggacccgtaacggggtaaccccgtcggtacccgtacccggttccc

SEQ ID NO: 326763 - DNA, 561 bp, Homo sapiens
  misc_feature: GZ8MTXP02HSNYD.44.53.E09.1.454.CMB.2.raw
  modified_base (299)..(299): a, c, t, g, unknown or other
  misc_feature (299)..(299): n is a, c, g, or t
  modified_base (435)..(435): a, c, t, g, unknown or other
  misc_feature (435)..(435): n is a, c, g, or t
  modified_base (462)..(462): a, c, t, g, unknown or other
  misc_feature (462)..(462): n is a, c, g, or t
tcagacagtatatacacgaccggtgctcgatttagagagagtgtgttgagctctgggagaggagccccagccttgggattcccaggtgttttcattcagtgatcaggactgaacacagaggactcaccatggagtttgggctgagctggattttcctgctgctattttaaaaggtgtccagtgtgaggtgcaggttggtggagtcgtgggggaggtttggtaaagccgtggggatcccttagactctcctgtgcagcctctggattcactttcagtaacgcctggatgacctgggtccncaggctccgagggaggctggagtgggtgcgtatagaacaaagctgacggtggacagcagactacgctcgcaccggtagaaacgcaagacttccactatacctcaaagagactagaatttacaaaagtcgttacggngttactcttgactaggataggaaaccncgacctagaaccgacgagacacgacgtcctattactactgtacgtggtacttcggtacgtaacggtcggaccgtacgggtacctcggtacctaccgtcg

SEQ ID NO: 326764 - DNA, 685 bp, Homo sapiens
  misc_feature: GZ8MTXP02HIO5F.44.53.E09.1.454.CMB.2.raw
tcagacagtatatacacgaccggtgctcgatttagagagagtgtgttgggtttggggggaagcacctgtggttcttcctcctgctggtggcggctcccagatgggtcctgtctcagccgcagctgcgggagtcgggcccaggactggtgaagccttcggagaccctgtccctcacgtgcacggtctctggtgcctccatcgacagaagttaatttctacgtggggctggactccgccacgccccaggaggagggctgcagtggagttggatctctatatagtggaacacctactaccaacccgtcctcgaacggtcgagtccacatatcgtggacacgtcgagactactcgtttaccagaacgtgtagttctggtcggccgccgccgacacggctcgtcctactacgtgtcgtcacgactacgtcgggtcccgtcgtacgtcggtacgtacgggtcctacgttactaactttacctacgttaccgtcggtttacggggtaccgttccggtacgggggacccaaacgggggtaccccgtaccgggtaccctacccggtcccttacccgtacctaccgttcccctacgtaccgtacccccgttacccgaacccggaaccgggtaaccccctacggttcccccggttccccgttccccccggttccggccccgtttcccccgtcccgg

SEQ ID NO: 326765 - DNA, 590 bp, Homo sapiens
  misc_feature: GZ8MTXP02HVL7Z.44.53.E09.1.454.CMB.2.raw
  modified_base (242)..(242): a, c, t, g, unknown or other
  misc_feature (242)..(242): n is a, c, g, or t
tcagacagtatatacacgaccggtgctcgatttagagagagtgtgttgggtttggggggaagcacctgtggttcttcctcctgctggtggcggctcccagatgggtcctgtctcagccgcagctgcgggagtcgggcccaggactggtgaagccttcggagaccctgtccctcacgtgcacggtctctggtgcctccatcgacagaagtaatttcactgggctggatccgccagccccaggngagggctgcagtggattgggatctctatatagtgggaacacctactacaacccgtcctacaacggtcgagtcacatactcgtgacacgtcgagacactagtttcccagaacgtgagttctggtggcccgtcgccgacgacggtctgtacctactacttgtcgtacagtacagtcgggtacccgctaacgtgggactacgggtctctactagtttacctaacgttacgcgtttaggggacctcggtcggggaccaaggggaccacggtacaccgttctcgtacactccctacacgtccctaccacgaacggccctacgtccggtcccttaccccgcggtccgaccctcg

SEQ ID NO: 326766 - DNA, 670 bp, Homo sapiens
  misc_feature: GZ8MTXP02GN2CM.44.53.E09.1.454.CMB.2.raw
  modified_base (277)..(277): a, c, t, g, unknown or other
  misc_feature (277)..(277): n is a, c, g, or t
tcagacagtatatacacgaccggtgctcgatttagagagagtgtgttgggtttggggggaagcacctgtggttcttcctcctgctggtggcggctcccagatgggtcctgtctcagccgcagctgcgggagtcgggcccaggactggtgaagccttcggagaccctgtccctcacgtgcacggtctcgtggtcgcctccatcgacagaagtaatttctacgtgggctggactccgcacgccccgaggacgagggctgctaggtaggatgggagtctntattatagtggaacactactaccacccgcctcacgtcgagtcacgatatcgtgacacgtcgacgacactacgtttaccgtagaaaccgtgtacgttcgtacggtcggacccgacccgccgaaccacggtaccgtacgtcctaactaccgttgtcggacaaacggactagtcggggtacccacgtagtcggacgtagggcctactctaaacttcgtaacgttaccgtgttacgggggacgttaccggtcgggggaccaaagggggaccctaaccgggtcctaacccggtctaacccgtcacctcttcccgaacgtaccctacccgaaaacccgtaaacgggcccctaaacggtttccggttccccttacccccgtcgggccccctcgtaacccg

SEQ ID NO: 326767 - DNA, 730 bp, Homo sapiens
  misc_feature: GZ8MTXP02F31UD.44.53.E09.1.454.CMB.2.raw
  modified_base (249)..(249): a, c, t, g, unknown or other
  misc_feature (249)..(249): n is a, c, g, or t
tcagacagtatatacacgaccggtgctcgatttagagagagtgtgttgggtttgggggaggcgtggtccagcccgggaggtccctgagactctcctgtgtagcctctgggttctcattcgatagtattttggtttgcactgggtccgccaggctccaggcgaaggggccggaggtgggtggcagtcatctccgacgatggaagtgagaagtattactcagactcgtgaagggccattcacatctcaganacaatcaagatatagctgttattgacaaatgaactagcgtagagtagttagacgactacgttcttagttttaattacgtggtgaccgggtacggggaccctaccggaaaggggtaaaccggggttcggggaaatcaaaacttaaaaccttactaacgttatttagaagttaggagttaggtcgtgggggacgtacggggggtacgtcgggtacctaccgtctacccgcgacgtacccttaacccgaacccgtaaacgggtccccgtaacgtttcccggggttaccccttccccccgggtcgggacccccgtcccgttacccggtccgttaaccccgagggggaccctacccgaaccgttccggggtacgggggacctaccggacggcccggggtacccttcgggggacctcggtcgttacggacgtaaacggtacctactttaccgtaagttactacgttcgtagtccgggaggccggtag

SEQ ID NO: 326768 - DNA, 502 bp, Homo sapiens
  misc_feature: GZ8MTXP01DRPRK.44.39.D06.1.454.CMB.2.raw
  modified_base (223)..(223): a, c, t, g, unknown or other
  misc_feature (223)..(223): n is a, c, g, or t
  modified_base (235)..(235): a, c, t, g, unknown or other
  misc_feature (235)..(235): n is a, c, g, or t
tcagacagtatatacacgaccggtgctcgatttagtgacatctcgcagttctttgggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactgganccagcggtaatnttcttagtcttaactttgtctctggtatcaacatcatccaggtaaagccccaaactcatcatctatgagctataagagcctcaggggtttctaatccgcttcactgcctccaagtccggcaacacggcctcctgacaatctctgggctccaggctgaggacgaggctgattattattggttgctcagattgttcgtcgcatccattatgttcttcggaagtgggacaaggtcaccgttcaggtcagccaggccaaccctcttcgtcc

SEQ ID NO: 326769 - DNA, 518 bp, Homo sapiens
  misc_feature: GZ8MTXP01EM100.44.39.D06.1.454.CMB.2.raw
  modified_base (201)..(201): a, c, t, g, unknown or other
  misc_feature (201)..(201): n is a, c, g, or t
  modified_base (213)..(213): a, c, t, g, unknown or other
  misc_feature (213)..(213): n is a, c, g, or t
  modified_base (260)..(260): a, c, t, g, unknown or other
  misc_feature (260)..(260): n is a, c, g, or t
  modified_base (353)..(353): a, c, t, g, unknown or other
  misc_feature (353)..(353): n is a, c, g, or t
tcagacagtatatacacgaccggtgctcgatttagtgacatctcgcagttctttgggggaggaactgctcagttaggacccagagggaaccatggaagccccagctcagcttctcttcctcctgctactctggctcccagagatcaccggagatattgtgttgacacagtctccaggcaccctgtctttgctccagggganagagccaccctntcctgtagggccagtcggagtgttgctaagtcctagcctggtacaanagaactggcaggctccaggctcctcatctatgatgcatccaaacagggtcactggcaccccagacaggttcagtggcagtgggtctagggacngacttcactctcacgtcagcaatgtacagcctagaagtattttgctagtttattactgttcaggtcagtccgttcctccaggccgctctacgtttcggggcgggggtaccgaagggtggagagtcgaggaacgaacttggttggctgcaaccatcttgtcttctc

SEQ ID NO: 326770 - DNA, 529 bp, Homo sapiens
  misc_feature: GZ8MTXP01A3TTG.44.39.D06.1.454.CMB.2.raw
  modified_base (241)..(241): a, c, t, g, unknown or other
  misc_feature (241)..(241): n is a, c, g, or t
  modified_base (394)..(394): a, c, t, g, unknown or other
  misc_feature (394)..(394): n is a, c, g, or t
  modified_base (506)..(506): a, c, t, g, unknown or other
  misc_feature (506)..(506): n is a, c, g, or t
tcagacagtatatacacgaccggtgctcgatttagtgacatctcgcagttctttgggggagctacaacaggcaggcaggggcagcaagatggtgttgcagacccaggtcttcatttctctgttgctctggatctctggtgcctgcggggacatcgcgatgagccagtctccagactccctggctgtgtctctgggcgaggagggccaccgtcaactgcaactccagccaaagtgtctttangtccccaatagtaagaactattagcctggtaaccaacagaaaccggacagtctacctaaattactctttatggcatctactcgggagtccggggtcctgaccgtattcaggtggcggcggtactgggcacgtatttcactctcacatcagtancctgcaggctgaagacgtgctagtttattatggtacaactaattatttaagaacttcctaatctacgtttcggacggacggaccaagtagttagagatacaaacgacgttgngaactgcaccattctgttctaac

SEQ ID NO: 326771 - DNA, 520 bp, Homo sapiens
  misc_feature: GZ8MTXP01CSCNB.44.39.D06.1.454.CMB.2.raw
  modified_base (243)..(243): a, c, t, g, unknown or other
  misc_feature (243)..(243): n is a, c, g, or t
  modified_base (396)..(396): a, c, t, g, unknown or other
  misc_feature (396)..(396): n is a, c, g, or t
  modified_base (402)..(402): a, c, t, g, unknown or other
  misc_feature (402)..(402): n is a, c, g, or t
  modified_base (480)..(480): a, c, t, g, unknown or other
  misc_feature (480)..(480): n is a, c, g, or t
tcagacagtatatacacgaccggtgctcgatttagtgacatctcgcagttctttgggggagctacaacaggcaggcaggggcagcaagatggtgttgcagacccaggtcttcatttctctgttgctctggatctctggtgcctggcggggacatcgcgatgagccagtctccagactccctggctgtgtctcgtgggcgagacgggccaccgtcaactgcaactccagccaaagtgtctttangtccccaatagtaagaactattagcctaggtaccaacagaaaccgggacagtctactaaatttactctttatgggctatctacgtcgggagtccgggtccctgaccgattcagtggcggcgggtctgggcacatttcactctcacatcagtancctgcnggctgaagcgtggctagtttattattggtcaactatatttagactctatctacttcggcggaggtccaagagttaganagtacgaacgaacttggttgctgccacgattctgttcttc

SEQ ID NO: 326772 - DNA, 527 bp, Homo sapiens
  misc_feature: GZ8MTXP01EGFC4.44.39.D06.1.454.CMB.2.raw
  modified_base (243)..(243): a, c, t, g, unknown or other
  misc_feature (243)..(243): n is a, c, g, or t
  modified_base (365)..(365): a, c, t, g, unknown or other
  misc_feature (365)..(365): n is a, c, g, or t
tcagacagtatatacacgaccggtgctcgatttagtgacatctcgcagttctttgggggagctacaacaggcaggcaggggcagcaagatggtgttgcagacccaggtcttcatttctctgttgctctggatctctggtgcctggcggggacatcgcgatgagccagtctccagacctccctggctgtgtctcgtgggcgagagggccaccgtcaactgcaactccagccaaagtgtctttangtaccccaatagtaagaactattagcctggtaaccaacagaaaccggacagtactactaaattactctttatggctatctactcgggagtccgggtcctgaccgatcgagtggcggcggtcngggcactattcactctcacctatcagtagcctgcaggctgaagcgtggctagtttatattggtacaaataattatttagaactcctatcactttcggcggaggaccaagagttagagaatacgaaaagttaacttggttggctgcaccattctgttaacttc

SEQ ID NO: 326773 - DNA, 532 bp, Homo sapiens
  misc_feature: GZ8MTXP01B1CRF.44.39.D06.1.454.CMB.2.raw
  modified_base (203)..(203): a, c, t, g, unknown or other
  misc_feature (203)..(203): n is a, c, g, or t
  modified_base (318)..(318): a, c, t, g, unknown or other
  misc_feature (318)..(318): n is a, c, g, or t
  modified_base (370)..(370): a, c, t, g, unknown or other
  misc_feature (370)..(370): n is a, c, g, or t
  modified_base (389)..(389): a, c, t, g, unknown or other
  misc_feature (389)..(389): n is a, c, g, or t
  modified_base (401)..(401): a, c, t, g, unknown or other
  misc_feature (401)..(401): n is a, c, g, or t
  modified_base (412)..(412): a, c, t, g, unknown or other
  misc_feature (412)..(412): n is a, c, g, or t
  modified_base (454)..(454): a, c, t, g, unknown or other
  misc_feature (454)..(454): n is a, c, g, or t
  modified_base (517)..(517): a, c, t, g, unknown or other
  misc_feature (517)..(517): n is a, c, g, or t
tcagacagtatatacacgaccggtgctcgatttagtgacatctcgcagttctttgggggaggaactgctcagttaggacccagagggaaccatggaagccccagctcagcttctcttcctcctgctactctggctcccagagatcaccggagatattgtgttgacacagtctccaggcaccctgtctttgtctccgagggganagacgccaccctctcctggtacgggccaggtcggagtgttgctaagtacctagcctggtaccaacagaaacctggccaggctcccaggcctcctcatctatgatgcatccaaagngggtcacgtggccaccccagacaggttcagtggcaggtcgggtctagggacngtacttcactctcaccgtnagcaatcgtacngcctagaagtntttgctagtttatactgtcaggctagtccttcctcgaggccnctcgtacgttcggggacgggggtaccagggtggagagtcgagacgtattggttgctgcaacgntcttgtcttcgtaac

SEQ ID NO: 326774 - DNA, 548 bp, Homo sapiens
  misc_feature: GZ8MTXP01DDFAW.44.39.D06.1.454.CMB.2.raw
  modified_base (244)..(244): a, c, t, g, unknown or other
  misc_feature (244)..(244): n is a, c, g, or t
  modified_base (521)..(521): a, c, t, g, unknown or other
  misc_feature (521)..(521): n is a, c, g, or t
  modified_base (530)..(530): a, c, t, g, unknown or other
  misc_feature (530)..(530): n is a, c, g, or t
tcagacagtatatacacgaccggtgctcgatttagtgacatctcgcagttctttgggggagctacaacaggcaggcaggggcagcaagatggtgttgcagacccaggtcttcatttctctgttgctctggatctctggtgcctgcggggacatcgcgatgagccagtctccagacctccctggctgtgtctcgtgggcgagacgggccaccgtcaactgcaactccagccaaagtgtcttttangtccccaatagtaagactattagcctggtaaccaacagaaaccggacagtctacctaaattactcttttatggctatctacgtcgggtagtccgggtcctgaccgtattcgagtggcggcgggtcttgggcactagtttccactctcacatcagtacgcctgcaggctagaagcgtgactagtttattattgtacaactaattatttaacgacttctatactacgtttcggacggtaggaccaagtacgttagagatacaaacgacgttgttacggntcgctaacncttcttcgttctttaacc

SEQ ID NO: 326775 - DNA, 572 bp, Homo sapiens
  misc_feature: GZ8MTXP01CBSHW.44.39.D06.1.454.CMB.2.raw
  modified_base (201)..(201): a, c, t, g, unknown or other
  misc_feature (201)..(201): n is a, c, g, or t
  modified_base (294)..(294): a, c, t, g, unknown or other
  misc_feature (294)..(294): n is a, c, g, or t
  modified_base (308)..(308): a, c, t, g, unknown or other
  misc_feature (308)..(308): n is a, c, g, or t
  modified_base (350)..(350): a, c, t, g, unknown or other
  misc_feature (350)..(350): n is a, c, g, or t
  modified_base (356)..(356): a, c, t, g, unknown or other
  misc_feature (356)..(356): n is a, c, g, or t
  modified_base (366)..(366): a, c, t, g, unknown or other
  misc_feature (366)..(366): n is a, c, g, or t
  modified_base (373)..(373): a, c, t, g, unknown or other
  misc_feature (373)..(373): n is a, c, g, or t
tcagacagtatatacacgaccggtgctcgatttagtgacatctcgcagttctttgggggaggaactgctcagttaggacccagagggaaccatggaagccccagctcagcttctcttcctcctgctactctggctcccagagatcaccggagatattgtgttgacacagtctccaggcaccctgtctttgctccagggganagagccacctctcctgtagggccagtcggagtgttgctaagtcctagcctggaccaacagaaacctggccaggctcccaggctcctcatctangatgcatccaaagngggtcactggccaccccagacaggttcagtggcaggtggtcngggacngcttcactcncaccgtnagcaatgtacagcctagtaaacgttatttgacttagtttattactgttcaggctagtccgttccgtccgacggcccgtctccgtaccggtttccggggacggggggtaccgtaaggggtcgggaagttaggtaccgaaggaaccgaacgttgggttcggcgtggacctaaccgtactcgttcgttccgttcgtaacccg

SEQ ID NO: 326776 - DNA, 547 bp, Homo sapiens
  misc_feature: GZ8MTXP01DDBA3.44.39.D06.1.454.CMB.2.raw
  modified_base (224)..(224): a, c, t, g, unknown or other
  misc_feature (224)..(224): n is a, c, g, or t
  modified_base (284)..(284): a, c, t, g, unknown or other
  misc_feature (284)..(284): n is a, c, g, or t
tcagacagtatatacacgaccggtgctcgatttagtgacatctcgcagttctttgggggggtcacaagaggcagcgctctcgggacgtctccaccatggcctgggctctgctgctcctcactctcctcacccaggacacagggtcctgggcccagtctgccctgactcagcctgcctccgtgtctggtcgcctggacagtcggtcaccatctcctgcactgganccagcgtaatattcttagtcttaactttgtctcctggtatcaacatcatccaggtaaacnccccaaactcatcatctatgaggcctataagaggccctgaggggtttctaatccgcttcactgccctccaagtccggcaacaccggcctccctgacaatcctctcgggctccaggctggacggacgaggctagatttattattgggttgcttcagtattgttcgtacgctatcactttatgttcttcggaaggttcggaccgtaaaggtccaccggttcttagggtccacgtcccaagggccccaaccctaacttcgtaaccc

SEQ ID NO: 326777 - DNA, 632 bp, Homo sapiens
  misc_feature: GZ8MTXP01CGY68.44.39.D06.1.454.CMB.2.raw
  modified_base (245)..(245): a, c, t, g, unknown or other
  misc_feature (245)..(245): n is a, c, g, or t
tcagacagtatatacacgaccggtgctcgatttagtgacatctcgcagttctttggggggggtcacaagaggcagcgctctcgggacgtctccaccatggcctgggctctgctgctcctcactctcctcactcaggacacagggtcctgggcccagtctgccctgactcagcctgcctcgtgtctggttctcctggacagtcgatcaccatctcctgcacgtgggtccagcaatgacagttgganatataacttgctctgtatacaacaacataccaggaccaaacgacccccaaactctaattactttttagacgtaccagtgacgcggccgtcgtaggttctttactaatcgtcttctctggcctaccgaagtcgtcggacccacgaccggtccctcctgtcgatccgtcgtcgggcctccggctggacggacgagtctagtaacttattacgtgccgtcttactaactttacaactttcgttaggacgttacgtttgggggtaacggttcggggacggggtaacgggttaccttaccgtacccgttacgggttaccccggttaccgtaacgggttcccaaccgggtaccccgaacgggttcccgttccccggttcccccgtttcccggg

SEQ ID NO: 326778 - DNA, 593 bp, Homo sapiens
  misc_feature: GZ8MTXP01DT4T0.44.39.D06.1.454.CMB.2.raw
  modified_base (207)..(207): a, c, t, g, unknown or other
  misc_feature (207)..(207): n is a, c, g, or t
  modified_base (321)..(321): a, c, t, g, unknown or other
  misc_feature (321)..(321): n is a, c, g, or t
  modified_base (360)..(360): a, c, t, g, unknown or other
  misc_feature (360)..(360): n is a, c, g, or t
  modified_base (449)..(449): a, c, t, g, unknown or other
  misc_feature (449)..(449): n is a, c, g, or t
  modified_base (469)..(469): a, c, t, g, unknown or other
  misc_feature (469)..(469): n is a, c, g, or t
tcagacagtatatacacgaccggtgctcgatttagtgacatctcgcagttctttggggagcttcagctgtggtagagaagacaggattcaggacaatctccagcatggccggcttccctctcctcctcaccctcctcactcactgtgcagggtcctgggcccagtctgtgctgactcagccatcctcagcgtctcgggacccccggnagacggtcacgatcttttgtctggaagtaggtccaacatcggaaagtaattacgtatactggtatcggcaattcacgaggagccggtccccagacccctcatctaagtaggganaatcagccggccctcgacggggtccctgaccccgattcnctcgccctaaccaagtctgccacctcacgcctccgtgccatcgacggtcgggccccgtcgaggtacgaggttcgattactacgtgccgngacgtcgttgggatcgaacncgccgtaggacgggtcgttggccgttgggtccgggcgggaacgggtaaccttaaacgtcggtacccggttcgttacggaccaacggcccgaagggccctccggcccccgtcggttcctaacccg

SEQ ID NO: 326779 - DNA, 513 bp, Homo sapiens
  misc_feature: GZ8MTXP01CK958.44.39.D06.1.454.CMB.2.raw
  modified_base (202)..(202): a, c, t, g, unknown or other
  misc_feature (202)..(202): n is a, c, g, or t
  modified_base (242)..(242): a, c, t, g, unknown or other
  misc_feature (242)..(242): n is a, c, g, or t
tcagacagtatatacacgaccggtgctcgatttagtgacatctcgcagttctttgggggagctacaacaggcaggcaggggcagcaagatggtgttgcagacccaggtcttcatttctctgttgctctggatctctggtgcctggcggggacatcgcgatgagccagtctccagactccctggctgtgtctcgtgggcgagngggccaccgtcaactgcaactccagccaaagtgtctttangtccccaatagtaagaactatttagcctggtaccaacagaaaccggacagtctcctaaattactctttattggcatctactcgggagtccgggtcctgaccgacttcagtggcggcgggtctgggcacagtttcactctcacatcagtagcctgcaggctgaagacgtgcagtttatattggtctaactaatatttagaactctatctattcggcgtaggaccaagagttagagatacaagaacgttgagctgcaccattctgttcttaac

SEQ ID NO: 326780 - DNA, 511 bp, Homo sapiens
  misc_feature: GZ8MTXP01EWOQX.44.39.D06.1.454.CMB.2.raw
  modified_base (203)..(203): a, c, t, g, unknown or other
  misc_feature (203)..(203): n is a, c, g, or t
  modified_base (215)..(215): a, c, t, g, unknown or other
  misc_feature (215)..(215): n is a, c, g, or t
  modified_base (264)..(264): a, c, t, g, unknown or other
  misc_feature (264)..(264): n is a, c, g, or t
  modified_base (293)..(293): a, c, t, g, unknown or other
  misc_feature (293)..(293): n is a, c, g, or t
  modified_base (313)..(313): a, c, t, g, unknown or other
  misc_feature (313)..(313): n is a, c, g, or t
  modified_base (359)..(359): a, c, t, g, unknown or other
  misc_feature (359)..(359): n is a, c, g, or t
  modified_base (376)..(376): a, c, t, g, unknown or other
  misc_feature (376)..(376): n is a, c, g, or t
  modified_base (470)..(470): a, c, t, g, unknown or other
  misc_feature (470)..(470): n is a, c, g, or t
tcagacagtatatacacgaccggtgctcgatttagtgacatctcgcagttctttgggggaggaactgctcagttaggacccagagggaaccatggaagccccagctcagcttctcttcctcctgctactctggctcccagagatcaccggagatattgtgttgacacagtctccaggcaccctgtctttgtctccgagggganagagccaccctntcctgtagggccagtcggagtgttgctaagtacctagcctggtaccaanagaaacctggccaggctcccaggctcctnatctatgatgcatccaaacngggtcactggcacccagacaggttcagtggcagtggtctagggacngacttcactctcacgtnagcaatgtacagctagaagtattttgctagttattactgtcaggctagcgttctccagccgctcacgtttcgggcgggggtaccagggtggagngtcgagacgaacttgttgctgcaaccatcttgtcttctaac

SEQ ID NO: 326781 - DNA, 576 bp, Homo sapiens
  misc_feature: GZ8MTXP01BAQFO.44.39.D06.1.454.CMB.2.raw
  modified_base (191)..(191): a, c, t, g, unknown or other
  misc_feature (191)..(191): n is a, c, g, or t
  modified_base (225)..(225): a, c, t, g, unknown or other
  misc_feature (225)..(225): n is a, c, g, or t
  modified_base (237)..(237): a, c, t, g, unknown or other
  misc_feature (237)..(237): n is a, c, g, or t
  modified_base (268)..(268): a, c, t, g, unknown or other
  misc_feature (268)..(268): n is a, c, g, or t
  modified_base (284)..(284): a, c, t, g, unknown or other
  misc_feature (284)..(284): n is a, c, g, or t
  modified_base (311)..(311): a, c, t, g, unknown or other
  misc_feature (311)..(311): n is a, c, g, or t
tcagacagtatatacacgaccggtgctcgatttagtgacatctcgcagttctttgggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactgganccagcggtaatnttcttagtcttaacttgtctcctgtatcaanatcatccaggtaaacncccccaaatcatcatctatgagcctanaagagcctgagggttctaatccgcttcactgccctaccaagtccggacaaacgaccggccctccctgacaatcctctgggcctccgagggctaggacggtacgaggctagtaatttattagttgggttgcttacaggtatgttccgtcgtcctaattccaactttatgttcgttacgggaaaggttcgggaacccgtaaaggtccttacccggttccttagggtcccaagtccccaaagggccccaaaccccgtcttcgtaaccc

SEQ ID NO: 326782 - DNA, 566 bp, Homo sapiens
  misc_feature: GZ8MTXP01ASYDN.44.39.D06.1.454.CMB.2.raw
  modified_base (192)..(192): a, c, t, g, unknown or other
  misc_feature (192)..(192): n is a, c, g, or t
  modified_base (226)..(226): a, c, t, g, unknown or other
  misc_feature (226)..(226): n is a, c, g, or t
  modified_base (318)..(318): a, c, t, g, unknown or other
  misc_feature (318)..(318): n is a, c, g, or t
  modified_base (373)..(373): a, c, t, g, unknown or other
  misc_feature (373)..(373): n is a, c, g, or t
tcagacagtatatacacgaccggtgctcgatttagtgacatctcgcagttctttggggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactgganccagcggtaatattcttagtcttaacttgtctctggtatcaacatcatccaaggtaaacgcccccaaatcatcatctatgaggcctataagnggccctgtaggggtttctaatccgtcttcactcgccctaccaacgtccgacaacncggccctcctgacaatctctcgggctccgaggctaggaggacgaggctgtattattattggttgctcagtatgttcgtcgtcatctactttagtgttcgttacgggttaaaggtcgggaaccgtaaagggtccacccggttcgttacgggccacggaaccccgaaacggccccaaaccccgtcttcgtaaccc

SEQ ID NO: 326783 - DNA, 581 bp, Homo sapiens
  misc_feature: GZ8MTXP01CJC3R.44.39.D06.1.454.CMB.2.raw
  modified_base (192)..(192): a, c, t, g, unknown or other
  misc_feature (192)..(192): n is a, c, g, or t
  modified_base (226)..(226): a, c, t, g, unknown or other
  misc_feature (226)..(226): n is a, c, g, or t
  modified_base (239)..(239): a, c, t, g, unknown or other
  misc_feature (239)..(239): n is a, c, g, or t
  modified_base (267)..(267): a, c, t, g, unknown or other
  misc_feature (267)..(267): n is a, c, g, or t
  modified_base (271)..(271): a, c, t, g, unknown or other
  misc_feature (271)..(271): n is a, c, g, or t
  modified_base (286)..(286): a, c, t, g, unknown or other
  misc_feature (286)..(286): n is a, c, g, or t
  modified_base (373)..(373): a, c, t, g, unknown or other
  misc_feature (373)..(373): n is a, c, g, or t
tcagacagtatatacacgaccggtgctcgatttagtgacatctcgcagttctttggggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactgganccagcggttaatnttcttagtcttaactttgtctcctgtancaantcatccaggtaaacncccccaaatcatcatctatgaggcctaataagacggccctcgtaggggtttctaatccgcttcactcgcctaccaagtccgcaaacncggcctccctgacaatctcgtcggctccgaggctgacggacgaggctgaattattattgggttgcttcgagtattcgttcgtcgactattctaactttagtgttcgttacgggaaggttcgggaaccgtaaacgggttccacccggttcgttacgggttccaacggaaccccgaaacgggccccaaaccccgtaacttcgttaacccc

SEQ ID NO: 326784 - DNA, 494 bp, Homo sapiens
  misc_feature: GZ8MTXP01BTT4W.44.39.D06.1.454.CMB.2.raw
  modified_base (200)..(200): a, c, t, g, unknown or other
  misc_feature (200)..(200): n is a, c, g, or t
  modified_base (212)..(212): a, c, t, g, unknown or other
  misc_feature (212)..(212): n is a, c, g, or t
  modified_base (350)..(350): a, c, t, g, unknown or other
  misc_feature (350)..(350): n is a, c, g, or t
  modified_base (422)..(422): a, c, t, g, unknown or other
  misc_feature (422)..(422): n is a, c, g, or t
  modified_base (427)..(427): a, c, t, g, unknown or other
  misc_feature (427)..(427): n is a, c, g, or t
  modified_base (457)..(457): a, c, t, g, unknown or other
  misc_feature (457)..(457): n is a, c, g, or t
  modified_base (473)..(473): a, c, t, g, unknown or other
  misc_feature (473)..(473): n is a, c, g, or t
  modified_base (482)..(482): a, c, t, g, unknown or other
  misc_feature (482)..(482): n is a, c, g, or t
  modified_base (487)..(487): a, c, t, g, unknown or other
  misc_feature (487)..(487): n is a, c, g, or t
  modified_base (494)..(494): a, c, t, g, unknown or other
  misc_feature (494)..(494): n is a, c, g, or t
tcagacagtatatacacgaccggtgctcgatttagtgacatctcgcagttctttggggaggaactgctcagttaggacccagagggaaccatggaagccccagctcagcttctcttcctcctgctactctggctcccagagatcaccggagatattgtgttgacacagtctccaggcaccctgtctttgctccagggganagagccaccctntcctgtaggccagtcggatgttgctaagtcctagcctggtacaacagaaacctggccaggctccaggctcctcatctatgatgcatccaacagggtcactggcaccccagacaggttcagtggcagtgggctgggacngacttcactctcacgtcagcaatgtacagcctgaagtattttgctagtttatactgtcaggtcagcttctcnggccnctcacgttcggcgggggaccaagggtgagntcgagacgaacttggngctgcaacntcttntcttcgn

SEQ ID NO: 326785 - DNA, 672 bp, Homo sapiens
  misc_feature: GZ8MTXP01AP6EB.44.39.D06.1.454.CMB.2.raw
  modified_base (262)..(262): a, c, t, g, unknown or other
  misc_feature (262)..(262): n is a, c, g, or t
  modified_base (305)..(305): a, c, t, g, unknown or other
  misc_feature (305)..(305): n is a, c, g, or t
tcagacagtatatacacgaccggtgctcgatttagtgacatctcgcagttctttgggggagagacgagcccagcactggaagtcgccggtgtttccattcggtgatcatcactgaacacagaggactcaccatggagtttgggctgagctgggttttcctcgttgctcttttaagaggtgtccagtgtcaggagcacttggtggagtcgtgggggaggcgtggtccaggcccgggagtccctgagctctcctgtgtagcctntgggttctcattcgatagtatttggttgctacgtggggtcccnccaggcctccgagggcgaagggggccgaggtgggtggcagtcatctcgacgagtggaagtgaagtaagttaattactcgaagtaccgtccggtaggaaacggggcctattccaacctatcctaccgaagaacgaaactaaactttacccgaaaagtaattagtacgtacttaggttaattttacggggaaactaaaagttcggaaaaccgtaggtaccggttaggaaacggttaaggtttacgaaccgtaacctacgtttctttaaggttttaacttacgtggttacggaccggggtaacgggggaccttaccggaaagggtaacgggttcgggaattaccgaattaaacgtaacttaacgtttaag

SEQ ID NO: 326786 - DNA, 615 bp, Homo sapiens
  misc_feature: GZ8MTXP01EEGMF.44.39.D06.1.454.CMB.2.raw
  modified_base (284)..(284): a, c, t, g, unknown or other
  misc_feature (284)..(284): n is a, c, g, or t
  modified_base (316)..(316): a, c, t, g, unknown or other
  misc_feature (316)..(316): n is a, c, g, or t
tcagacagtatatacacgaccggtgctcgatttagtgacatctcgcagttctttgggggagctacaacaggcaggcaggggcagcaagatggtgttgcagacccaggtcttcatttctctgttgctctggatctctggtgcctacggggacatcgtgatgacccagtctccagacttcctggccctgtctcgtgggcgagagggccaccatcaactgcacgtccagccagagttctttcacagctccagcaataggaactacttacttgaaccaacagaaaccngggcagccctcccagacctactctatttacgngggctagtccgtaacccgggaatcccgggggtcctcggaccgtattcgagtcggcaggcgggtctggggactagtactttcacttctacaccatcagcagtccctgcgaggctagaagtagttggtagggggttctttaggttttaacttaccgtagtaaccaaacgtaaggtaactctaacttccctttccccttcccctttaattttccgttttacgggacccggttaaacgggggaacccctaaggccgttagggaacgtaactacgaaaacgtacgtggttcggtcttcgaaccc

SEQ ID NO: 326787 - DNA, 542 bp, Homo sapiens
  misc_feature: GZ8MTXP01C3MPO.44.39.D06.1.454.CMB.2.raw
  modified_base (203)..(203): a, c, t, g, unknown or other
  misc_feature (203)..(203): n is a, c, g, or t
  modified_base (264)..(264): a, c, t, g, unknown or other
  misc_feature (264)..(264): n is a, c, g, or t
  modified_base (367)..(367): a, c, t, g, unknown or other
  misc_feature (367)..(367): n is a, c, g, or t
  modified_base (387)..(387): a, c, t, g, unknown or other
  misc_feature (387)..(387): n is a, c, g, or t
  modified_base (446)..(446): a, c, t, g, unknown or other
  misc_feature (446)..(446): n is a, c, g, or t
  modified_base (453)..(453): a, c, t, g, unknown or other
  misc_feature (453)..(453): n is a, c, g, or t
  modified_base (485)..(485): a, c, t, g, unknown or other
  misc_feature (485)..(485): n is a, c, g, or t
tcagacagtatatacacgaccggtgctcgatttagtgacatctcgcagttctttgggggaggaactgctcagttaggacccagagggaaccatggaagccccagctcagcttctcttcctcctgctactctggctcccagagatcaccggagatattgtgttgacacagtctccaggcaccctgtctttgtctccgagggganagagccacctctcctgtagggccaggtcggagtgttgctaagtcctagcctaggtaccaanagaaacctggccaggctccaggctcctcatctatgatgcatccaaacagggtcaacgtggccaccccagaccgaggttcaggtggcaggtgggtctagggacnggaccttcactctcaccgtnacgcaatgtacagcctagaagtattttgactagttattactgtcaggtcagtcgttccncgagccnctcacgttcggggcggggaccaagggtggagngtacgaggtacgaacgttggcgggctggctaaccgtatcttcgtaacctttcgtaac

SEQ ID NO: 326788 - DNA, 563 bp, Homo sapiens
  misc_feature: GZ8MTXP01C1SJ4.44.39.D06.1.454.CMB.2.raw
  modified_base (190)..(190): a, c, t, g, unknown or other
  misc_feature (190)..(190): n is a, c, g, or t
  modified_base (223)..(223): a, c, t, g, unknown or other
  misc_feature (223)..(223): n is a, c, g, or t
  modified_base (235)..(235): a, c, t, g, unknown or other
  misc_feature (235)..(235): n is a, c, g, or t
  modified_base (321)..(321): a, c, t, g, unknown or other
  misc_feature (321)..(321): n is a, c, g, or t
  modified_base (381)..(381): a, c, t, g, unknown or other
  misc_feature (381)..(381): n is a, c, g, or t
tcagacagtatatacacgaccggtgctcgatttagtgacatctcgcagttctttgggggggtcacaagaggcagcgctctcgggacgtctccaccatggcctgggctctgctgctcctcactctcctcacccaggacacagggtcctgggcccagtctgccctgactcagcctgcctcgtgtctgggtcncctggacagtcggtcacatctcctgcactgganccagcggtaatnttcttagtcttaactttgtctcctggtatcaacatcatccaggtaaacgccccaaactcatcatctatgagcctataagagccctnaggggtttctaatccgcttcactgcctccaagtccgacaacacggcctcctgacatctcnggctcagctgagacgaggctgattattattggttgcttacagtattgttcgtcgactattctaacttagtgttcttcgggaaaggttcgggaccgtaaagggtccttaaacccggttccgttaacggggttccaacggccccgaaacgggaccccaaaaccccctaacgttcggttaacccc

SEQ ID NO: 326789 - DNA, 744 bp, Homo sapiens
  misc_feature: GZ8MTXP01AKWX2.44.39.D06.1.454.CMB.2.raw
  modified_base (242)..(242): a, c, t, g, unknown or other
  misc_feature (242)..(242): n is a, c, g, or t
tcagacagtatatacacgaccggtgctcgatttagtgacatctcgcagttctttgggggagctacaacaggcaggcaggggcagcaagatggtgttgcagacccaggtcttcatttctctgttgctctggatctctggtgcctgcggggacatcgcgatgagccagtctcagactccctggctgtgtctcgtgggcgagacgggccaccgtcaactgacaactccagaccaagtgtctttancgtacccaatagtaagaactattacgcctagtaccaacgagaaaccggacagtctacctaaattctctttagtggctatctacgtcgggtagtcccgggtcctgaccgtattcgaggtcgggccggtcgggtacgtacggggaactacgtacgtttaccaccttcctaccgaacctataccgtaaggttaaccgcccgttcggacgtaacgggtcccgttaggaaaacggtaccgggttcgggtaccgtttaaaggttttaagtttaacgtttacggggttaaacctaaaacgttaaatttaaacgtttttaaaccgtaacccttaccttaacgttacccgttaaccggttttcccgggggaaccgggtaacgggtaacccgtaaggtaaacgggttaaggaaacggttaacgttaaacccggaaaaacgttaccgttagggttacgggtaacctacggtaaccctaacctagttccgtttaacggttaacccgttaacccg

SEQ ID NO: 326790 - DNA, 585 bp, Homo sapiens
  misc_feature: GZ8MTXP01DAMYA.44.39.D06.1.454.CMB.2.raw
  modified_base (236)..(236): a, c, t, g, unknown or other
  misc_feature (236)..(236): n is a, c, g, or t
  modified_base (467)..(467): a, c, t, g, unknown or other
  misc_feature (467)..(467): n is a, c, g, or t
  modified_base (491)..(491): a, c, t, g, unknown or other
  misc_feature (491)..(491): n is a, c, g, or t
  modified_base (559)..(559): a, c, t, g, unknown or other
  misc_feature (559)..(559): n is a, c, g, or t
  modified_base (564)..(564): a, c, t, g, unknown or other
  misc_feature (564)..(564): n is a, c, g, or t
  modified_base (568)..(568): a, c, t, g, unknown or other
  misc_feature (568)..(568): n is a, c, g, or t
  modified_base (573)..(573): a, c, t, g, unknown or other
  misc_feature (573)..(573): n is a, c, g, or t
  modified_base (582)..(582): a, c, t, g, unknown or other
  misc_feature (582)..(582): n is a, c, g, or t
  modified_base (585)..(585): a, c, t, g, unknown or other
  misc_feature (585)..(585): n is a, c, g, or t
tcagacagtatatacacgaccggtgctcgatttagtgacatctcgcagttctttggggggcgggagtcagacccagtcaagacacagcgtggacatgagggtccccgctcagctcctggggctcctgctgctctggctcccaggtgccgactgtgccgtccagatgacccagtcctccttccaccctgtctgcgtctcgtgggcacagagtcaccatcacttgccgggcagtgagngtggctggatggctggtatacgaaggaaaacggcccgggacggtaccccaagtcctccgtggtacctaataaccgtccttacttaattttacgaactaggtttcgggggtacccttacgtaaggttcaggtggacaaggtaaacgtcgtgggtactactatttcctctctcaactatacaagtcggacctgacagtcctagatgttatttcgccgtactacttcgcgccanctaacttatttaacttcgtttccncccgtgtcccggttcgggacccgggtactagttcgtacgtaccctaacgaaacgttactgcgctcgcnccttntctntctcncttcctccnctn

SEQ ID NO: 326791 - DNA, 554 bp, Homo sapiens
  misc_feature: GZ8MTXP01BOSZ5.44.39.D06.1.454.CMB.2.raw
tcagacagtatatacacgaccggtgctcgatttagtgacatctcgcagttctttggggggggtcacaagaggcagcgctctcgggacgtctccaccatggcctgggctctgctgctcctcactctcctcactcaggacacagggtcctgggcccagtctgccctgactcagcctgcctccgtgtctggttctcctggacagtcgatcaccatctcctgcactgggtccagcaatgacattgggagatataaccttgtctcctggtatcaacaacatccaggcaaacgcccccaaactcatactttttgagtccagtgagcggccgtcaggtcgtttctaatcgcttctctggctccaagtctggcccacacggccctccctgtcgatctctgggcctccggcctgaggacgaggctgactattactgcggctcatttacaacttcttgagtaccgttggggtaagtttcgggcgggtacgggactcgaaccgttcggacccgttcccgtaagggtccaacggaccccaagggcctccgttccccccgttccggg

SEQ ID NO: 326792 - DNA, 548 bp, Homo sapiens
  misc_feature: GZ8MTXP01ED6HJ.44.39.D06.1.454.CMB.2.raw
  modified_base (244)..(244): a, c, t, g, unknown or other
  misc_feature (244)..(244): n is a, c, g, or t
  modified_base (380)..(380): a, c, t, g, unknown or other
  misc_feature (380)..(380): n is a, c, g, or t
  modified_base (528)..(528): a, c, t, g, unknown or other
  misc_feature (528)..(528): n is a, c, g, or t
tcagacagtatatacacgaccggtgctcgatttagtgacatctcgcagttctttgggggagctacaacaggcaggcaggggcagcaagatggtgttgcagacccaggtcttcatttctctgttgctctggatctctggtgcctggcggggacatcgcgatgagccagtctccagacctccctggctgtgtctcgtgggcgagacgggccaccgtcaactgcaactcagccaaagtgttctttancgtccccaatagtaagaactattagcctggtaaccaacagaaccggacagtctacctaaattactctttatggctatctacgtcgggagtccggtcctgacgtctcagtggcggcggtctgggcactattcactcncacatcagtagcctgccaggcctagaacgacgtggactagtttattagtttcgggtactaaactaatttaactttaacgaaccttccttatactacgtttcgggacggaggaccaaggagttagagatacgaaacgaacgttgagctncgaccattctgttcttaacc

SEQ ID NO: 326793 - DNA, 561 bp, Homo sapiens
  misc_feature: GZ8MTXP01EM75W.44.39.D06.1.454.CMB.2.raw
  modified_base (300)..(300): a, c, t, g, unknown or other
  misc_feature (300)..(300): n is a, c, g, or t
  modified_base (317)..(317): a, c, t, g, unknown or other
  misc_feature (317)..(317): n is a, c, g, or t
  modified_base (544)..(544): a, c, t, g, unknown or other
  misc_feature (544)..(544): n is a, c, g, or t
tcagacagtatatacacgaccggtgctcgatttagtgacatctcgcagttctttgggggagctacaacaggcaggcagggggcagcaagatggtgttacagacccaggtcttcatttctctgttgctctggatctctggtgcctgcggggacatcgcgatgagccagtctccagactccctggctgtgtctcgtgggcgaggagggccaccgtcaactgacaactccagaccaaagtgttcttttatcgtaccccaaatagtaagaactattacgcctaggtaccaaacagaaaccgganagtctactaaattactntttatggactatctacgtcgggacgtcccggggtcctgaccgtattccgaggtgggcggtcgggtctacggggactaacgtatttccacttctacaccatcagtagcctgacaggctaggaacgtacggtggactagtttattattgtactaaataattatttagaactctatctacgtttcggcggaggcaggaagtagagattacgaaacgacttgttgctgacnctatcttacgtcttctc

SEQ ID NO: 326794 - DNA, 536 bp, Homo sapiens
  misc_feature: GZ8MTXP01B32AC.44.39.D06.1.454.CMB.2.raw
  modified_base (244)..(244): a, c, t, g, unknown or other
  misc_feature (244)..(244): n is a, c, g, or t
tcagacagtatatacacgaccggtgctcgatttagtgacatctcgcagttctttggggggagctacaacaggcaggcaggggcagcaagatggtgttgcagacccaggtcttcatttctctgttgctctggatctctggtgcctggcggggacatcgcgatgagccagtctccagactccctggctgtgtctcgtgggcgagcgggccaccgtcaactgcaactccagccaaagtgtcttttancgtaccccaatagtaagaactattagcctaggtaaccaacaggaaaccgggacagtcctacctaaattactcttttatggctatctacgtcgggacgtcccgggtcctgaccgtacttcgaggtggcgggtcgggtctgggcactagtttccactctacacatcagtacgctgcaggctaggaacgagtgctagtttattattggtactaaataattattagaactctatcacgttcggcgaggcaagagttagagatacaaagacgttgacgctgcaccattcgtgttctc

SEQ ID NO: 326795 - DNA, 689 bp, Homo sapiens
  misc_feature: GZ8MTXP01EON8W.44.39.D06.1.454.CMB.2.raw
  modified_base (203)..(203): a, c, t, g, unknown or other
  misc_feature (203)..(203): n is a, c, g, or t
  modified_base (215)..(215): a, c, t, g, unknown or other
  misc_feature (215)..(215): n is a, c, g, or t
tcagacagtatatacacgaccggtgctcgatttagtgacatctcgcagttctttgggggaggaactgctcagttaggacccagagggaaccatggaagccccagctcagcttctcttcctcctgctactctggctcccagagatcaccggagatattgtgttgacacagtctccaggcaccctgtctttgtctccgagggganagagccaccctntcctggtacgggccagtcggagtgttgctaagtacctagcctaggtaccaacagaaacctggccaggcctcccgaggctcctcatctatgatgcataccaaacgagggtccacgtcggaccaacccccgagacgtaggttccaggtcggactagggtcggggtccgtaagggggaaccctaaggtaccctttcgaacctttcctaccgaacccggttcaacgactaaagtcgtaaacgagtccctaggtaaacgttattttaggtacttaagttttattacgttagtacgtacgggtacgtaacggttccgttccgttacccgacgggtcccgtccgttaccgttaccggtttccgggggaccggggggtaaccgaaagggggttcgggaaggttacgtacgaacggtaaccgtaacggttcggttcgggccgtggaccgtaaccctagtcttacgttccgtttccgtaacccg

SEQ ID NO: 326796 - DNA, 566 bp, Homo sapiens
  misc_feature: GZ8MTXP01A0A4I.44.39.D06.1.454.CMB.2.raw
  modified_base (396)..(396): a, c, t, g, unknown or other
  misc_feature (396)..(396): n is a, c, g, or t
  modified_base (493)..(493): a, c, t, g, unknown or other
  misc_feature (493)..(493): n is a, c, g, or t
tcagacagtatatacacgaccggtgctcgatttagtgacatctcgcagttctttggggggggtcacaagaggcagcgctctcgggacgtctccaccatggcctgggctctgctgctcctcactctcctcactcaggacacagggtcctgggcccagtctgccctgactcagcctgcctccgtgtctggttctcctggacagtcgatcaccatcctcctgcactgggtccagcaatgacagttgggagatataacttgtctcctggtatcaacaacatccaggaccaaacgcccccaaacttctaattactttttgacgtccagtggagccggccgtcgtaggttctttactatcgtcttctctcggctcaagtctggccacgacgccctcctgtcntcgtcgtgggcctccggctcggacggacgaggctacggacttatacgtcgcggtctctatttacaacttcgttgacgtcgttggggtcggttcgggngggtacgggttactccgtacgttcgttacccgttcgtggtcaacggtaccccagggcctccggccccgttcgg

SEQ ID NO: 326797 - DNA, 551 bp, Homo sapiens
  misc_feature: GZ8MTXP01D0WLT.44.39.D06.1.454.CMB.2.raw
  modified_base (244)..(244): a, c, t, g, unknown or other
  misc_feature (244)..(244): n is a, c, g, or t
  modified_base (293)..(293): a, c, t, g, unknown or other
  misc_feature (293)..(293): n is a, c, g, or t
tcagacagtatatacacgaccggtgctcgatttagtgacatctcgcagttctttgggggagctacaacaggcaggcaggggcagcaagatggtgttgcagacccaggtcttcatttctctgttgctctggatctctggtgcctgcggggacatcgcgatgagccagtctccagacctccctggctgtgtctctgggcgagagggccaccgtcaaactgacaactccagccaaagtgtcttttangtccccaatagtaagaactatttagcctggtaaccaacagaaaccgganagtctactaaattactcttttatggctatctactcgggacgtccgggtcctgaccgtattcagtggcggcggtctgggcactatttcactctcaccatcagtagcctgcaggctagaagcgtggactagtttattacttgtacaaactaattatttaacgactcctatactactttcggcggtaggcaagtagttagaagttataacgaaacgaacgttggttggtaacctgcctaacattcgttcgttctttaaccg

SEQ ID NO: 326798 - DNA, 520 bp, Homo sapiens
  misc_feature: GZ8MTXP01CDE3Q.44.39.D06.1.454.CMB.2.raw
  modified_base (202)..(202): a, c, t, g, unknown or other
  misc_feature (202)..(202): n is a, c, g, or t
  modified_base (289)..(289): a, c, t, g, unknown or other
  misc_feature (289)..(289): n is a, c, g, or t
  modified_base (308)..(308): a, c, t, g, unknown or other
  misc_feature (308)..(308): n is a, c, g, or t
  modified_base (359)..(359): a, c, t, g, unknown or other
  misc_feature (359)..(359): n is a, c, g, or t
  modified_base (371)..(371): a, c, t, g, unknown or other
  misc_feature (371)..(371): n is a, c, g, or t
  modified_base (377)..(377): a, c, t, g, unknown or other
  misc_feature (377)..(377): n is a, c, g, or t
  modified_base (397)..(397): a, c, t, g, unknown or other
  misc_feature (397)..(397): n is a, c, g, or t
tcagacagtatatacacgaccggtgctcgatttagtgacatctcgcagttctttgggggaggaactgctcagttaggacccagagggaaccatggaagccccagctcagcttctcttcctcctgctactctggctcccagagatcaccggagatattgtgttgacacagtctccaggcaccctgtctttgtctccagggganagagccaccctctcctgtagggccagtcggagtgttgctaagtaccagcctggtaccaacagaaacctggccaggctcccaggctcncatctatgatgcatccaangggtcactggccaccccagaccaggttcagtggcaggtggtctaggggacnggacttcactcncacgtnagcaatgtacagcctgaatntttgctagttatactgtctaggcagtcgtcctacgcgccgctcacgttcgggacgggggtaccagggtggagagtcgagacgacgttggttcgacgtgcaactacgtcttcgtcttcgtaacc

SEQ ID NO: 326799 - DNA, 637 bp, Homo sapiens
  misc_feature: GZ8MTXP01BS462.44.39.D06.1.454.CMB.2.raw
  modified_base (243)..(243): a, c, t, g, unknown or other
  misc_feature (243)..(243): n is a, c, g, or t
  modified_base (258)..(258): a, c, t, g, unknown or other
  misc_feature (258)..(258): n is a, c, g, or t
  modified_base (289)..(289): a, c, t, g, unknown or other
  misc_feature (289)..(289): n is a, c, g, or t
tcagacagtatatacacgaccggtgctcgatttagtgacatctcgcagttctttgggggagctacaacaggcaggcaggggcagcaagatggtgttgcagacccaggtcttcatttctctgttgctctggatctctggtgcctggcggggacatcgcgatgagccagtctccagacctccctggctgtgtctcgtgggcgagagggccaccgtcaactgcaactccagccaaagtgtctttancgtcccaatagtaanaactattagcctaggtaccaacagaaccggnagtctactaattctctttatggctatctacgtcgggagtccggggtcctgaccgtattcgaggtcgggccgggcggtacgtcgggaactactaacgtttccacttcctacgacctataccagttacgcccgtgcgaggtcctaggaacgtacggtaggtcctaggttttaacttagttcggttactaaacctaaatttacgttttaacgaacctttcccgtaattaccgtaacggttttcgggaacgggtacgggaacccgtaagggtaacggttaagaaggttactaaccgtaaaacgacgttcggttaggccttaggcctaaccctagttcttcgttcgttaaccc

SEQ ID NO: 326800 - DNA, 536 bp, Homo sapiens
  misc_feature: GZ8MTXP01DKSMY.44.39.D06.1.454.CMB.2.raw
  modified_base (226)..(226): a, c, t, g, unknown or other
  misc_feature (226)..(226): n is a, c, g, or t
  modified_base (238)..(238): a, c, t, g, unknown or other
  misc_feature (238)..(238): n is a, c, g, or t
  modified_base (267)..(267): a, c, t, g, unknown or other
  misc_feature (267)..(267): n is a, c, g, or t
  modified_base (271)..(271): a, c, t, g, unknown or other
  misc_feature (271)..(271): n is a, c, g, or t
tcagacagtatatacacgaccggtgctcgatttagtgacatctcgcagttctttggggggggtcacaagaggcagcgctctcgggacgtctccaccatggcctgggctctgctgctcctcactctcctcacccaggacacagggtcctgggcccagtctgtcctgactcagcctgcctccgtgtctgggtcgcctggacagtcggtcaccatctcctgcactgganccagcggtaatnttcttagtcttaactttgtctcctggtancaantcatccaggtaaagcccccaaatcatcatctatgagcctataagaggccctcaggggtttctaatccgcttcactgccctaccaacgtccggacaaccacggccctccctgacaatctctgggctccaggctagaggacgaggctgatttattatttggttgctcgagtattgttcgtcgactattcacttatgtcttcggaagtcgggactaaggtccaccgttcttaggtcacgcccaacggcccaacccgtcttcgtaaccc

SEQ ID NO: 326801 - DNA, 538 bp, Homo sapiens
  misc_feature: GZ8MTXP01CSKYK.44.39.D06.1.454.CMB.2.raw
  modified_base (222)..(222): a, c, t, g, unknown or other
  misc_feature (222)..(222): n is a, c, g, or t
  modified_base (267)..(267): a, c, t, g, unknown or other
  misc_feature (267)..(267): n is a, c, g, or t
  modified_base (282)..(282): a, c, t, g, unknown or other
  misc_feature (282)..(282): n is a, c, g, or t
  modified_base (320)..(320): a, c, t, g, unknown or other
  misc_feature (320)..(320): n is a, c, g, or t
tcagacagtatatacacgaccggtgctcgatttagtgacatctcgcagttctttgggggtcacaagaggcagcgctctcgggacgtctccaccatggcctgggctctgctgctcctcactctcctcacccaggacacagggtcctgggcccagtctgccctgactcagcctgcctccgtgtctggtcgcctggacagtcggtcaccatctcctgcactgganccagcggtaatattcttagtcttaactttgtctcctggtatcaanatcatccagtaaacncccccaaatcatcatctatgagcctataagaggccctnaggggtttctaatccgcttcactgcctacaagtccgcaacacggcctcctgacatctctggctcaggctgaggacgaggctgatttattattggttcgacttcagtatgttcgtcgcatctacttatgtccttgggaaagttcgggaccgtaaaggtccaacccggttcacgggttccacggccccaaacgggccccaaaacccctcgttcgtaaccc

SEQ ID NO: 326802 - DNA, 559 bp, Homo sapiens
  misc_feature: GZ8MTXP01CHTY3.44.39.D06.1.454.CMB.2.raw
  modified_base (191)..(191): a, c, t, g, unknown or other
  misc_feature (191)..(191): n is a, c, g, or t
  modified_base (224)..(224): a, c, t, g, unknown or other
  misc_feature (224)..(224): n is a, c, g, or t
  modified_base (236)..(236): a, c, t, g, unknown or other
  misc_feature (236)..(236): n is a, c, g, or t
  modified_base (262)..(262): a, c, t, g, unknown or other
  misc_feature (262)..(262): n is a, c, g, or t
  modified_base (282)..(282): a, c, t, g, unknown or other
  misc_feature (282)..(282): n is a, c, g, or t
  modified_base (550)..(550): a, c, t, g, unknown or other
  misc_feature (550)..(550): n is a, c, g, or t
tcagacagtatatacacgaccggtgctcgatttagtgacatctcgcagttctttggggggggtcacaagaggcagcgctctcgggacgtctccaccatggcctgggctctgctgctcctcactctcctcacccaggacacagggtcctgggcccagtctgccctgactcagcctgcctccgtgtctggtcncctggacagtcggtcacatctcctgcactgganccagcggtaatnttcttagtcttaacttgtctctgtancaacatcatcaaggtaaacnccccaaatcatcatctatgagcctaataagaggccctgtagggtttactaatccgtcttcactcgccctaccaacgtccgactaacaccggccctacctcgacaaactctcgtcgggctccgaggctagacggacgaggctagtattattattggtgtcttcagtattgttcgtcacacttctacttatgttcgttacggaaggttcgggaacgtaaacggtcgttacccgttcttacgggtcacgcccaaacggcccaaaccccgtnttcgtaacc

SEQ ID NO: 326803 - DNA, 563 bp, Homo sapiens
  misc_feature: GZ8MTXP01CR13V.44.39.D06.1.454.CMB.2.raw
  modified_base (192)..(192): a, c, t, g, unknown or other
  misc_feature (192)..(192): n is a, c, g, or t
  modified_base (226)..(226): a, c, t, g, unknown or other
  misc_feature (226)..(226): n is a, c, g, or t
  modified_base (238)..(238): a, c, t, g, unknown or other
  misc_feature (238)..(238): n is a, c, g, or t
  modified_base (481)..(481): a, c, t, g, unknown or other
  misc_feature (481)..(481): n is a, c, g, or t
tcagacagtatatacacgaccggtgctcgatttagtgacatctcgcagttctttggggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactgganccagcggtaatnttcttagttcttaactttgtctcctggtatcaacatcaatccaggtaaacacccccaaatcatcatctatgaggcctaataagaggtcccctcgtaaggggtttctaatcccgtcttcactcgccctaaccaacgtccggacaaacgaccggtccctccctgacaactctcgtcgggctcgaggcctaggacgggacgaggcttagtatttattattgggttagtctcaggtattgtcgttcnctatcctattatggttcttacgggagttcggactaaggtcaccgttcttaggtcacgccaacggcccaccctaagttcgtcc

SEQ ID NO: 326804 - DNA, 623 bp, Homo sapiens
  misc_feature: GZ8MTXP01BKXLY.44.39.D06.1.454.CMB.2.raw
  modified_base (192)..(192): a, c, t, g, unknown or other
  misc_feature (192)..(192): n is a, c, g, or t
  modified_base (226)..(226): a, c, t, g, unknown or other
  misc_feature (226)..(226): n is a, c, g, or t
  modified_base (238)..(238): a, c, t, g, unknown or other
  misc_feature (238)..(238): n is a, c, g, or t
  modified_base (264)..(264): a, c, t, g, unknown or other
  misc_feature (264)..(264): n is a, c, g, or t
tcagacagtatatacacgaccggtgctcgatttagtgacatctcgcagttctttggggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactgganccagcggtaatnttcttagtcttaattgtctcctgtancaacatcatccaaggtaaacgacccccaaactcatcatctatgagtcctaataagacggccctagtacggggtttctaatccgcttcactcgccctaccaacgtcccggacaaaccgaccggtccctcccgtagaacctaatcctcgttcgggcctccgaaggcgtaggaggacgaggtctaggtaatttattagtttggttcgtctacgagtagttcgttcgtcgtcctattcctactttatggttaaccgttacgggttaagggttacgggaaaccgtaaagggttcccacccggttccgttaacgggtcccacggtaaccccaacgggaccccaaccccgtcgttaaccgtaaccc

SEQ ID NO: 326805 - DNA, 519 bp, Homo sapiens
  misc_feature: GZ8MTXP01DGBA1.44.39.D06.1.454.CMB.2.raw
  modified_base (225)..(225): a, c, t, g, unknown or other
  misc_feature (225)..(225): n is a, c, g, or t
  modified_base (237)..(237): a, c, t, g, unknown or other
  misc_feature (237)..(237): n is a, c, g, or t
  modified_base (266)..(266): a, c, t, g, unknown or other
  misc_feature (266)..(266): n is a, c, g, or t
  modified_base (286)..(286): a, c, t, g, unknown or other
  misc_feature (286)..(286): n is a, c, g, or t
  modified_base (403)..(403): a, c, t, g, unknown or other
  misc_feature (403)..(403): n is a, c, g, or t
  modified_base (423)..(423): a, c, t, g, unknown or other
  misc_feature (423)..(423): n is a, c, g, or t
  modified_base (512)..(512): a, c, t, g, unknown or other
  misc_feature (512)..(512): n is a, c, g, or t
tcagacagtatatacacgaccggtgctcgatttagtgacatctcgcagttctttgggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactgganccagcggtaatnttcttagtcttaactttgtctcctggtancaacatcatccaggtaaacnccccaaatcatactttttgagtccagtgagcggcgtcaggttgtttctaatcgcttctctggctccaaagtctggccacacggcctcctgtcgatctctcggctccgctgaggacgngctgactatactgcgggctnatttacactcttgagtacttgggtgttcgggcgagggaactcactgacgtcgtcttaggttcacgcccaggccttgcccccttggtccncgttccg

SEQ ID NO: 326806 - DNA, 551 bp, Homo sapiens
  misc_feature: GZ8MTXP01CLNNS.44.39.D06.1.454.CMB.2.raw
  modified_base (225)..(225): a, c, t, g, unknown or other
  misc_feature (225)..(225): n is a, c, g, or t
  modified_base (236)..(236): a, c, t, g, unknown or other
  misc_feature (236)..(236): n is a, c, g, or t
  modified_base (262)..(262): a, c, t, g, unknown or other
  misc_feature (262)..(262): n is a, c, g, or t
  modified_base (266)..(266): a, c, t, g, unknown or other
  misc_feature (266)..(266): n is a, c, g, or t
  modified_base (318)..(318): a, c, t, g, unknown or other
  misc_feature (318)..(318): n is a, c, g, or t
  modified_base (365)..(365): a, c, t, g, unknown or other
  misc_feature (365)..(365): n is a, c, g, or t
tcagacagtatatacacgaccggtgctcgatttagtgacatctcgcgagttcgtttggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctctgcactgganccagcgtaatnttctagtcttaacttgtctctggtancaantcatccaggtaagcccccaaatcatcatctatgaggctagtaagacggcctnaggggtttctaatccgcttcactgcctaaccaagtccggacaaaccncggcctccctagacaatctctgggctccgaggctgaggacgaggctgaattattattggttagcttcagtatgttcgctctatcctattatgtcgtttacggaagttcggggaacctaaaggggtccaaacccggttcttaggggtccacgccccgaagggccccaaaccccgtcttcggtaaccc

SEQ ID NO: 326807 - DNA, 582 bp, Homo sapiens
  misc_feature: GZ8MTXP01BXJV3.44.39.D06.1.454.CMB.2.raw
  modified_base (190)..(190): a, c, t, g, unknown or other
  misc_feature (190)..(190): n is a, c, g, or t
  modified_base (248)..(248): a, c, t, g, unknown or other
  misc_feature (248)..(248): n is a, c, g, or t
  modified_base (350)..(350): a, c, t, g, unknown or other
  misc_feature (350)..(350): n is a, c, g, or t
  modified_base (395)..(395): a, c, t, g, unknown or other
  misc_feature (395)..(395): n is a, c, g, or t
  modified_base (433)..(433): a, c, t, g, unknown or other
  misc_feature (433)..(433): n is a, c, g, or t
  modified_base (506)..(506): a, c, t, g, unknown or other
  misc_feature (506)..(506): n is a, c, g, or t
tcagacagtatatacacgaccggtgctcgatttagtgacatctcgcagttctttggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcgctcaccctctcctgcactggaactaatactgatgttaggaaaattntaaccttgtctcttggtaccaaagtatacccaggtaaaaccccccaaatccttactttaatgaaagtcaaataagccgccctggctatttctcatcgcttcncaggcctccaagtctggccaaaacacggctcgttagataatttcnggcctctgcctgacgcgagccgactattatgctgctanactagtgcgggttcctagtattgttgggtcttcggcggacggggcccgccttggaacccgtcttacgggtccncgaccccgaaggcccgttcgcccccccgttcgggtccaaccgtttccctcggtttcccccaacccgtttcccttcc

SEQ ID NO: 326808 - DNA, 623 bp, Homo sapiens
  misc_feature: GZ8MTXP01B8BKZ.44.39.D06.1.454.CMB.2.raw
  modified_base (226)..(226): a, c, t, g, unknown or other
  misc_feature (226)..(226): n is a, c, g, or t
  modified_base (266)..(266): a, c, t, g, unknown or other
  misc_feature (266)..(266): n is a, c, g, or t
tcagacagtatatacacgaccggtgctcgatttagtgacatctcgcagttctttggggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactgganccagcggtaatattcttagtcttaacttgtctcctggtancaacatcatccaggtaaacgccccaaactcatcatctatgaggtcctataagaggcccttgtaggggtttctaatccgcttcactcgccctaccaacgtcccggacaaaccgaccgggtccctccctacgaccaaacttcctacgtcggggcctccgaggctaggacgggacgagggcttagtatttaattatttgggttgtctacagtattcggttcgtcgtactattcctaactttagtgttccgttacgggaaagggttcggggaacccgaaagggttccccaacccggtttcgttacgggttccaaccggtccccgaaaacggccccttaaaacccctcgttcggttaacccc

SEQ ID NO: 326809 - DNA, 593 bp, Homo sapiens
  misc_feature: GZ8MTXP01DYZNZ.44.39.D06.1.454.CMB.2.raw
  modified_base (192)..(192): a, c, t, g, unknown or other
  misc_feature (192)..(192): n is a, c, g, or t
  modified_base (223)..(223): a, c, t, g, unknown or other
  misc_feature (223)..(223): n is a, c, g, or t
  modified_base (260)..(260): a, c, t, g, unknown or other
  misc_feature (260)..(260): n is a, c, g, or t
  modified_base (277)..(277): a, c, t, g, unknown or other
  misc_feature (277)..(277): n is a, c, g, or t
  modified_base (284)..(284): a, c, t, g, unknown or other
  misc_feature (284)..(284): n is a, c, g, or t
tcagacagtatatacacgaccggtgctcgatttagtgacatctcgcagttctttggggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcgtcacatctctgcactggancagcgtaatattcttagttcttaatttgtctctgtancaacatcatcagtaacnccccaancatcatctatgagcctaagtaagacggcctcgtaggggtttctaagtccgtcttacactcgcccttaaccaacgtcccggactaaaccgaccggccctaccctagaactaaactctcgtgggcctccgaggtcctaggaggtacgaggcttagtattagttatttgggttgtctacagtagttgttcgtcgtactatctactttagtgttaacgttcgggaaagttcggggaacctaagggttcttaaccggttccttaaggtaaccgaacgcccgaaacggccccttaaaacccctcttcgttaaccc

SEQ ID NO: 326810 - DNA, 562 bp, Homo sapiens
  misc_feature: GZ8MTXP01D2IA8.44.39.D06.1.454.CMB.2.raw
  modified_base (385)..(385): a, c, t, g, unknown or other
  misc_feature (385)..(385): n is a, c, g, or t
  modified_base (412)..(412): a, c, t, g, unknown or other
  misc_feature (412)..(412): n is a, c, g, or t
  modified_base (481)..(481): a, c, t, g, unknown or other
  misc_feature (481)..(481): n is a, c, g, or t
  modified_base (543)..(543): a, c, t, g, unknown or other
  misc_feature (543)..(543): n is a, c, g, or t
tcagacagtatatacacgaccggtgctcgatttagtgacatctcgcagttctttgggggagctacaacaggcaggcaggggcagcaagatggtgttgcagacccaggtcttcatttctctgttgctctggatctctggtgcctggcggggacatcgcgatgagccagtctccagacctcccgtggctgtgtctcgtgggcgagacgggccaccgtcaactgacaactccagacctaaagtgttacttttatcgtaccccaatagtaaagaactattagcctaggtaaccaacagaaaccggacagtctactaaattactcttttatggcatctacgtcgggtagtcccgggtcctgaccgtacttcgaggtggcgggcggtacgngggcatagttcactctcacatcagtanctgcaggctgaagcgtggacagtttattatggtacaaataattatttagaactctatactcgttcgggngtagggccaaggtagttaggagaattacgaaaacgttacgttggttaggctacgctaacccnttacgttcgttctttaacc

SEQ ID NO: 326811 - DNA, 547 bp, Homo sapiens
  misc_feature: GZ8MTXP01C7JHB.44.39.D06.1.454.CMB.2.raw
  modified_base (203)..(203): a, c, t, g, unknown or other
  misc_feature (203)..(203): n is a, c, g, or t
  modified_base (321)..(321): a, c, t, g, unknown or other
  misc_feature (321)..(321): n is a, c, g, or t
  modified_base (374)..(374): a, c, t, g, unknown or other
  misc_feature (374)..(374): n is a, c, g, or t
  modified_base (385)..(385): a, c, t, g, unknown or other
  misc_feature (385)..(385): n is a, c, g, or t
  modified_base (391)..(391): a, c, t, g, unknown or other
  misc_feature (391)..(391): n is a, c, g, or t
  modified_base (492)..(492): a, c, t, g, unknown or other
  misc_feature (492)..(492): n is a, c, g, or t
tcagacagtatatacacgaccggtgctcgatttagtgacatctcgcagttctttgggggaggaactgctcagttaggacccagagggaaccatggaagccccagctcagcttctcttcctcctgctactctggctcccagagatcaccggagatattgtgttgacacagtctccaggcaccctgtctttgtctccgagggganagacgcccacccttctcctggtacgggccaggtcggagtgttgctaagtacctagcctaggtaccaacagaaacctggccaggctcccaggcctcctcatctatgatgcactccaagngggtcacgtggaccaccccagacaggttcaggtggcaggtgggtctagggacngacttcactcncacgtnagacatgtacagctagaattatttgacttagttatctgtcaggtctagtccgttcctcgcggtccgctcgtcgttcggggacgggggtaccagggtggagntacgagtaacgtaacgttggttggctcgacctctactcgttgttccttcgtaacc

SEQ ID NO: 326812 - DNA, 719 bp, Homo sapiens
  misc_feature: GZ8MTXP01ELWB1.44.39.D06.1.454.CMB.2.raw
  modified_base (203)..(203): a, c, t, g, unknown or other
  misc_feature (203)..(203): n is a, c, g, or t
  modified_base (289)..(289): a, c, t, g, unknown or other
  misc_feature (289)..(289): n is a, c, g, or t
tcagacagtatatacacgaccggtgctcgatttagtgacatctcgcagttctttgggggaggaactgctcagttaggacccagagggaaccatggaagccccagctcagcttctcttcctcctgctactctggctcccagagatcaccggagatattgtgttgacacagtctccaggcaccctgtctttgtctccgagggganagacgccacctctcctggtacgggccagtcggagtgtgactaagtctagcctaggaccaacagaactgacaggctccaggcctccncatctatgatgactactaccaacgtcggtcaccgtcggaccaccccgagtacgtaggttacaggttgggacgtagggtcggggtacgtaaggggaactaacgtactttaccgaccttccgtacccgtaaccggtcaacgtaactaacgttcgtaaccgacgtaccgttaaggttaaacgtttacgtttttaggaccgttttaagttttacttaacgttacgtacgtaacggggttacgttacggttacccgtttaccccgaccggtaccgggtcccttaccgtttaccgggttacccgggtttaccgggggggaaccggggggttaaaccgtaagggggtccggaagttaaccggtacggacggtaacggtaacggttgggttcggcttcggacctaaccgtagttcgttacgttccgtttaaccgtccg

SEQ ID NO: 326813 - DNA, 629 bp, Homo sapiens
  misc_feature: GZ8MTXP01BEGNJ.44.39.D06.1.454.CMB.2.raw
  modified_base (202)..(202): a, c, t, g, unknown or other
  misc_feature (202)..(202): n is a, c, g, or t
  modified_base (313)..(313): a, c, t, g, unknown or other
  misc_feature (313)..(313): n is a, c, g, or t
  modified_base (366)..(366): a, c, t, g, unknown or other
  misc_feature (366)..(366): n is a, c, g, or t
tcagacagtatatacacgaccggtgctcgatttagtgacatctcgcagttctttgggggaggaactgctcagttaggacccagagggaaccatggaagccccagctcagcttctcttcctcctgctactctggctcccagagatcaccggagatattgtgttgacacagtctccaggcaccctgtctttgctccgagggganagagccaccctctcctgtagggccagtcggagtgtgctaagtacctagcctggtaccaacagaaacctggccaggctcccgaggctcctcatctatgatgcatccaaacgngggtcacgtggccaccccgagacaggttcagtggcaggtgggtctaggggacnggtacttcgactctacgaccgtcacgactaagtcgtaacacgtcctagaaacgttattttgacttagtttattacttgtacaaggggctacggttccgttccctaccgacgggtccccgtcgttaccgtaccggtttccgggggaccggggggtaacccgtaagggggtcgggaacggttacgttaccgaaacgggtaaccgtaaacggttcgggttcggttacgtcggactaaccgtacgtcgttacgttcttccgtaaccg

SEQ ID NO: 326814 - DNA, 523 bp, Homo sapiens
  misc_feature: GZ8MTXP01DHOG2.44.39.D06.1.454.CMB.2.raw
  modified_base (224)..(224): a, c, t, g, unknown or other
  misc_feature (224)..(224): n is a, c, g, or t
  modified_base (235)..(235): a, c, t, g, unknown or other
  misc_feature (235)..(235): n is a, c, g, or t
  modified_base (374)..(374): a, c, t, g, unknown or other
  misc_feature (374)..(374): n is a, c, g, or t
tcagacagtatatacacgaccggtgctcgatttagtgacatctcgcagttctttgggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcacatctcctgcactgganccagcgtaatnttcttagtcttaactttgtctcctggtatcaacatcatccaggtaaagccccaaactcatcatctatgaggcctataagagccctctaggggttctaatccgcttcactgcctccaagtccggacaacacggcctcccngacaatctctgggctccaggctgagacgaggctgattattatggttgctcagatgttcgcgctatctacttatgtcgttggaagttcgggacctaaagggtcaccggttccttaggtccagcccaaggcccaaccccaattcgtaaccc

SEQ ID NO: 326815 - DNA, 753 bp, Homo sapiens
  misc_feature: GZ8MTXP01C2PSM.44.39.D06.1.454.CMB.2.raw
  modified_base (206)..(206): a, c, t, g, unknown or other
  misc_feature (206)..(206): n is a, c, g, or t
  modified_base (310)..(310): a, c, t, g, unknown or other
  misc_feature (310)..(310): n is a, c, g, or t
  modified_base (331)..(331): a, c, t, g, unknown or other
  misc_feature (331)..(331): n is a, c, g, or t
tcagacagtatatacacgaccggtgctcgatttagtgacatctcgcagttctttgggggaggaactgctcagttaggacccagagggaaccatggaagccccagctcagcttctcttcctcctgctactctggctcccagagatcaccggagatattgtgttgacacagtctccaggccacccttgtctttgtctccgaggggganagacgcccaccctctcctggtacgggccaggtcggagttgttgacttaagtacctagccctaggtaaccaacaacgaaacctggccaggcctcccgaggctccncatctatgatgcactccaagngggtcacgtggaccaccccgagacgtaggttcaggtcggacgtaggtcggggtactaacgggggacaaggtacctttaccaaccctttccgtaccgaacccggttcaacggactaaacgttacggtaaccgacggtacccttaagggtaaacgtttagtttttcggtaacgtttaaaggttttaactttaacgttacgttaccgtaaggggtaccgttaacggttacccggttttccccgtacccggtaaccgggtccccgtcccgtttacccggttaccgggttttaccggggggaccggggggttaacccgtaaagggggtaagggtaacggttacgtaacgaacggtaaaccggtaacgttcgggttcgggttacgtccggtaccaaccgtacttcgttcgttaaccttccgttaaccg

SEQ ID NO: 326816 - DNA, 707 bp, Homo sapiens
  misc_feature: GZ8MTXP01AN62I.44.39.D06.1.454.CMB.2.raw
  modified_base (226)..(226): a, c, t, g, unknown or other
  misc_feature (226)..(226): n is a, c, g, or t
  modified_base (269)..(269): a, c, t, g, unknown or other
  misc_feature (269)..(269): n is a, c, g, or t
  modified_base (282)..(282): a, c, t, g, unknown or other
  misc_feature (282)..(282): n is a, c, g, or t
tcagacagtatatacacgaccggtgctcgatttagtgacatctcgcagttctttggggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactgganccagcggtaatattcttagtcttaacttgtctctgtatcaacntcatcagtaaacnccccaaatcatcatctatgagacctataacgagccctgtagggtttcaagtccgcttcactcgcctaccaaacgtccggacaaaccgacgggtcccctaccgtacgaactaaacttccgtcgttacggggccttaccccgaaggggtccttagggaacgggtaccggagggtccttaggttaactttaactttaaggtttacggggtttacgtccgtttccgtaaagggttactttcgggtttccggtccggtacttaacgttccttaaaccttttaagttcggttcccgtttaaggggttaaacgggtttacggggaacccgtaaacgggttccccgaacccggtttcccgttacggggttaaccaaccggtaacccccgtaacgggaccccttaacccccggttaacttccggtttaaccccg

SEQ ID NO: 326817 - DNA, 691 bp, Homo sapiens
  misc_feature: GZ8MTXP01BFBJL.44.39.D06.1.454.CMB.2.raw
  modified_base (225)..(225): a, c, t, g, unknown or other
  misc_feature (225)..(225): n is a, c, g, or t
  modified_base (236)..(236): a, c, t, g, unknown or other
  misc_feature (236)..(236): n is a, c, g, or t
  modified_base (263)..(263): a, c, t, g, unknown or other
  misc_feature (263)..(263): n is a, c, g, or t
  modified_base (267)..(267): a, c, t, g, unknown or other
  misc_feature (267)..(267): n is a, c, g, or t
  modified_base (288)..(288): a, c, t, g, unknown or other
  misc_feature (288)..(288): n is a, c, g, or t
tcagacagtatatacacgaccggtgctcgatttagtgacatctcgcagttctttggggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcatgganccagcgtaatnttcttagtcttaatttgtctcctgtancaanatcatcagtaaacgccccaancatcatctatgacggcctaataagacggccccttacgtaggggtttactaaacgtccgtccttacactcggtcccctaacccgaaacggttccccgggacaaacccgtacccgggaccccttccccgtaggtaaacctaaacttcccttacgtccggggtacctcccgtaaggtcgttacgggaacgggtacggaacgggtaccgttaggtaatttaagtttaagttgggtttaacggtccttacgtaaagtgttcgttccgggtacgacttatacctactttacgtggttaacgttaacgggaggttaccgggaaacgtaacggtaccgttacccggttcgttacggtcaacccggaacccgtaacccggaccccaaccccgttaacgttccggttaacccc

SEQ ID NO: 326818 - DNA, 592 bp, Homo sapiens
  misc_feature: GZ8MTXP01AVR7C.44.39.D06.1.454.CMB.2.raw
  modified_base (190)..(190): a, c, t, g, unknown or other
  misc_feature (190)..(190): n is a, c, g, or t
  modified_base (197)..(197): a, c, t, g, unknown or other
  misc_feature (197)..(197): n is a, c, g, or t
  modified_base (207)..(207): a, c, t, g, unknown or other
  misc_feature (207)..(207): n is a, c, g, or t
  modified_base (221)..(221): a, c, t, g, unknown or other
  misc_feature (221)..(221): n is a, c, g, or t
  modified_base (232)..(232): a, c, t, g, unknown or other
  misc_feature (232)..(232): n is a, c, g, or t
  modified_base (280)..(280): a, c, t, g, unknown or other
  misc_feature (280)..(280): n is a, c, g, or t
  modified_base (464)..(464): a, c, t, g, unknown or other
  misc_feature (464)..(464): n is a, c, g, or t
tcagacagtatatacacgaccggtgctcgatttagtgacatctcgcagttctttgggggggtcacaagaggcagcgctctcgggacgtctccaccatggcctgggctctgctgctcctcactctcctcacccaggacacagggtcctgggcccagtctgccctgactcagcctgcctcgtgtctgggtcnctggacngtcgtcaccntctctgcactgganccagcgtaatnttctagtcttaacttgtctcctggtatcaacatcatccaaggtaaacncccccaaatcatcatctatgaggcctataagacggtccctacgaggggtttctaatccgctttcactcgcctaaccaacgtccggcaaacacggccctcctgacaactctctgggcctccgaggctggaacggacgaggctaggatttatttatggtttgcttcgagtattgttcgttcgactntcctacgttagtgtcctttagggaacggttgggaaaccgtaaaggggttccaccccggtttcgttaaccgggttccaacggtaaccccgaacgggaccccttaaaacccccgtcgttcgttaaccccg

SEQ ID NO: 326819 - DNA, 539 bp, Homo sapiens
  misc_feature: GZ8MTXP01BIAL1.44.39.D06.1.454.CMB.2.raw
  modified_base (199)..(199): a, c, t, g, unknown or other
  misc_feature (199)..(199): n is a, c, g, or t
tcagacagtatatacacgaccggtgctcgatttagtgacatctcgcagttctttggggggggtcacaagaggcagcgctctcgggacgtctccaccatggcctgggctctgctgctcctcactctcctcactcaggacacagggtcctgggcccagtctgccctgactcagcctgcctcgtgtctggttctcctggacngtcgatcaccatctcctgcactgggtccagcaatgacattgggagatataaccttgctcctggtatcaacaacatccaggcaaacgcccccaaactcatacttttgagtccagtgagcggcgtcaggttcgtttctaatcgcttctctggctccaaagtctggccacaccggcctccctgtcgatctctgggcctccggcctgacggacgaggctggactattacgtgcggctcatttacaacttctgacgtacgttggggtgttcgggcgggaggacgtcgaaccgttcggaccgttccgtaaggtcaacgcccgaaggttcctcggcccccgttccgg

SEQ ID NO: 326820 - DNA, 767 bp, Homo sapiens
  misc_feature: GZ8MTXP01BUF9M.44.39.D06.1.454.CMB.2.raw
  modified_base (182)..(182): a, c, t, g, unknown or other
  misc_feature (182)..(182): n is a, c, g, or t
  modified_base (247)..(247): a, c, t, g, unknown or other
  misc_feature (247)..(247): n is a, c, g, or t
  modified_base (363)..(363): a, c, t, g, unknown or other
  misc_feature (363)..(363): n is a, c, g, or t
tcagacagtatatacacgaccggtgctcgatttagtgacatctcgcagttctttgggggagctacaacaggcaggcaggggcagcaagatggtgttgcagacccaggtcttcatttctctgttgctctggatctctggtgcctggcggggacatcgcgatgagccagtctccagacctcccnggctgtgtctcgtgggcgaggacgggccaccgtcaactgacaactcagaccaaagtgttctttancgtacccaatagtaagactattacgctaggtaaccaacgacgaaccggacagtacctacctaaattacttcttttagtggactatctacgtcgggtacgtccgggtcctgaccgtnttcgaggtcggacgggtcggtacgtagggaacagtactttacaccttcctaccaccctagttaccgtaaggtacgtccccttaggacccgtaaggggtaccgtttaagggaaacggtacccgggttagggtaccgtttaaacgggtttttaaactttagttttacggggtaaacccgttaaaacgtttaaaattttaaacgtttttaaacgtaaacccctttacctttaacgttaacccgtttaaccggttttacgggggacccgggaaacgggggttaacccaaagggtaaggttaaacggaaacgttaaacgttaaaccggaaaaacccgttaacggttggttaccggggtaaccttcggaaccctaaccctaagtttacccggttcgttttccttaacccg

SEQ ID NO: 326821 - DNA, 550 bp, Homo sapiens
  misc_feature: GZ8MTXP01E2V8T.44.39.D06.1.454.CMB.2.raw
  modified_base (406)..(406): a, c, t, g, unknown or other
  misc_feature (406)..(406): n is a, c, g, or t
tcagacagtatatacacgaccggtgctcgatttagtgacatctcgcagttctttgggggagctacaacaggcaggcaggggcagcaagatggtgttgcagacccaggtcttcatttctctgttgctctggatctctggtgcctgcggggacatcgcgatgagccagtctccagacctccctggctgtgtctcgtgggcgaggacgggccaccgtcaactgcaaactccagccaaagtgttcttttatcgtaccccaatagtaagaactattagcctgtaaccaacagaaaccggacagtctacctaaattacttcttttatgggctatctacgtcgggagtccgggtcctgaccgtacttcagtggcggcgggtctgggcactattcactctcacctatcagtacncctgccgaggctagaagcgtggctagtttattattggtacaactaattatttaagaacttcctatctacgttcggcggagggaccaaggaagttagagatacgaaaacgacgttgttggctggccacacttctcgttcttaacc

SEQ ID NO: 326822 - DNA, 581 bp, Homo sapiens
  misc_feature: GZ8MTXP01B4XMS.44.39.D06.1.454.CMB.2.raw
  modified_base (242)..(242): a, c, t, g, unknown or other
  misc_feature (242)..(242): n is a, c, g, or t
  modified_base (250)..(250): a, c, t, g, unknown or other
  misc_feature (250)..(250): n is a, c, g, or t
  modified_base (258)..(258): a, c, t, g, unknown or other
  misc_feature (258)..(258): n is a, c, g, or t
  modified_base (268)..(268): a, c, t, g, unknown or other
  misc_feature (268)..(268): n is a, c, g, or t
  modified_base (295)..(295): a, c, t, g, unknown or other
  misc_feature (295)..(295): n is a, c, g, or t
tcagacagtatatacacgaccggtgctcgatttagtgacatctcgcagttctttgggggggtcacaagaggcagcgctctcgggacgtctccaccatggcctgggctctgctgctcctcactctcctcactcaggacacagggtcctgggcccagtctgccctgactcagcctgcctcgtgtctggttctcctggacagtcgatcaccatctcctgcactgggtccagcaatgacatggganatatactnctctgtanacaacaacanacagacaaacacccaactacatacttntagtacagtgagcgcgtcgtagtcgttactatcgtctctctcgtctacctaacgtacgtcgaccgaccgacgtccctccctacgaccactctcgtcggcgtaccgtacgcgacggacggaacggacgtacgtacggtaacttaactaacgtacgacgacgactactaactaactaacgaaacgacgaacgaacgtaacgacctaacccttacgttacgttacgttacgttaacgttacgggtaacgaacggtaaccgtaccgtaccgttacgtaacgaacgaaccg

SEQ ID NO: 326823 - DNA, 648 bp, Homo sapiens
  misc_feature: GZ8MTXP01D9WDE.44.39.D06.1.454.CMB.2.raw
  modified_base (198)..(198): a, c, t, g, unknown or other
  misc_feature (198)..(198): n is a, c, g, or t
  modified_base (207)..(207): a, c, t, g, unknown or other
  misc_feature (207)..(207): n is a, c, g, or t
  modified_base (221)..(221): a, c, t, g, unknown or other
  misc_feature (221)..(221): n is a, c, g, or t
  modified_base (232)..(232): a, c, t, g, unknown or other
  misc_feature (232)..(232): n is a, c, g, or t
tcagacagtatatacacgaccggtgctcgatttagtgacatctcgcagttctttggggggggtcacaagaggcagcgctctcgggacgtctccaccatggcctgggctctgctgctcctcactctcctcacccaggacacagggtcctgggcccagtctgccctgactcagcctgcctccgtgtctggtcgctggacngtcgtcacntctctgcactgganccagcgtaatnttcttagtcttaactttgtctcctgtatcaacatcatccaaggtaaacgaccccaaatcatcatctatgaggcctataagacgcctcgtaggggtttctaatccgcttcactcgccctaaccgaaacgttcccgggacaaaccgacccgggtcccctcccctaggaaacctaaacgttccgtcgttcggggcccttccgaagggcgttagggaaggaccggagggtcctaggtatttaagtttagtttgggtttcgcttactaaggtgttcggtttcgtacgtactacttacctaactttagttcggttaacttacggggaggttacggggttaaccgtaaacggttcccgttaccgttccgttacggtccaacgaaccccgaaacggacccaacccctaacgttccgttaacccg

SEQ ID NO: 326824 - DNA, 509 bp, Homo sapiens
  misc_feature: GZ8MTXP01EFNQI.44.39.D06.1.454.CMB.2.raw
  modified_base (201)..(201): a, c, t, g, unknown or other
  misc_feature (201)..(201): n is a, c, g, or t
  modified_base (306)..(306): a, c, t, g, unknown or other
  misc_feature (306)..(306): n is a, c, g, or t
  modified_base (354)..(354): a, c, t, g, unknown or other
  misc_feature (354)..(354): n is a, c, g, or t
  modified_base (367)..(367): a, c, t, g, unknown or other
  misc_feature (367)..(367): n is a, c, g, or t
  modified_base (374)..(374): a, c, t, g, unknown or other
  misc_feature (374)..(374): n is a, c, g, or t
  modified_base (376)..(376): a, c, t, g, unknown or other
  misc_feature (376)..(376): n is a, c, g, or t
  modified_base (378)..(378): a, c, t, g, unknown or other
  misc_feature (378)..(378): n is a, c, g, or t
  modified_base (380)..(381): a, c, t, g, unknown or other
  misc_feature (380)..(381): n is a, c, g, or t
  modified_base (383)..(383): a, c, t, g, unknown or other
  misc_feature (383)..(383): n is a, c, g, or t
  modified_base (385)..(385): a, c, t, g, unknown or other
  misc_feature (385)..(385): n is a, c, g, or t
  modified_base (396)..(396): a, c, t, g, unknown or other
  misc_feature (396)..(396): n is a, c, g, or t
  modified_base (398)..(398): a, c, t, g, unknown or other
  misc_feature (398)..(398): n is a, c, g, or t
  modified_base (407)..(407): a, c, t, g, unknown or other
  misc_feature (407)..(407): n is a, c, g, or t
  modified_base (409)..(409): a, c, t, g, unknown or other
  misc_feature (409)..(409): n is a, c, g, or t
  modified_base (412)..(412): a, c, t, g, unknown or other
  misc_feature (412)..(412): n is a, c, g, or t
  modified_base (423)..(423): a, c, t, g, unknown or other
  misc_feature (423)..(423): n is a, c, g, or t
tcagacagtatatacacgaccggtgctcgatttagtgacatctcgcagttctttgggggaggaactgctcagttaggacccagagggaaccatggaagccccagctcagcttctcttcctcctgctactctggctcccagagatcaccggagatattgtgttgacacagtctccaggcaccctgtctttgctccagggganagagccacctctcctgtagggccagtcggatgttgctaaagtacctagcctggtaccaacagaaacctggccaggctccaggctctcatcatgatgcatccaaangggtcactggcaccccagacaggttcagtggcagtgggtctggggacnggacttcacttcncaccgtnananannanancagaagtattntntattatatntnagnagcgtcctccncgcgctctcgttcgggcgggggacggaaggtaaggagagtagagacgaacgttagttggcgtgcgaaccactcttcgttcgttctc

SEQ ID NO: 326825 - DNA, 552 bp, Homo sapiens
  misc_feature: GZ8MTXP01CU7S1.44.39.D06.1.454.CMB.2.raw
  modified_base (319)..(319): a, c, t, g, unknown or other
  misc_feature (319)..(319): n is a, c, g, or t
tcagacagtatatacacgaccggtgctcgatttagtgacatctcgcagttctttggggggggtcacaagaggcagcgctctcgggacgtctccaccatggcctgggctctgctgctcctcactctcctcactcaggacacagggtcctgggcccagtctgccctgactcagcctgcctcgtgtctggttctcctggacagtcgatcaccatctcctgcactgggtccagcaatgacagttgggagatataacttgctctgtatcaacaacatcaggcaaagcccccaaactcatacttttgagtccagtgagcgccgtnaggtgtttctaatcgtctctctggctcaagtctgccacacggcctcctgtcgatctctggctccggctgaggacgaggctgactattacgtgcggtctcatttacaacttcttgacgtacgttggggttaagtttcgggcgggtacgggttacgtccgaccgttcggttcccgttaccgtaagggttaccgaacggtccccgaaacgggccgttccggcccccgtttcccggg

SEQ ID NO: 326826 - DNA, 654 bp, Homo sapiens
  misc_feature: GZ8MTXP01B0XTC.44.39.D06.1.454.CMB.2.raw
  modified_base (211)..(211): a, c, t, g, unknown or other
  misc_feature (211)..(211): n is a, c, g, or t
  modified_base (466)..(466): a, c, t, g, unknown or other
  misc_feature (466)..(466): n is a, c, g, or t
tcagacagtatatacacgaccggtgctcgatttagtgacatctcgcagttcgtttggggggggtcacaagaggcagcgctctcgggacgtctccaccatggcctgggctctgctgctcctcactctcctcactcaggacacagggtcctgggcccagtctgccctgactcagcctgcctcgtgtctggttctcctggacagtcgatcaccntctcctgcacgtgggtccagcaatgacagttggagatataaccttgtctcctgtatcaacaacatccaggacaaacgacccccaaatctaattacttttagacgtaccagtgaggccggtccgtacgtaggttcgtttactaattcgtcttctctcggctcctaagtctcgccacaccggtccctccctgtccgtatcgtcgtcgggccttcccgggccgtcggagggcgacggtctacgacgttacgtttacgngccggtcttctaacttttacctaaaccgttcgttacggtacgttaaccggtttgggggttaacggttccggggttacgggtacggggttaccttcggtaaccccgttcgggttcccgttacccggtaacggttcccgaacggccccgtaaacgggttccccgttccccggttccccccgtttcccggg

SEQ ID NO: 326827 - DNA, 553 bp, Homo sapiens
  misc_feature: GZ8MTXP01DHF7B.44.39.D06.1.454.CMB.2.raw
  modified_base (243)..(243): a, c, t, g, unknown or other
  misc_feature (243)..(243): n is a, c, g, or t
  modified_base (289)..(289): a, c, t, g, unknown or other
  misc_feature (289)..(289): n is a, c, g, or t
  modified_base (541)..(541): a, c, t, g, unknown or other
  misc_feature (541)..(541): n is a, c, g, or t
tcagacagtatatacacgaccggtgctcgatttagtgacatctcgcagttctttgggggagctacaacaggcaggcaggggcagcaagatggtgttgcagacccaggtcttcatttctctgttgctctggatctctggtgcctgcggggacatcgcgatgagccagtctccagactccctggctgtgtctcgtgggcgagacgggccaccgtcaactgcaactccagaccaaagtgtctttancgtcccaatagtaagactattagcctggtaccaacagaaaccgganagtctacctaaattactcttttatggcatctacgtcgggtagtcccgggtcctgacccgtattcgagtggcggtcgggtcgtagggctactatttcactcctcacatcagtacgcctgcaggctacggaagacggtgctagtttattagttggtaactaactaattactttaagaacttcctattacgtaccgtttcggacggaggtaccaaggtaagttagagagtacaacgaacttgttggctgccacgnttactgttcttc

SEQ ID NO: 326828 - DNA, 857 bp, Homo sapiens
  misc_feature: GZ8MTXP01EMEK5.44.39.D06.1.454.CMB.2.raw
  modified_base (294)..(294): a, c, t, g, unknown or other
  misc_feature (294)..(294): n is a, c, g, or t
tcagacagtatatacacgaccggtgctcgatttagtgacatctcgcagttctttgggggaggaactgctcagttaggacccagagggaaccatggaagccccagctcagcttctcttcctcctgctactctggctcccagagatcaccggagatattgtgttgacacagtctccaggcaccctgtctttgtctccgaggggagagagcccaccctctccgtggtagggccaggtcggagtgtgctaagtcctagcctaggaccaacagaaacctggccaggctcccaggctccncatctatgatgcactacccaaacgtaggggtccaaccgtcgggacccaaccccccgaaggtaaccgtaacgggggttttccaaacggggtttcggggacctaagggggtttcggggggttcccgttaaggggggaaaccctaaggggtaaccctttttacccgaaacccgtttcccttacccggtaacccccggggtttcaaaacgggtaccctaaaaagtttacggggttaaaccaaccgggttaccccgttaaagggttaaaacggttttacgtttttttagggtaaccctttaaagggttttttaaactttaaccggtttagggttaccctaaggggtaccgtaacgggtttacccgttttccccgtaccccggtaaccggggtccccgtccgttacccggttaaccgggttttccggggggacccggggggggtaacccgtaaagggggttaaggggaaacggttacggttaccggaaacgggaaaccggtaaacggttgggttacggggccttaacggaccaacctacgttccgttcggttaaccctttcgtaacccg

SEQ ID NO: 326829 - DNA, 733 bp, Homo sapiens
  misc_feature: GZ8MTXP01AUOMK.44.39.D06.1.454.CMB.2.raw
  modified_base (192)..(192): a, c, t, g, unknown or other
  misc_feature (192)..(192): n is a, c, g, or t
tcagacagtatatacacgaccggtgctcgatttagtgacatctcgcagttctttggggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcgtcaccatctctgcactgagccagcgtaatattcttagtcttaactttgtcttctgtatcaacatcatccaggtaaacgacccccaaatcatctatctatgacgtacctaagtaacgacggcccttacgtaggggtttctaaacgtcccgtcttcactcgtccctaaccgaacgtcccggacaacccgaccggtcccctcccgtacgaactaactccgtcgtcgggcctccgacggtcgtacggaacgggaccggagggtccgttagtaaacgttttaatttaacgtttggggtttcgtaccgttccgtaaaggttctttacggtttccggttaccgtacgtaacgttaccgttaaccttttaagttcgggttaaccgtttacgggggaaaggggttaccggggttaaacccgtaaaccggggtttaacccgttaaccccgggttcccgtttaacggggtaacccgtaacccggaacccccgtaaaaccggggccccccttaaaacccccgtccgttccggttaaccccg

SEQ ID NO: 326830 - DNA, 715 bp, Homo sapiens
  misc_feature: GZ8MTXP01BNWYS.44.39.D06.1.454.CMB.2.raw
tcagacagtatatacacgaccggtgctcgatttagtgacatctcgcagttctttgggggggggtcacaagaggcagcgctctcgggacgtctccaccatggcctgggctctgctgctcctcactctcctcacccaggacacagggtcctgggcccagtctgccctgactcagcctgcctccgtgtctggtcgcctggacagtcggtcaccatctcctgcactggagccagtcggtaatattcttagtcttaactttgtctcctggtatcaacatcatccaggtaaacgacccccaaatcatcatctatgacgcctaagtaacgacgtccctacgtaggggtttactaacgtccgtcttcaactcgcccctaaccgaacgttcccggactaaccgaccggtccctaccccgtgaacctactccttcgcggtccctacgcgcgtacggaacggtagaccggtataggttaatttagttttacgtttggggttctccgtagtagttacgttcggttccggtagtacctacttaaccttacgtttacggttcgtttaacccggttaaggggttaacggggttacccggttaaaccggttaaaccgggttccccgttaaacccgggttccggttaaccggtaaccgtaacccccgggtaaacccgaaaccccgggtaacccccttaaaacccccgtccgggtttaacccgttaacccccg

SEQ ID NO: 326831 - DNA, 683 bp, Homo sapiens
  misc_feature: GZ8MTXP01DATHB.44.39.D06.1.454.CMB.2.raw
  modified_base (202)..(202): a, c, t, g, unknown or other
  misc_feature (202)..(202): n is a, c, g, or t
  modified_base (413)..(413): a, c, t, g, unknown or other
  misc_feature (413)..(413): n is a, c, g, or t
tcagacagtatatacacgaccggtgctcgatttagtgacatctcgcagttctttgggggaggaactgctcagttaggacccagagggaaccatggaagccccagctcagcttctcttcctcctgctactctggctcccagagatcaccggagatattgtgttgacacagtctccaggcaccctgtctttgctccgagggganagagccacctctcctgtaggccagtcggagtgttgcttaagtacctagcctaggtaaccaacagaaacctggccaggcctcccgaggcctcctacatctatgatcgactactacccaagacgggtcacgtcggaccaaccccgagacaggttcaggtcggcagggtgggtcgtaggggaactggtaccttcgaacttccgtaccaccggtnaacgactaatcgtaacacgtccgtagaagttattttgacttagtttacttacgtgtacgtacggtaccgtaaggttcccgtttacccgtacccggtaccgggtcccgtacgttacccggtaccgggttttaccggggggacccggggggtaaacccgtaagggggttaacgggaaggttaacgtccggaaagggtaaaccggtaacgttgggttacgggccgttaacggaccgtaacctacgtcgttacggttcctttaacgtaaccccg

SEQ ID NO: 326832 - DNA, 601 bp, Homo sapiens
  misc_feature: GZ8MTXP01C212E.44.39.D06.1.454.CMB.2.raw
  modified_base (203)..(203): a, c, t, g, unknown or other
  misc_feature (203)..(203): n is a, c, g, or t
  modified_base (374)..(374): a, c, t, g, unknown or other
  misc_feature (374)..(374): n is a, c, g, or t
  modified_base (457)..(457): a, c, t, g, unknown or other
  misc_feature (457)..(457): n is a, c, g, or t
tcagacagtatatacacgaccggtgctcgatttagtgacatctcgcagttctttgggggaggaactgctcagttaggacccagagggaaccatggaagccccagctcagcttctcttcctcctgctactctggctcccagagatcaccggagatattgtgttgacacagtctccaggcaccctgtctttgtctccgagggganagacgcccacctctcctggtacgggccaggtcggagtgttgactaagtacctagcctaggtaccaacacgaaacctggccaggctcccaggctcctcatctatgatgcatccaacgagggtcacgtggccaccccagacaggttcaggtggcgaggtgggtctaggggacngtacttcactctccaccgtcagacaatgtaacagcctagaagttatttgacttagtttattactgtcaggctagtccgttccncgacggccgcgtcgtacggtttcgggggaccgggggtaacctaaggggtcggaagttacgtaccggaaggtaaaccggtaacgttgggttcggttaccgttcgggacctaacccgttcgttcgttccgttccgttccgtaaccg

SEQ ID NO: 326833 - DNA, 660 bp, Homo sapiens
  misc_feature: GZ8MTXP01EMTM2.44.39.D06.1.454.CMB.2.raw
  modified_base (204)..(204): a, c, t, g, unknown or other
  misc_feature (204)..(204): n is a, c, g, or t
  modified_base (270)..(270): a, c, t, g, unknown or other
  misc_feature (270)..(270): n is a, c, g, or t
  modified_base (300)..(300): a, c, t, g, unknown or other
  misc_feature (300)..(300): n is a, c, g, or t
  modified_base (392)..(392): a, c, t, g, unknown or other
  misc_feature (392)..(392): n is a, c, g, or t
  modified_base (419)..(419): a, c, t, g, unknown or other
  misc_feature (419)..(419): n is a, c, g, or t
tcagacagtatatacacgaccggtgctcgatttagtgacatctcgcagttctttgggggaggaactgctcagttaggacccagagggaaccatggaagccccagctcagcttctcttcctcctgctactctggctcccagagatcaccggagatattgtgttgacacagtctccaggcacccttgtctttgtctccgagggganagacgcccaccctctcctggtacgggccaggtcggagtgttgctaagtactagcctaggtaccaanagaaacctggaccaggcctccagtctcctnatctatgatcgcactaccaaagtcgggtacacgtcggaccaccccgagacgtaggttccaggtcggactagggtgggtccgtaaggggaacnggtaccttcaccttctccaaccgggtnaacgactaaagtcgtaacgagtccgtagtaaacgttagttttagactttaaggtttacttaacgttgtactaggggtactacggtccgttacccgtaccgaccgggtccctccgttaccggtaaccgggtttccgggggaaccgggggtaaccgtaaggggtaaggtacgttacgtacgaaacggacgtaaacgttggttcgacgtaagaccgtaacctgtcttcgttccgttctaacccg

SEQ ID NO: 326834 - DNA, 617 bp, Homo sapiens
  misc_feature: GZ8MTXP01ECFJ6.44.39.D06.1.454.CMB.2.raw
tcagacagtatatacacgaccggtgctcgatttagtgacatctcgcagttctttggggggcgggagtcagacccagtcaagacacagcgtggacatgagggtccccgctcagctcctggggctcctgctgctctggctcccaggtgccgactgtgccgtccagatcgacccagtcctccttccaccctgtctgcgtctcgtgggcacagagtcaccatcacttcgccgggcagtgagagtggctggatggctggtatcgaaggaaacggcccgggacggtcccagctccgtggtctatacgccttattattttagactagttcgggggtccctactaaggttcaggtggacaagtaaacggtcgtagggtcaacttatttcctctctccaacctatcaagtcgggctgcagtcctgactgtattttcgaccgttaccttcttctcgcctaagtaccttaacgttaactttaatttccgttttacctccccgttcgggtcccggtttccggggaccccggggtactagttacggtccggtaaccctaacgaacgttacgtcggttacggtctcgaccttcgttacttcttgtccttcaccttcccttcccgccttaac

SEQ ID NO: 326835 - DNA, 597 bp, Homo sapiens
  misc_feature: GZ8MTXP01AKXKJ.44.39.D06.1.454.CMB.2.raw
  modified_base (191)..(191): a, c, t, g, unknown or other
  misc_feature (191)..(191): n is a, c, g, or t
  modified_base (244)..(244): a, c, t, g, unknown or other
  misc_feature (244)..(244): n is a, c, g, or t
tcagacagtatatacacgaccggtgctcgatttagtgacatctcgcagttctttggggggggtcacaagaggcagcgctctcgggacgtctccaccatggcctgggctctgctgctcctcactctcctcactcaggacacagggtcctgggcccagtctgccctgactcagcctgcctcgtgtctggttcncctggacagtcgatcaccatctctgcactgggtccagcaatgacagttggganatataaccttgtctcctggtatcaacaacatccaggaccaaacgacccccaaatctattactttttgacgtccagtgacgcggccgtgtaggttcgttctatcgtcttctacgtggctcaagtctcggccacaccggtccctcccgtgtcgtactcgtcgtcgggtcctccgggctacgggacggacgacggtctcgacttacgttaccgtgccggtacctacgtaactttaccaacttcgttaggagttacggttggggtcgttcggggcgggtacgggttaccgtccgtaaccgttcggacccgttcgtaacggtccaacggtccccgaggttcctcccgcccccgttcgg

SEQ ID NO: 326836 - DNA, 619 bp, Homo sapiens
  misc_feature: GZ8MTXP01DYKYL.44.39.D06.1.454.CMB.2.raw
  modified_base (187)..(187): a, c, t, g, unknown or other
  misc_feature (187)..(187): n is a, c, g, or t
  modified_base (208)..(208): a, c, t, g, unknown or other
  misc_feature (208)..(208): n is a, c, g, or t
  modified_base (309)..(309): a, c, t, g, unknown or other
  misc_feature (309)..(309): n is a, c, g, or t
tcagacagtatatacacgaccggtgctcgatttagtgacatctcgcagttctttggggagcttcagctgtggtagagaagacaggattcaggacaatctccagcatggccggcttccctctcctcctcaccctcctcactcactgtgcagggtcctgggcccagtctgtgctgactcagccatcctnagcgtctcgggacccccgggnagacggtcacgattcttttgtctggaagtaggtccaaacatcggaagtaattacgtatactggatcggcaattcacaggacgcggtcccccagaccccctnatctagtaagggagaatccagccggccccttcgacggggtcccctcggaccccgattctctcgccctacccaagtctggccaccctcacgccctcccgtggcctatcaggtcgggtcctcccgggtacccggaggtatcggaggtctaggtatttacgtttcgtggttgcggtcgtttgggattcggactacttccgtgtaggtcggactggtcttagttccgggacggacggggtaacccaaggttcgttaccggtaacccgtccgttaaacggccgacggacccccgtaaggggttcccttccccggg

SEQ ID NO: 326837 - DNA, 624 bp, Homo sapiens
  misc_feature: GZ8MTXP01CUJ7E.44.39.D06.1.454.CMB.2.raw
  modified_base (210)..(210): a, c, t, g, unknown or other
  misc_feature (210)..(210): n is a, c, g, or t
  modified_base (246)..(246): a, c, t, g, unknown or other
  misc_feature (246)..(246): n is a, c, g, or t
tcagacagtatatacacgaccggtgctcgatttagtgacatctcgcagttctttgggggggtcacaagaggcagcgctctcgggacgtctccaccatggcctgggctctgctgctcctcactctcctcactcaggacacagggtcctgggcccagtctgccctgactcagcctgcctcgtgtctggttctcctggacagtcgatcacctntctcgtgcacgtgggtccagcaatgactagttgganatataaccttgtctcctgtatacaacaacataccaggaaccaaacgacccccaaaatctaattacttttagacgtccagtgacgcggccgtgtaggttcgtttactaatcgtcttctctggcctaccgaagtctcggacccacgaccggcccttccctgtccgactctcgtcgggtcctccgggcctggacggacgtacggctacggtaaccttaagtttccggcgtaccgtacttacgtactttaaccgtaaccgttcgttaggtacgttacggttgggggttcgttcggggacgggtacggttaccgtaccgtaccgttccggttccgttcgtaacgtccgaaccgtacccgacggttccgtccccgccccgttcg

SEQ ID NO: 326838 - DNA, 664 bp, Homo sapiens
  misc_feature: GZ8MTXP01A020S.44.39.D06.1.454.CMB.2.raw
  modified_base (209)..(209): a, c, t, g, unknown or other
  misc_feature (209)..(209): n is a, c, g, or t
  modified_base (322)..(322): a, c, t, g, unknown or other
  misc_feature (322)..(322): n is a, c, g, or t
  modified_base (336)..(336): a, c, t, g, unknown or other
  misc_feature (336)..(336): n is a, c, g, or t
tcagacagtatatacacgaccggtgctcgatttagtgacatctcgcagttctttggggagcttcagctgtggtagagaagacaggattcaggacaatctccagcatggccggcttccctctcctcctcaccctcctcactcactgtgcagggtcctgggcccagtctgtgctgactcagccatcctcagccgtcgtcgggacccccggnagacggtcacgtattcttttgtctaggaagtacggtccaactagtacggaaagttaattacgtatacgtggtatcggactaattcacgaggacgccggtaccccagacccctnatctaagtaggganaatcaggccgccctcgacggggtccctagaccccgtattctctcgccctaaccaagtccgtgcctaccctcgacgtcccctccgtcggaccctatccgtaggtcgggtcccgttccgggtaccggaggtacgtcgggaacggtcttaggttaattttcgtttcggtggttcgggtcggtcgtttaggggacttcggacttacgtccgtaggtacggttcgggattcgtacgttaagggttccgggcggggtaaaccgggaccaacgggttcgttaaccggtaacccgtacgtaacgtccgacgttacccgaacggttcccgtccccgg

SEQ ID NO: 326839 - DNA, 581 bp, Homo sapiens
  misc_feature: GZ8MTXP01B1TFE.44.39.D06.1.454.CMB.2.raw
  modified_base (225)..(225): a, c, t, g, unknown or other
  misc_feature (225)..(225): n is a, c, g, or t
tcagacagtatatacacgaccggtgctcgatttagtgacatctcgcagttctttggggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctctgcactgganccagcgtaatattcttagtcttaatttgtctctggtatcaacatcatccaaggtaaacgcccccaaactcatcatctatgagcctataagagccctgaggggtttctaatccgcttcactcgccctccaacgtccggacaaaccacggccctccctgacaaatcctcgtgggctcgaggctagaggacgagggctagtaatttatttagtttggttagtcttcgagtattgttcgtcgactatctaactttatgttcgttcgggaaggttcggggaaccctaaaggggtccaacccggttccgttaacgggtccacgccccgaaacgggccccaaccccgtaacgttcgttaaccc

SEQ ID NO: 326840 - DNA, 604 bp, Homo sapiens
  misc_feature: GZ8MTXP01CMI6A.44.39.D06.1.454.CMB.2.raw
  modified_base (200)..(200): a, c, t, g, unknown or other
  misc_feature (200)..(200): n is a, c, g, or t
  modified_base (246)..(246): a, c, t, g, unknown or other
  misc_feature (246)..(246): n is a, c, g, or t
  modified_base (408)..(408): a, c, t, g, unknown or other
  misc_feature (408)..(408): n is a, c, g, or t
  modified_base (416)..(416): a, c, t, g, unknown or other
  misc_feature (416)..(416): n is a, c, g, or t
  modified_base (490)..(490): a, c, t, g, unknown or other
  misc_feature (490)..(490): n is a, c, g, or t
  modified_base (495)..(495): a, c, t, g, unknown or other
  misc_feature (495)..(495): n is a, c, g, or t
  modified_base (501)..(501): a, c, t, g, unknown or other
  misc_feature (501)..(501): n is a, c, g, or t
tcagacagtatatacacgaccggtgctcgatttagtgacatctcgcagttctttggggggggtcacaagaggcagcgctctcgggacgtctccaccatggcctgggctctgctgctcctcactctcctcactcaggacacagggtcctgggcccagtctgccctgactcagcctgcctccgtgtctggttctcctggacngtcgatcaccatctcctgcactgggtccagcaatgacagttggganatataaccttgtctcctggtatacaacaacactaccaggaccaaaccgacccccaaatctaatttacttttgacgtccagtgacgcggcgtcgtaggttcgtttactaatcgtcttctctggtcctacctaacgtcgtcggcccacgacccggccctacccngtaacccntcctcgtggcctcgagcgtgaggtccgagtctaggtactttacctagtgcacgtcctataattaactacgaacncgacncgaacncccttacccgttacgttacggttcgttaaccggacggttacggggtaaccctaacgggtccctaacccggttcgttaccggttaaccgaaccggtaacccccg

SEQ ID NO: 326841 - DNA, 614 bp, Homo sapiens
  misc_feature: GZ8MTXP01C54F9.44.39.D06.1.454.CMB.2.raw
  modified_base (190)..(190): a, c, t, g, unknown or other
  misc_feature (190)..(190): n is a, c, g, or t
  modified_base (221)..(221): a, c, t, g, unknown or other
  misc_feature (221)..(221): n is a, c, g, or t
  modified_base (233)..(233): a, c, t, g, unknown or other
  misc_feature (233)..(233): n is a, c, g, or t
  modified_base (373)..(373): a, c, t, g, unknown or other
  misc_feature (373)..(373): n is a, c, g, or t
  modified_base (382)..(382): a, c, t, g, unknown or other
  misc_feature (382)..(382): n is a, c, g, or t
  modified_base (390)..(390): a, c, t, g, unknown or other
  misc_feature (390)..(390): n is a, c, g, or t
  modified_base (421)..(421): a, c, t, g, unknown or other
  misc_feature (421)..(421): n is a, c, g, or t
tcagacagtatatacacgaccggtgctcgatttagtgacatctcgcagttctttgggggggtcacaagaggcagcgctctcgggacgtctccaccatggcctgggctctgctgctcctcactctcctcacccaggacacagggtcctgggcccagtctgccctgactcagcctgcctccgtgtctggtcncctggacagtcgtcacatctctgcactgganccagcgttaatnttcttagtcttaactttgtctcctgtatcaacatcatccagtaaacgccccaaactcatcatctatgagcctataagagcctacgtaggggtttctaatccgcttcactgcctaacccagtccggacaacacgcctcccngacaatctntggctcgngctgagacgagctagacttattattgggttntcgtacagacttgttcgtcgtactacttacaccgttttaatcggttccgtttaacgggaaacggtttacggggaaacccgttaaaacggggtcccttaaccccggttccggtttaaaacgggcccgttaaaaccgggtccccctaaaacggggacccccttaaacccccggtaaccttaacgggttaaccccc

SEQ ID NO: 326842 - DNA, 525 bp, Homo sapiens
  misc_feature: GZ8MTXP01AOD9W.44.39.D06.1.454.CMB.2.raw
  modified_base (189)..(189): a, c, t, g, unknown or other
  misc_feature (189)..(189): n is a, c, g, or t
  modified_base (223)..(223): a, c, t, g, unknown or other
  misc_feature (223)..(223): n is a, c, g, or t
  modified_base (264)..(264): a, c, t, g, unknown or other
  misc_feature (264)..(264): n is a, c, g, or t
tcagacagtatatacacgaccggtgctcgatttagtgacatctcgcagttctttggggggtcacaagaggcagcgctctcgggacgtctccaccatggcctgggctctgctgctcctcactctcctcacccaggacacagggtcctgggcccagtctgccctgactcagcctgcctcgtgtctgggtcncctggacagtcggtcaccatctcctgcactgganccagcggtaatattctagtcttaacttgtctctgtatcaanatcatccaggtaaacgcccccaaatcatcatctatgaggcctataagagccctcgaggggtttctaatccgcttcactcgcctcaagtccgcaacacggcctcctgacaatctatgggctcgaggctggagacgaggctgattagtttattgggttgcttcagtattgttcgtcgactatccactttatgtcttcggaagttcgggaccaaaggttccacgttccaggtcacgccaacggccaaccccgtaattcgtaacc

SEQ ID NO: 326843 - DNA, 614 bp, Homo sapiens
  misc_feature: GZ8MTXP01C3XCX.44.39.D06.1.454.CMB.2.raw
  modified_base (192)..(192): a, c, t, g, unknown or other
  misc_feature (192)..(192): n is a, c, g, or t
  modified_base (226)..(226): a, c, t, g, unknown or other
  misc_feature (226)..(226): n is a, c, g, or t
  modified_base (237)..(237): a, c, t, g, unknown or other
  misc_feature (237)..(237): n is a, c, g, or t
  modified_base (599)..(599): a, c, t, g, unknown or other
  misc_feature (599)..(599): n is a, c, g, or t
tcagacagtatatacacgaccggtgctcgatttagtgacatctcgcagttctttggggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctctgcacgtgganccagcgtaatnttcttagtcttaactttgtctctgtatcaacatcataccaggtaaacgccccaaactcatcatctatgagacctataagacgtcctcgtaggggtttctaacgtccgtcttctctcgtccctaaccaacgtccgacaaacccaccgggccctcccgagaacaactctacgtcggctccgagggtcctaggacggacgagggtctagaatttattattggtttcgcgttacgagtagttcgttcgtcgtactacttcctaagttacttgtcgtttaacgggaaggtacggggaaccgtaaacgggtccttaaccggttcccgttaggtaacccgaacgcccaaacgggtacccaaaccccgtnttaaccggttaaccc

SEQ ID NO: 326844 - DNA, 536 bp, Homo sapiens
  misc_feature: GZ8MTXP01BWWL2.44.39.D06.1.454.CMB.2.raw
  modified_base (203)..(203): a, c, t, g, unknown or other
  misc_feature (203)..(203): n is a, c, g, or t
  modified_base (315)..(315): a, c, t, g, unknown or other
  misc_feature (315)..(315): n is a, c, g, or t
  modified_base (368)..(368): a, c, t, g, unknown or other
  misc_feature (368)..(368): n is a, c, g, or t
  modified_base (407)..(407): a, c, t, g, unknown or other
  misc_feature (407)..(407): n is a, c, g, or t
  modified_base (492)..(492): a, c, t, g, unknown or other
  misc_feature (492)..(492): n is a, c, g, or t
  modified_base (516)..(516): a, c, t, g, unknown or other
  misc_feature (516)..(516): n is a, c, g, or t
  modified_base (518)..(518): a, c, t, g, unknown or other
  misc_feature (518)..(518): n is a, c, g, or t
tcagacagtatatacacgaccggtgctcgatttagtgacatctcgcagttctttgggggaggaactgctcagttaggacccagagggaaccatggaagccccagctcagcttctcttcctcctgctactctggctcccagagatcaccggagatattgtgttgacacagtctccaggcaccctgtctttgtctccgagggganagagccaccctctcctgtagggccagtcggagtgttgactaagtacctagcctaggtaccaacagaaacctggccaggctcccaggctcctcatctatgatgcatccaaagngggtcacgtggccaccccgagacaggttcaggtggcgaggtgggtctgggacngacttcactctcacgtcagcatgacagcctagaaagttntttcgactagtttattactgttcagggctacgtccgttcctccgacggccgtctcgtcgttcggggccgggggacagggtggagngtcgagacgacgttgttggctgcncntcgttcgttcttcgtaac

SEQ ID NO: 326845 - DNA, 584 bp, Homo sapiens
  misc_feature: GZ8MTXP01BF6Y8.44.39.D06.1.454.CMB.2.raw
  modified_base (243)..(243): a, c, t, g, unknown or other
  misc_feature (243)..(243): n is a, c, g, or t
  modified_base (296)..(296): a, c, t, g, unknown or other
  misc_feature (296)..(296): n is a, c, g, or t
  modified_base (539)..(539): a, c, t, g, unknown or other
  misc_feature (539)..(539): n is a, c, g, or t
  modified_base (570)..(570): a, c, t, g, unknown or other
  misc_feature (570)..(570): n is a, c, g, or t
tcagacagtatatacacgaccggtgctcgatttagtgacatctcgcagttctttgggggagctacaacaggcaggcaggggcagcaagatggtgttgcagacccaggtcttcatttctctgttgctctggatctctggtgcctgcggggacatcgcgatgagccagtctccagactccctggctgtgtctcgtgggcgaggagggccaccgtcaactgcaactccagccaaagtgtcttttancgtaccccaatagtaagtaactattagcctaggtaaccaacgagaaaccgganagtctactaaattacttctttatggactatctacgtcgggacgtccgggtcctgaccgtattcgaggtcgggcgggcgggtacgtcgggaactactacgtttccacgttcctacacctatccagttacgcctgacgaggtcctagaacgtcgtggtactaggtttacttagttcggtaactaacgtaaatttacgtttaacgaacttccttatactacgttcggacggagacgaagacgaganagtacgaaacgacgttgttcggctgcctacnttacgtcgttcgtc

SEQ ID NO: 326846 - DNA, 621 bp, Homo sapiens
  misc_feature: GZ8MTXP01BATZQ.44.39.D06.1.454.CMB.2.raw
  modified_base (245)..(245): a, c, t, g, unknown or other
  misc_feature (245)..(245): n is a, c, g, or t
tcagacagtatatacacgaccggtgctcgatttagtgacatctcgcagttctttggggggggtcacaagaggcagcgctctcgggacgtctccaccatggcctgggctctgctgctcctcactctcctcactcaggacacagggtcctgggcccagtctgccctgactcagcctgcctccgtgtctggttctcctggacagtcgatcaccatctctgcactgggtccagcaatgacagttggganatataacttgtctctgtatcaacaacatcaggacaaacgcccccaaatctattacttttgacgtccagtgagcgccgtgtagttcgttactatcgtcttctctgtcctacaagtcgtcggtacccaccgaccggtccctccctgtccgtactcgtcgtcggggccctccgggccgtagggacggtacggacggtctacgggtaacttacgttacgtcggccggtacttactaactttaaccgaacttcgttagtaacgttcggtttggggttcggttcgggacggggtacgggttacctccgtaacccgttcggttacccggttccgtaagggtacccaacggccccgtaaggttccttcccggttccccgtccgg

SEQ ID NO: 326847 - DNA, 672 bp, Homo sapiens
  misc_feature: GZ8MTXP01BFAM7.44.39.D06.1.454.CMB.2.raw
tcagacagtatatacacgaccggtgctcgatttagtgacatctcgcagttctttggggggggtcacaagaggcagcgctctcgggacgtctccaccatggcctgggctctgctgctcctcactctcctcactcaggacacagggtcctgggcccagtctgtcctgactcagcctgcctcgtgtctggttctctggacagtcatcacatctctgcatgggtccagctatgactagttggatatactacttgctctagtatacaacacactacaggaccaaacgacccccaaatctaattacgttttacgacgtacctaaggtcgacggccggtaccgtcgtaggttccgtttactaactcgtccttctacgttcggcctacgtacgtcgtcgaccacgtccgtccctcccgtagtcgtacttccgtccgtcgggtcccgtccggtcgtgggaacggcgacggtcgttacggacttacgttacgcggtacggtaccttacgttaactttaaccgtaactttcgttacggtaacggttccggttggggttaacggtcggggttaccgggtaacggggttacccttacggtaacccgttcgttacccggttccggtaaacggttcccgaaccgttccccgggaacgttcccgtaaccccgttcccgttaacccggg

SEQ ID NO: 326848 - DNA, 675 bp, Homo sapiens
  misc_feature: GZ8MTXP01A8RHQ.44.39.D06.1.454.CMB.2.raw
  modified_base (208)..(208): a, c, t, g, unknown or other
  misc_feature (208)..(208): n is a, c, g, or t
  modified_base (246)..(246): a, c, t, g, unknown or other
  misc_feature (246)..(246): n is a, c, g, or t
  modified_base (311)..(311): a, c, t, g, unknown or other
  misc_feature (311)..(311): n is a, c, g, or t
  modified_base (323)..(323): a, c, t, g, unknown or other
  misc_feature (323)..(323): n is a, c, g, or t
  modified_base (348)..(348): a, c, t, g, unknown or other
  misc_feature (348)..(348): n is a, c, g, or t
  modified_base (361)..(361): a, c, t, g, unknown or other
  misc_feature (361)..(361): n is a, c, g, or t
tcagacagtatatacacgaccggtgctcgatttagtgacatctcgcagttctttggggagcttcagctgtggtagagaagacaggattcaggacaatctccagcatggccggcttccctctcctcctcaccctcctcactcactgtgcagggtcctgggcccagtctgtgctgactcagccatcctcagcgtcgtcgggacccccggnagacggtcacgattcttttgtctggaagtggtccaacntacggaaagttaattacgtatactggtatcggactaatcacgaggacgccggtccccagcccctnatctagtagganatcgagccgccctgacggggtcccngaccccgtattcnctcgccctacagtctaggccacctcacgccctcccgtaggccctatcgacgggtcgggcccgtccgggtaccgaggacgtggacggtcttaggtaatttcgtttcggtggtcggtcgttcggttagggactggaactcgtccgtaggtacggttcgggaacttcggtacgtttacgggttacccgggggacgggaaaccgggggaaacccttaacgggttccgttaaccgggtaacccccggtttaaccgtttaaaccgggcccggtaaccggttacccccggtaaacgggttccccggtttaacccccccggg

SEQ ID NO: 326849 - DNA, 641 bp, Homo sapiens
  misc_feature: GZ8MTXP01DCIT4.44.39.D06.1.454.CMB.2.raw
  modified_base (205)..(205): a, c, t, g, unknown or other
  misc_feature (205)..(205): n is a, c, g, or t
  modified_base (409)..(409): a, c, t, g, unknown or other
  misc_feature (409)..(409): n is a, c, g, or t
tcagacagtatatacacgaccggtgctcgatttagtgacatctcgcagttctttgggggaggaactgctcagttaggacccagagggaaccatggaagccccagctcagcttctcttcctcctgctactctggctcccagagatcaccggagatattgtgttgacacagtctccaggccacccttgtctttgtctccgagggganagacgcccacctctcctggtacggccaggtcggagtgttgactaagtcctagcctaggtaccaacacgaaacctggccaggcctcccgaggtcctcctcatctatgatgcactaccaaagcgggtcacgtcggaccaccccgagacgaggttcaggtggacgtaggtcggggtcgtaaggggacctggtactttccgacttccnccgaccgtcagactaagtcggtaacagtcctagtaagttattttgacgttagtttactacttagtaccagggtactacggttccgttcccgtcgaccggtcccgtcgttaccgtacggtttccgggggacgggggtaccgaaggggtaacggtagttacgtacgacgtaaccggtaacgttgggttcggttacgtcgtacctcctacgttcgttcgttccgttaacgttccg

SEQ ID NO: 326850 - DNA, 595 bp, Homo sapiens
  misc_feature: GZ8MTXP01EREMX.44.39.D06.1.454.CMB.2.raw
  modified_base (237)..(237): a, c, t, g, unknown or other
  misc_feature (237)..(237): n is a, c, g, or t
  modified_base (246)..(246): a, c, t, g, unknown or other
  misc_feature (246)..(246): n is a, c, g, or t
  modified_base (481)..(481): a, c, t, g, unknown or other
  misc_feature (481)..(481): n is a, c, g, or t
tcagacagtatatacacgaccggtgctcgatttagtgacatctcgcagttctttgggggagctacaacaggcaggcaggggcagcaagatggtgttgcagacccaggtcttcatttctctgttgctctggatctctggtgcctggcggggacatcgcgatgagccagtctccagacctccctggctgtgtctcgtgggcgagacgggccaccgtcaactgacaactcagccaaagtnttactttancgtacccaatagtaagaactattagcctaggtaaccaacgaagaaaccggacagtacctacctaaatttacttacttttatgggactatctaacgtcgggtagtcccgggggtcctcgacgtacttcgagtcggcggcgggtactgggcactagtttcactcctacaccatcagtagcctgcaggtctagaagcgtggactagtttattattaggtacaaattaattagtttaanaaccttctatacctacgtttacggcggtaacgggactaaggtagttagagttaactacgaaacgttacgttggttacggcttaggaacctaccgtattcgttcgttctttaacc

SEQ ID NO: 326851 - DNA, 551 bp, Homo sapiens
  misc_feature: GZ8MTXP01DLPN6.44.39.D06.1.454.CMB.2.raw
  modified_base (248)..(248): a, c, t, g, unknown or other
  misc_feature (248)..(248): n is a, c, g, or t
  modified_base (414)..(414): a, c, t, g, unknown or other
  misc_feature (414)..(414): n is a, c, g, or t
tcagacagtatatacacgaccggtgctcgatttagtgacatctcgcagttctttgggggggggtcacaagaggcagcgctctcgggacgtctccaccatggcctgggctctgctgctcctcactctcctcactcaggacacagggtcctgggcccagtctgccctgactcagcctgcctccgtgtctggttctccgtggacagtcatcaccatctcctgcacgtggtccagcaatgactagttggganatataacttgtctctgtatacaacaacatccagacaaacgcccccaaatctattactttgagtccagtgagcgcgtgagttcgttactatcgtcttctctgctcaagtctcgccacgacggccctacctgtcgtactctcgtcgggcgtcccggcgtggaggacgnggtctagtactattacgtgcgtctctactttacctaacttcgttgtagtccgttggggttgttcgggcgggtagggttactccgaccgttcgcccgttacgtaacggtcaacgacccgtaggcctccgcccccgtcg

SEQ ID NO: 326852 - DNA, 616 bp, Homo sapiens
  misc_feature: GZ8MTXP01BB9AD.44.39.D06.1.454.CMB.2.raw
  modified_base (227)..(227): a, c, t, g, unknown or other
  misc_feature (227)..(227): n is a, c, g, or t
  modified_base (238)..(238): a, c, t, g, unknown or other
  misc_feature (238)..(238): n is a, c, g, or t
  modified_base (262)..(262): a, c, t, g, unknown or other
  misc_feature (262)..(262): n is a, c, g, or t
  modified_base (266)..(266): a, c, t, g, unknown or other
  misc_feature (266)..(266): n is a, c, g, or t
  modified_base (280)..(280): a, c, t, g, unknown or other
  misc_feature (280)..(280): n is a, c, g, or t
tcagacagtatatacacgaccggtgctcgatttagtgacatctcgcagttctttggggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcacgtgganccagcgtaatnttcttagtcttattgtctctgtancaanatcatcaagtaacncctaccaaactctaatttacttttgacgttaccaggtgacgccggtccgtacgtaggtttgttactaactcccgtctttctcgtcggcctaaccgaagtcgtcggcccacgaccggtccctccgtgtctactctcgtcgggcctccggcgtaggacggtacggaggtctcgtaacttagttacgtgggcggtcttactaactttaactacttcgttaggacgttacgttggggttacgttcgggcgggtaacggtcttccgtaccgttcgtacccgtcgttacggttccaccggcccgacggtcctacccgtccccgttcggtcccttcgttcccg

SEQ ID NO: 326853 - DNA, 578 bp, Homo sapiens
  misc_feature: GZ8MTXP01EI94I.44.39.D06.1.454.CMB.2.raw
  modified_base (241)..(241): a, c, t, g, unknown or other
  misc_feature (241)..(241): n is a, c, g, or t
  modified_base (293)..(293): a, c, t, g, unknown or other
  misc_feature (293)..(293): n is a, c, g, or t
  modified_base (344)..(344): a, c, t, g, unknown or other
  misc_feature (344)..(344): n is a, c, g, or t
  modified_base (351)..(351): a, c, t, g, unknown or other
  misc_feature (351)..(351): n is a, c, g, or t
  modified_base (467)..(467): a, c, t, g, unknown or other
  misc_feature (467)..(467): n is a, c, g, or t
tcagacagtatatacacgaccggtgctcgatttagtgacatctcgcagttctttgggggagctacaacaggcaggcaggggcagcaagatggtgttgcagacccaggtcttcatttctctgttgctctggatctctggtgcctgcggggacatcgcgatgagccagtctccagactccctggctgtgtctcgtgggcgagacgggccaccgtcaactgcaactcagccaaagtgtctttangtccccaatagtaaagaactattagcctaggtaaccaacgagaaaccggganagtcctactaaattactcttttatggctatctactcgggagtccgggtccngaccgtnttacgagtggccggcggtacgtgggaacactagtttccacgtctacacctatcagtacgcctgcaggctagaacgtcgtggctagtttattagtggtacaaagtattaagtttaanacttcctaatctacgtttcgggcggtagggaccaagtagttagaagttatacgaaacggttaacttggttcggtaactcggaaccaccgtattccgttcgttaactttccc

SEQ ID NO: 326854 - DNA, 674 bp, Homo sapiens
  misc_feature: GZ8MTXP01AFWWB.44.39.D06.1.454.CMB.2.raw
  modified_base (151)..(151): a, c, t, g, unknown or other
  misc_feature (151)..(151): n is a, c, g, or t
  modified_base (198)..(198): a, c, t, g, unknown or other
  misc_feature (198)..(198): n is a, c, g, or t
  modified_base (255)..(255): a, c, t, g, unknown or other
  misc_feature (255)..(255): n is a, c, g, or t
  modified_base (278)..(278): a, c, t, g, unknown or other
  misc_feature (278)..(278): n is a, c, g, or t
tcagacagtatatacacgaccggtgctcgatttagtgacatctcgcagttctttggggggaggaactgctcagttaggacccagagggaaccatggaagccccagctcagcttctcttcctcctgctactctggctccagagatcacgganatattgtgttgacacagtctcaggcacctgtcttgtctcgagggganagacgccacctctccgtgtacggccagtcggagtgtgactaagtactagcctgacanagaactgcagctccgagctcctnatcatgatcgcactaccgaaacgtagggtccaacgtcggaccaaccccgagaccgtaggttccgaaggtccggtagagggtttcggggacgtaaggggaactaaggtaaccgtttccgaactccgtacgaaccggtcaacggacctaaagttcggtaacacggtaccttaaggtaacgtttacgttttagactttaaagtttacttacgtgtaccgtaaggggtccgtacggttcccgtttacccgccggtaaccggtcccgtacgtttacccgggtccgggtttaccggggggaccgggggtaaaccgtaggggtaacggaagttacggttacgacggtaacggtaacgttcggttacgcgtcgacaacgtctcgttacgttcttaacgttaacc

SEQ ID NO: 326855 - DNA, 605 bp, Homo sapiens
  misc_feature: GZ8MTXP01C8Z6A.44.39.D06.1.454.CMB.2.raw
tcagacagtatatacacgaccggtgctcgatttagtgacatctcgcagttctttggggggggtcacaagaggcagcgctctcgggacgtctccaccatggcctgggctctgctgctcctcactctcctcactcaggacacagggtcctgggcccagtctgccctgactcagcctgcctccgtgtctggttctcctggacagtcatcaccatctctgcacgtgggtccagcaatgactagttggatatataacttgtctctgtatacaacaacatccaggaccaaacgacccccaaatctaatttacttttgacgtccagtgacgcggtccgtgtaggtttcgttactaagtcgtcttctcgttcgctacgagtctcggacccacgcgccctcctgtacgtctcgtcgtcgggcctccgggctaggacggtaacgcggtctacgtaacttacgttacgtcggacgtcttactaactttaacgaacttcgtagtacgtacgtttggggaacggttccgggagggtacggttaccttaccgccgttacggttccgttaccgttaaggtaccaacggcccgaacggttccttcccggccccgttaacgg

SEQ ID NO: 326856 - DNA, 654 bp, Homo sapiens
  misc_feature: GZ8MTXP01AXT2X.44.39.D06.1.454.CMB.2.raw
  modified_base (192)..(192): a, c, t, g, unknown or other
  misc_feature (192)..(192): n is a, c, g, or t
  modified_base (246)..(246): a, c, t, g, unknown or other
  misc_feature (246)..(246): n is a, c, g, or t
  modified_base (264)..(264): a, c, t, g, unknown or other
  misc_feature (264)..(264): n is a, c, g, or t
  modified_base (425)..(425): a, c, t, g, unknown or other
  misc_feature (425)..(425): n is a, c, g, or t
  modified_base (435)..(435): a, c, t, g, unknown or other
  misc_feature (435)..(435): n is a, c, g, or t
tcagacagtatatacacgaccggtgctcgatttagtgacatctcgcagttctttggggggggtcacaagaggcagcgctctcgggacgtctccaccatggcctgggctctgctgctcctcactctcctcactcaggacacagggtcctgggcccagtctgccctgactcagcctgcctccgtgtctggttcncctggacagtcgatcacatctctgcacgtgggtccagcaatgactagttggganatatactgtctcctgtanacaacacatcaaggacaaaccgacccccaaatctaattacttttgacgtaccgagttggacgtccggtaccgtcgtacggtttacgtttactaaatcgtacttcttcgtcggtcctacgtaaacgtccgtacgggacctaccgaccgggtccccttacccncgtaaccctntccgtcggtcggggtacccttccggaaggcgttacgggacggacggaagttcccgtagggtaacttacctacgttcgacgtcgtctacgtaattacgtaaacacgtacgaggccctacggttaccctaaccccgttgttaccgttaccgttcggaaacgttccggggaaacctacgggtcccgtaaccggtccgttaacggtccgaaccggaaaccccg

SEQ ID NO: 326857 - DNA, 614 bp, Homo sapiens
  misc_feature: GZ8MTXP01BXCFW.44.39.D06.1.454.CMB.2.raw
  modified_base (225)..(225): a, c, t, g, unknown or other
  misc_feature (225)..(225): n is a, c, g, or t
  modified_base (267)..(267): a, c, t, g, unknown or other
  misc_feature (267)..(267): n is a, c, g, or t
  modified_base (271)..(271): a, c, t, g, unknown or other
  misc_feature (271)..(271): n is a, c, g, or t
  modified_base (288)..(288): a, c, t, g, unknown or other
  misc_feature (288)..(288): n is a, c, g, or t
  modified_base (433)..(433): a, c, t, g, unknown or other
  misc_feature (433)..(433): n is a, c, g, or t
tcagacagtatatacacgaccggtgctcgatttagtgacatctcgcagttctttggggggggtcacaagaggcagcgctctcgggacgtctccaccatggcctgggctctgctgctcctcactctcctcacccaggacacagggtcctgggcccagtctgccctgactcagcctgcctccgtgtctggtcgcctggacagtcgtcaccatctcctgcactggacnccagcggttaatattcttagttcttaactttgtctcctgtancaanatcatcaaggtaaaccnccccaaatcatcatctatagacggtcctaagtaacgcggtcccttagtacggggtttactacttccgtcttcacctcgaccctaaccgaacgtcccggacaaaccgaccggcccctccgtacactaacttccgtcgtcgggaccnccgtaaggccgtaggaacgggtacggacgggtcctagttaatttagtttagttcggggttcgtctacgtagtagttcgttcgtctactacttctacttagtcgttcgttacgggagttcggacgtaaagtcgaccgttcgttacgtccacggcccaacggccccaaccctgttaacgtccc

SEQ ID NO: 326858 - DNA, 631 bp, Homo sapiens
  misc_feature: GZ8MTXP01CBV19.44.39.D06.1.454.CMB.2.raw
  modified_base (204)..(204): a, c, t, g, unknown or other
  misc_feature (204)..(204): n is a, c, g, or t
  modified_base (274)..(274): a, c, t, g, unknown or other
  misc_feature (274)..(274): n is a, c, g, or t
  modified_base (302)..(302): a, c, t, g, unknown or other
  misc_feature (302)..(302): n is a, c, g, or t
  modified_base (322)..(322): a, c, t, g, unknown or other
  misc_feature (322)..(322): n is a, c, g, or t
tcagacagtatatacacgaccggtgctcgatttagtgacatctcgcagttctttgggggaggaactgctcagttaggacccagagggaaccatggaagccccagctcagcttctcttcctcctgctactctggctcccagagatcaccggagatattgtgttgacacagtctccaggcaccctgtctttgtctccgaggggganagacgcccaccctctccgtggtacgggccaggtcggagttgttgactaagtacctagcctggtaaccaanagaaacctggccaggctcccaggcctcncatctatgatgcatccaagngggtcactggccaccccagacaggttcagtggcaggtcgggtctaaggggaccaaggtacctttcgaccttctaccgaccgtcaagactaagtcgtaacagcctagtaagttattttgacttagtttatactgtacaggtctacgtccgttcctccgtacggcccgtcgtaccgtaccggttttccgggggaccggggggtaacccgtaaggggtcgggaaggacgttacggaaacggtaaacggtaaacgttgggttagggccgttcgggaccgaaccttacgtcgttcggttccgtttcgttaaccg

SEQ ID NO: 326859 - DNA, 814 bp, Homo sapiens
  misc_feature: GZ8MTXP01EDYVY.44.39.D06.1.454.CMB.2.raw
  modified_base (208)..(208): a, c, t, g, unknown or other
  misc_feature (208)..(208): n is a, c, g, or t
  modified_base (246)..(246): a, c, t, g, unknown or other
  misc_feature (246)..(246): n is a, c, g, or t
  modified_base (311)..(311): a, c, t, g, unknown or other
  misc_feature (311)..(311): n is a, c, g, or t
  modified_base (324)..(324): a, c, t, g, unknown or other
  misc_feature (324)..(324): n is a, c, g, or t
tcagacagtatatacacgaccggtgctcgatttagtgacatctcgcagttctttggggagcttcagctgtggtagagaagacaggattcaggacaatctccagcatggccggcttccctctcctcctcaccctcctcactcactgtgcagggtcctgggcccagtctgtgctgactcagccatcctcagcgtctcgggacccccgggnagacggtcacgattcttttgtctggaagtaggtccaanatacggaagtaattacgtatactggtatcggcaattcacgaggacgccggtccccagaccccctnatctagtaggganaatcagccggccctgacggggtccctgacccccgtattctactcgccctaccgaagttcccgtagggaccctacccgttacacggtcccccttccccgtcgggaccctacgttaccgtaacgggttcgggggccccgtttaccccgggggttacccggaaggggtaacgttcgggaaacgggttcccgttagggttaaactttttaacgtttttacccgggttggggttacggggttccgggttaccgggtttacggggggtaatttacgggaacccttaaacgttccccgttagggtaaagggttcggggtaaaccgttccgggttaccgtttaaacggggtttccccggggggacggggaaacccggggggtaaccccttaaaaccggggttccggttacccgggtaacccccgggtttacccgttaaaaccgggttccctaaacccggggacccccgtaaacgggttccccgtttaaccccccgggg

SEQ ID NO: 326860 - DNA, 655 bp, Homo sapiens
  misc_feature: GZ8MTXP01B5TMK.44.39.D06.1.454.CMB.2.raw
tcagacagtatatacacgaccggtgctcgatttagtgacatctcgcagttctttgggggggggtcacaagaggcagcgctctcgggacgtctccaccatggcctgggctctgctgctcctcactctcctcactcaggacacagggtcctgggcccagtctgtcctgactcagcctgcctccgtgtctggttctctggacagtcgatcacatctctgcactgggtccagcaatgactagttggagatataccttgtctctgtatacaaacaaacataccagaccaaacgaccccctaaactctaattacttttgacgttccagtgacgccggtccgtacgtaggttcgtttactaatccgtcttctcttcggcctaccaagtcctcggacccaccgtaccggtcccctcccgttgtccgtactccgtcgtcggggtccttcccggctgggacggacgaggtctacggaactttacgtttacgtcggtaccggtctacgttaacgtttaactaaacttcgttaggtacggtacggtttgggggtcggttccggggcgggtaacggggttccttacccggtacgttaccggttacccgttaccgtaacgggtcgtaaccggaccccgtagggttccctaacccgttcccccgttcggg

SEQ ID NO: 326861 - DNA, 619 bp, Homo sapiens
  misc_feature: GZ8MTXP01AWNFK.44.39.D06.1.454.CMB.2.raw
  modified_base (201)..(201): a, c, t, g, unknown or other
  misc_feature (201)..(201): n is a, c, g, or t
  modified_base (263)..(263): a, c, t, g, unknown or other
  misc_feature (263)..(263): n is a, c, g, or t
  modified_base (267)..(267): a, c, t, g, unknown or other
  misc_feature (267)..(267): n is a, c, g, or t
  modified_base (281)..(282): a, c, t, g, unknown or other
  misc_feature (281)..(282): n is a, c, g, or t
  modified_base (284)..(284): a, c, t, g, unknown or other
  misc_feature (284)..(284): n is a, c, g, or t
  modified_base (287)..(287): a, c, t, g, unknown or other
  misc_feature (287)..(287): n is a, c, g, or t
  modified_base (290)..(290): a, c, t, g, unknown or other
  misc_feature (290)..(290): n is a, c, g, or t
  modified_base (402)..(402): a, c, t, g, unknown or other
  misc_feature (402)..(402): n is a, c, g, or t
tcagacagtatatacacgaccggtgctcgatttagtgacatctcgcagttctttgggggaggaactgctcagttaggacccagagggaaccatggaagccccagctcagcttctcttcctcctgctactctggctcccagagatcaccggagatattgtgttgacacagtctccaggcaccctgtctttgctccgaggganagacgccaccctctcctggtacggccagtcggagtgtgactaagtacctgctagtacaacanaacngcagctccagctcnntntangangcatccaacgtggcactcggccacccagacaggttcagtggacgaggtcggtacgtgggaactgaccttcactcgtacaccgtcaacgatatacgacagcctaagtaagttntttagtacttaaggtttactacgtgtactcggcgtacgtccgtttcccgacgtccggtcccgtaccgttaccgttaccgggttacccgggggacggggggttaaacccgtaagggggtaacggtaaccgttaagaccggttaaacggtaaacccggtacggttaggttccggttacgtaacgtccgtaacctcgtcgtttccgtcgttaacgttccc

SEQ ID NO: 326862 - DNA, 726 bp, Homo sapiens
  misc_feature: GZ8MTXP01AGO2E.44.39.D06.1.454.CMB.2.raw
  modified_base (199)..(199): a, c, t, g, unknown or other
  misc_feature (199)..(199): n is a, c, g, or t
tcagacagtatatacacgaccggtgctcgatttagtgacatctcgcagttctttgggggaggaactgctcagttaggacccagagggaaccatggaagccccagctcagcttctcttcctcctgctactctggctccagagatcaccggagatattgtgttgacacagtctccaggcacctgtcttgtctcgagggganagacgccacctctcctggtacgggccaggtcggagttgttgacttaaagtcctagccttaggtaaccaacgaagaaaccgtggacccaggcctcccgaaggtcctcctacgattctataggactcgaccacgtaccgaaacgtacgggggtccaacgtacggaccaacccccgagacgtacggttcgaggttcggacgtagggtcggggtactaaggggaactaacggtacttaccgaactcctacgaccgtacgaacgtacgtaaactacggttaaacgacgtaccgtaaggtaaagtttaacgttttaggtaaccttaaggttttaaactttaccgttaggttaccaacggggtactaacggttcccgtttacccgttaccggaaccggtcccgtacccgttacggtaccgggtttaccgggggccggggggtaaacctaacggggtcggaagttacgttaccgaaggtaaccgtaagttcggttcggactcgactaacgtactcgttacgtcttaacgtaaccg

SEQ ID NO: 326863 - DNA, 614 bp, Homo sapiens
  misc_feature: GZ8MTXP01B2E20.44.39.D06.1.454.CMB.2.raw
  modified_base (202)..(202): a, c, t, g, unknown or other
  misc_feature (202)..(202): n is a, c, g, or t
  modified_base (240)..(240): a, c, t, g, unknown or other
  misc_feature (240)..(240): n is a, c, g, or t
  modified_base (264)..(264): a, c, t, g, unknown or other
  misc_feature (264)..(264): n is a, c, g, or t
  modified_base (279)..(279): a, c, t, g, unknown or other
  misc_feature (279)..(279): n is a, c, g, or t
  modified_base (289)..(289): a, c, t, g, unknown or other
  misc_feature (289)..(289): n is a, c, g, or t
  modified_base (309)..(309): a, c, t, g, unknown or other
  misc_feature (309)..(309): n is a, c, g, or t
  modified_base (385)..(385): a, c, t, g, unknown or other
  misc_feature (385)..(385): n is a, c, g, or t
tcagacagtatatacacgaccggtgctcgatttagtgacatctcgcagttctttgggggaggaactgctcagttaggacccagagggaaccatggaagccccagctcagcttctcttcctcctgctactctggctcccagagatcaccggagatattgtgttgacacagtctccaggtaccctgtctttgctccgagggganagacgcccaccctctccgtgtaggccagtcggagtgtnctaagtcctagcctggtaaccaanagaacctggccagcnccgagctctnatctatgatgacatccaagnggtcacgtcgccacccgagactggtcagtcggcagggtcggtcaggggaacacgtcttcacctcctacgacccgtnacgactaatcgtaacacgactagaagttacgtttgtactttaagtttattacgtagtactacgtacgtacgttcccgtttcccgtccgtaacggtcccgtaccgtccgttacccgggtttccgggggaccgggggtaaccgtaaggggtcgggaagtacgttacggaaggttacggtaacgttgggcggttcgttacgctacgtctcgtcgttcttaacgttcttcccg

SEQ ID NO: 326864 - DNA, 521 bp, Homo sapiens
  misc_feature: GZ8MTXP01A3P38.44.39.D06.1.454.CMB.2.raw
  modified_base (192)..(192): a, c, t, g, unknown or other
  misc_feature (192)..(192): n is a, c, g, or t
  modified_base (210)..(210): a, c, t, g, unknown or other
  misc_feature (210)..(210): n is a, c, g, or t
  modified_base (215)..(215): a, c, t, g, unknown or other
  misc_feature (215)..(215): n is a, c, g, or t
  modified_base (223)..(223): a, c, t, g, unknown or other
  misc_feature (223)..(223): n is a, c, g, or t
  modified_base (233)..(233): a, c, t, g, unknown or other
  misc_feature (233)..(233): n is a, c, g, or t
  modified_base (276)..(276): a, c, t, g, unknown or other
  misc_feature (276)..(276): n is a, c, g, or t
  modified_base (302)..(302): a, c, t, g, unknown or other
  misc_feature (302)..(302): n is a, c, g, or t
  modified_base (306)..(306): a, c, t, g, unknown or other
  misc_feature (306)..(306): n is a, c, g, or t
  modified_base (328)..(328): a, c, t, g, unknown or other
  misc_feature (328)..(328): n is a, c, g, or t
  modified_base (361)..(361): a, c, t, g, unknown or other
  misc_feature (361)..(361): n is a, c, g, or t
  modified_base (430)..(430): a, c, t, g, unknown or other
  misc_feature (430)..(430): n is a, c, g, or t
tcagacagtatatacacgaccggtgctcgatttagtgacatctcgcagttctttggggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcgtcaccntctcngcatggancagcgtaatnttctagtcttaacttgtctctgtatcacatcatccagtaaacnccccaaatcatcatctatgagcctanaagngcctgagggttcaatccgcttnactgcctaccaagtccgcaaacacggcctcccngacaatctagtggactccgagcgtagaggacgaggctagtattattattggtagctcagtatgttcgtncattcacttatcgtcttcgggaagttcggaacgtaaacggtcgaccgttcttagggtccacggccaacgggcccaaccctcgttcgtaacc

SEQ ID NO: 326865 - DNA, 684 bp, Homo sapiens
  misc_feature: GZ8MTXP01BTV1B.44.39.D06.1.454.CMB.2.raw
  modified_base (380)..(380): a, c, t, g, unknown or other
  misc_feature (380)..(380): n is a, c, g, or t
tcagacagtatatacacgaccggtgctcgatttagtgacatctcgcagttctttgggggcgggagtcagacccagtcaagacacagcgtggacatgagggtccccgctcagctcctggggctcctgctgctctggctcccaggtgccgactgtgccgtcagatgacccagtctccttccaccctgtctgcgtctctgggcgacagagtcacatcacttgccggcagtgagagtggctggatggctggtatcgaaggaaacggccgggacggtcccaagccgtccgtcggtctagtaaccgctacgttatttacgaacgtagttacgggggtcccgtcgtaacggttcgaggtgacgaagtaaacgtcgtgggtcaacgtntttacctctcctacacctatcgtaaattcgggccttacggcctagtacctgtacgttgtaacgtttttacggccgttaacctttacgttccgttcgacccgaagtacctaacgttatttaaacgtttcgtttttccccgttaccccgttcggttccccggttacccggggtaccccgggggtaaccttacggttacggttccgggtaaccccgtaaccgaaaccgttaaaccggttcggaccggtctacggttaccgttaccttacttcgtcttccgttctaccgttccttaacccgccgttcg

SEQ ID NO: 326866 - DNA, 784 bp, Homo sapiens
  misc_feature: GZ8MTXP01DLJVA.44.39.D06.1.454.CMB.2.raw
  modified_base (203)..(203): a, c, t, g, unknown or other
  misc_feature (203)..(203): n is a, c, g, or t
  modified_base (267)..(267): a, c, t, g, unknown or other
  misc_feature (267)..(267): n is a, c, g, or t
  modified_base (320)..(320): a, c, t, g, unknown or other
  misc_feature (320)..(320): n is a, c, g, or t
tcagacagtatatacacgaccggtgctcgatttagtgacatctcgcagttctttggggggaggaactgctcagttaggacccagagggaaccatggaagccccagctcagcttctcttcctcctgctactctggctcccagagatcaccggagatattgtgttgacacagtctccaggcaccctgtctttgctccgagggganagacgccacctctcctggtagggcctaggtcggagtgtgactaagtacctagcctaggaccaanagaactggaccaggcctcccaggctcctcatctatgatcgacactaccaacgngggtcacgtcggccaccccgagaccgtaggttccaggtggacgtagggtggggttacgacgggggaactaacggtacctttaccgaacccttccgtacccgacccgggtacaacggacctaaaagtctaaaccgcggtaccttaaaggaaaagttttggtttttccgaactttaagggttttaaattaccgttgggttaccctaagggggttacccctaaacggggttccccgttttccccgtaacccggaccggggttcccccgttaacttccccgggtttacgggggttttaccccggggggaacggggggtaacccgtaaagggggttcggaaagggttacgttacccggaaaggtaaaccccgggtaagggttttccggttcgggttacccttaacgggttaaaacccttcggttttaccccgtaggtttcccttttaacggaacccgtttttccccccg

SEQ ID NO: 326867 - DNA, 691 bp, Homo sapiens
  misc_feature: GZ8MTXP01EVMQ8.44.39.D06.1.454.CMB.2.raw
tcagacagtatatacacgaccggtgctcgatttagtgacatctcgcagttctttggggggcgggagtcagacccagtcaagacacagcgtggacatgagggtccccgctcagctcctggggctcctgctgctctggctcccaggtgccgactgtgccgtccagatcgacccagtcctccttccaccctgtctgcgtctcgtgggcacagagtcaccatcacgttcggccggcagtgaggagtggctggatcggctggtatacgaagggaaacggcccgggacggtacccgaagtctccgtgtacgtaataaccgtcttacttatttaacggacttacggttcggggtacccgtagtaaggttcgaggttaggacgtaaggtaacgttcgttagggtactacgttactttccgtcttcctacgtaacacttactaacgtcgggctcgacgtaacgtccgtaggtattacgttagttttacgaccgtttaccttacgttcctacgtacctacgtaccttacgttaactttaacgtttccgttttcccctccccggttacggttccccgggtttcccggggaccccgggtacgttaacggttcggtacccgtaccgtaaccaacggttacgttcgttcggacttcgccttaccgttactcttacgttccttccacgtttccctccgttcttaac

SEQ ID NO: 326868 - DNA, 509 bp, Homo sapiens
  misc_feature: GZ8MTXP02JPFZ2.44.39.D06.1.454.CMB.2.raw
  modified_base (191)..(191): a, c, t, g, unknown or other
  misc_feature (191)..(191): n is a, c, g, or t
  modified_base (225)..(225): a, c, t, g, unknown or other
  misc_feature (225)..(225): n is a, c, g, or t
tcagacagtatatacacgaccggtgctcgatttagtgacatctcgcagttctttgggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactgganccagcggtaatattctagtcttaactttgtctcctggtatcaacatcatccaggtaaagcccccaaactcatcatctatgaggcctataagagccctcaggggtttctaatccgcttcactgcctccaagtccgcaacacggcctccctgacaatctctggctccaggctgagacgaggctgattattattgttgctcagatgttcgtcgcatcacttatgttcttcggaagtcgggaccaaggtcaccgtctaggtcacgcccaggcccaacccgctcgtacc

SEQ ID NO: 326869 - DNA, 514 bp, Homo sapiens
  misc_feature: GZ8MTXP02IMTR5.44.39.D06.1.454.CMB.2.raw
  modified_base (203)..(203): a, c, t, g, unknown or other
  misc_feature (203)..(203): n is a, c, g, or t
  modified_base (308)..(308): a, c, t, g, unknown or other
  misc_feature (308)..(308): n is a, c, g, or t
  modified_base (352)..(352): a, c, t, g, unknown or other
  misc_feature (352)..(352): n is a, c, g, or t
  modified_base (370)..(370): a, c, t, g, unknown or other
  misc_feature (370)..(370): n is a, c, g, or t
tcagacagtatatacacgaccggtgctcgatttagtgacatctcgcagttctttggggaggaactgctcagttaggacccagagggaaccatggaagccccagctcagcttctcttcctcctgctactctggctcccagagatcaccggagatattgtgttgacacagtctccaggcacccttgtctttgtctccaggggganagagccacctctcctgtagggccagtcggagtgttgctaagtcctagcctggtacaacagaaacctggccaggctcccaggctcctcatctatgatgcatccaangggtcactggcacccagacaggttcagtgcagtggtctgggacngacttcactctcaccgtnagcaatgtacagcctagaagtattttgctagtttattactgtctagctagtcgttcctccaggccgctctacgtttcgggcgggggacaagggtcggagagtacgaagacgaacgtcgtaggcgtgcaccatctcgtcttctac

SEQ ID NO: 326870 - DNA, 520 bp, Homo sapiens
  misc_feature: GZ8MTXP02GEU9C.44.39.D06.1.454.CMB.2.raw
  modified_base (419)..(419): a, c, t, g, unknown or other
  misc_feature (419)..(419): n is a, c, g, or t
tcagacagtatatacacgaccggtgctcgatttagtgacatctcgcagttctttgggggggtcacaagaggcagcgctctcgggacgtctccaccatggcctgggctctgctgctcctcactctcctcactcaggacacagggtcctgggcccagtctgccctgactcagcctgcctccgtgtctggttctcctggacagtcgatcaccatctcctgcactgggtccagcaatgacattgggagatataaccttgtctcctggtatcaacaacatccaggcaaagcccccaaatcatacttttgagtccagtgagcggccgtcaggtcgtttctaatcgcttctctggctccaagtctggccacacggccctccctgtcgatctctgggctccggctgaggacgaggctgactattacngcggctcatttacaactcttgagtacgttgggtcgttcggcgggtacgggtactcaccgtcgaccgtcctaaggtcacgcccaaggcctcggccccctcgg

SEQ ID NO: 326871 - DNA, 550 bp, Homo sapiens
  misc_feature: GZ8MTXP02IEEJ6.44.39.D06.1.454.CMB.2.raw
  modified_base (356)..(356): a, c, t, g, unknown or other
  misc_feature (356)..(356): n is a, c, g, or t
  modified_base (394)..(394): a, c, t, g, unknown or other
  misc_feature (394)..(394): n is a, c, g, or t
tcagacagtatatacacgaccggtgctcgatttagtgacatctcgcagttctttgggggagctacaacaggcaggcaggggcagcaagatggtgttgcagacccaggtcttcatttctctgttgctctggatctctggtgcctgcggggacatcgcgatgagccagtctccagactccctggctgtgtctctgggcgagagggccaccgtcaactgcaactccagccaaagtgtcttttatcgtccccaatagtaagaactattagcctggtaccaacagaaaccggacagtctactaaattactcttttatggcatctacgtcggagtccgggtcctgaccgattcagtggcggnggtctgggcactatttccacttcctcacctatcagtancctgcaggctagaagacgtggactagtttattattagtactaaactaattatttagaaccttcttatctactttcggacggtaggaccagagtagagtaaatacgaaaacgacgttagtaggaacttaggacctaccaattcttacgttctttacc

SEQ ID NO: 326872 - DNA, 631 bp, Homo sapiens
  misc_feature: GZ8MTXP02IYFM7.44.39.D06.1.454.CMB.2.raw
  modified_base (202)..(202): a, c, t, g, unknown or other
  misc_feature (202)..(202): n is a, c, g, or t
  modified_base (310)..(310): a, c, t, g, unknown or other
  misc_feature (310)..(310): n is a, c, g, or t
  modified_base (358)..(358): a, c, t, g, unknown or other
  misc_feature (358)..(358): n is a, c, g, or t
  modified_base (376)..(376): a, c, t, g, unknown or other
  misc_feature (376)..(376): n is a, c, g, or t
tcagacagtatatacacgaccggtgctcgatttagtgacatctcgcagttctttgggggaggaactgctcagttaggacccagagggaaccatggaagccccagctcagcttctcttcctcctgctactctggctcccagagatcaccggagatattgtgttgacacagtctccaggcaccctgtctttgtctccagggganagagcccacctctcctgtagggccagtcggagtgttgctaagtacctagcctggtaccaacagaaacctggccaggctcccaggctcctcatctatgatgcatccaangggtcactggccacccagacaggttcagtggcagtgggtctggggacngtacttcacttctcacgntcagatatcacacgtcgtagtagtttattgactttagtttattacgtgttacgacgtacgtaccggttccgtttcccgaccggaccggtcccgttccgtacccgtttaccggggtttacccggggggaccgggggtaaaccggtaaagggggtacgggtaaacggtacgttaaaccggaacgggtaaaccgtaacggttcgggtacggttcgtaccggaccgtaacctacgtttcgttacgtttaccgtttaccg

SEQ ID NO: 326873 - DNA, 516 bp, Homo sapiens
  misc_feature: GZ8MTXP02IPEQB.44.39.D06.1.454.CMB.2.raw
tcagacagtatatacacgaccggtgctcgatttagtgacatctcgcagttctttgggggagctacaacaggcaggcaggggcagcaagatggtgttgcagacccaggtcttcatttctctgttgctctggatctctggtgcctgcggggacatcgcgatgagccagtctccagacctccctggctgtgtctctgggcgagagggccaccgtcaactgccaactcagccaaagtgtctttatgtccccaatagtaagaactattagcctggtaccaacagaaaccggacagtctcctaaattactctttatggcatctactcgggagtccggggtcctgaccgattcagtcggcggcggtctgggcacattcactctcaccatcagtagcctgcaggctgaagacgtggctagtttattattgtacaacattatttagaaacttcctatctactttcggacggtagaccagagtagagtatacaaacgaactgtaggctgcaccatactcgtcttac

SEQ ID NO: 326874 - DNA, 551 bp, Homo sapiens
  misc_feature: GZ8MTXP02G3BV4.44.39.D06.1.454.CMB.2.raw
  modified_base (263)..(263): a, c, t, g, unknown or other
  misc_feature (263)..(263): n is a, c, g, or t
  modified_base (288)..(288): a, c, t, g, unknown or other
  misc_feature (288)..(288): n is a, c, g, or t
  modified_base (299)..(299): a, c, t, g, unknown or other
  misc_feature (299)..(299): n is a, c, g, or t
  modified_base (328)..(328): a, c, t, g, unknown or other
  misc_feature (328)..(328): n is a, c, g, or t
  modified_base (363)..(363): a, c, t, g, unknown or other
  misc_feature (363)..(363): n is a, c, g, or t
  modified_base (389)..(389): a, c, t, g, unknown or other
  misc_feature (389)..(389): n is a, c, g, or t
  modified_base (394)..(394): a, c, t, g, unknown or other
  misc_feature (394)..(394): n is a, c, g, or t
  modified_base (411)..(411): a, c, t, g, unknown or other
  misc_feature (411)..(411): n is a, c, g, or t
tcagacagtatatacacgaccggtgctcgatttagtgacatctcgcagttctttgggggagagacgagcccagcactggaagtcgccggtgtttccattcggtgatcatcactgaacacagaggactcaccatggagtttgggctgagctgggttttcctcgttgctcttttaagaggtgtccagtgtcaggagcacttggtggagtcgtgggggagcgtggtccaggcccgggaggtccctgagactctcctgtgtagcctntggtctcattcgatagatttggttncactgggtccncaggctccgaggcaaggggccgagtgggngcagtcatctccgagatggaatgagaagtattacnagactccgtgaagggcattcacatcncaganacaataccaaagaatangctagtattagacaaatgaaacagacgtagagagttgaacgacacgtctagtttattactgtacggacggtacgggggacctaccggaaaaggtaaccgggtacggggaaactcgaaattaaaacgtacctaactttaag

SEQ ID NO: 326875 - DNA, 516 bp, Homo sapiens
  misc_feature: GZ8MTXP02G7FZ3.44.39.D06.1.454.CMB.2.raw
  modified_base (418)..(418): a, c, t, g, unknown or other
  misc_feature (418)..(418): n is a, c, g, or t
  modified_base (422)..(422): a, c, t, g, unknown or other
  misc_feature (422)..(422): n is a, c, g, or t
tcagacagtatatacacgaccggtgctcgatttagtgacatctcgcagttctttggggggtcacaagaggcagcgctctcgggacgtctccaccatggcctgggctctgctgctcctcactctcctcactcaggacacagggtcctgggcccagtctgccctgactcagcctgcctccgtgtctggttctcctggacagtcgatcaccatctcctgcactgggtccagcaatgacattggagatataaccttgtctcctggtatcaaacaacatccaaggcaaaacgcccccaaaactcatacttttgagtccagtgagcgcgtcagtgtttctaatcgcttctctggctccaagtctgccacacgccctccctgtcgatctctgggctccggcctgaggacgaggctgactattacngcgntcatttacaacttctgagtacttgggtcgttcgggcggagggactcgacctcgacccgtcgtaaggtcacgtcccaaaggcctcgcccctccgg

SEQ ID NO: 326876 - DNA, 501 bp, Homo sapiens
  misc_feature: GZ8MTXP02I88IC.44.39.D06.1.454.CMB.2.raw
  modified_base (200)..(200): a, c, t, g, unknown or other
  misc_feature (200)..(200): n is a, c, g, or t
  modified_base (307)..(307): a, c, t, g, unknown or other
  misc_feature (307)..(307): n is a, c, g, or t
  modified_base (354)..(354): a, c, t, g, unknown or other
  misc_feature (354)..(354): n is a, c, g, or t
tcagacagtatatacacgaccggtgctcgatttagtgacatctcgcagttctttggggaggaactgctcagttaggacccagagggaaccatggaagccccagctcagcttctcttcctcctgctactctggctcccagagatcaccggagatattgtgttgacacagtctccaggcaccctgtctttgctccagggganagagccaccctctcctgtagggccagtcggagtgttgctaagtacctagcctggtaccaacagaaacctggccaggctccaggctcctcatctatgatgcatccaanagggtcactggcaccccagacaggttcagtgcagtggtctggggacngacttcactctcacgtcagcaatgtacagcctgaagtatttgactagtttattactgtctagctagcttctccagccgctcacgtttcggcgggggtacaaggtggacgatcagacgaactgtggctgcaccgtctctcgtcttcac

SEQ ID NO: 326877 - DNA, 512 bp, Homo sapiens
  misc_feature: GZ8MTXP02JMXZZ.44.39.D06.1.454.CMB.2.raw
  modified_base (415)..(415): a, c, t, g, unknown or other
  misc_feature (415)..(415): n is a, c, g, or t
tcagacagtatatacacgaccggtgctcgatttagtgacatctcgcagttctttgggggggtcacaagaggcagcgctctcgggacgtctccaccatggcctgggctctgctgctcctcactctcctcactcaggacacagggtcctgggcccagtctgccctgactcagcctgcctccgtgtctggttctcctggacagtcgatcaccatctcctgcactgggtccagcaatgacattgggagatataaccttgtctcctggtatcaacaacatccaggcaaagcccccaaatcatacttttgagtccagtgagcggccgtcaggtgtttctaatcgcttctctgctccaagtctgccacacgcctccctgtcgatctctgggctccggcctgaggacgaggctgactattacngcggctcatttacaactcttgagtacttgggtcgttcgggcggtacgggactcaccgtcgaccgtctaaggtcacgcccgaagcctcgccccctcgg

SEQ ID NO: 326878 - DNA, 516 bp, Homo sapiens
  misc_feature: GZ8MTXP02JK82X.44.39.D06.1.454.CMB.2.raw
  modified_base (414)..(414): a, c, t, g, unknown or other
  misc_feature (414)..(414): n is a, c, g, or t
tcagacagtatatacacgaccggtgctcgatttagtgacatctcgcagttctttggggggtcacaagaggcagcgctctcgggacgtctccaccatggcctgggctctgctgctcctcactctcctcactcaggacacagggtcctgggcccagtctgccctgactcagcctgcctccgtgtctggttctcctggacagtcgatcaccatctcctgcactgggtccagcaatgacattgggagatataaccttgtctcctggtatcaacaacatccaggcaaacgcccccaaatcatacttttgagtccagtgagcgccgtcaggtcgtttctaatcgcttctctgctcagtctgccacacgccctccctgtcgatctctgggctccggctggaggacgagctgactattacgngcggtctctatttacacttcttgagtacgttgggtcgttcggcggtacgggctcgaccgtcgacccgtcgtaaggtcacgcccgaaggcctcgccccgtcgg

SEQ ID NO: 326879 - DNA, 515 bp, Homo sapiens
  misc_feature: GZ8MTXP02I3TA2.44.39.D06.1.454.CMB.2.raw
  modified_base (239)..(239): a, c, t, g, unknown or other
  misc_feature (239)..(239): n is a, c, g, or t
tcagacagtatatacacgaccggtgctcgatttagtgacatctcgcagttctttgggggagctacaacaggcaggcaggggcagcaagatggtgttgcagacccaggtcttcatttctctgttgctctggatctctggtgcctgcggggacatcgcgatgagccagtctccagactccctggctgtgtctctgggcgagagggccaccgtcaactgcaactccagccaagtgtctttangtcccaatagtaagactattagctggtaccaacagaaccggacagtctcctaaattctctttatggcatctacgtcgggtacgtccggggtcctgaccgattcagtggcggcggtctgggcactatttcactctcaccatcagtacgcctgcagctgaacgcgtgctagtttattattgtacaatattatttaagactcctatactacttcggacggtaggacctaggagtaagagtatacgaaacgtaacgtgtagctgactacatctgtcttac

SEQ ID NO: 326880 - DNA, 499 bp, Homo sapiens
  misc_feature: GZ8MTXP02HE8KF.44.39.D06.1.454.CMB.2.raw
  modified_base (364)..(364): a, c, t, g, unknown or other
  misc_feature (364)..(364): n is a, c, g, or t
tcagacagtatatacacgaccggtgctcgatttagtgacatctcgcagttctttgggggagctacaacaggcaggcaggggcagcaagatggtgttgcagacccaggtcttcatttctctgttgctctggatctctggtgcctgcggggacatcgcgatgagccagtctccagactccctggctgtgtctctgggcgagagggccaccgtcaactgcaactccagccaaagtgtctttatgtccccaatagtaagaactattagcctggtaccaacagaaaccggacagtctcctaaattactctttatggcatctactcgggagtccggggtcctgaccgattcagtggcggcggtctgggcncatttcactctcaccatcagtagcctgcaggctgaagacgtgctagtttatattgcaacaatatttagaacttctatcactttcggcgaggaccagagtagagatacaaacgactgtagctgcacatctgtctac

SEQ ID NO: 326881 - DNA, 513 bp, Homo sapiens
  misc_feature: GZ8MTXP02HD7QI.44.39.D06.1.454.CMB.2.raw
tcagacagtatatacacgaccggtgctcgatttagtgacatctcgcagttctttgggggagctacaacaggcaggcaggggcagcaagatggtgttgcagacccaggtcttcatttctctgttgctctggatctctggtgcctgcggggacatcgcgatgagccagtctccagactccctggctgtgtctctgggcgagagggccaccgtcaactgcaactccagccaaagtgtctttatgtccccaatagtaagaactattagcctggtaccaacagaaaccggacagtctacctaaattactctttatggcatctactcgggagtccggggtcctgaccgattcagtggcggcggtctgggcacgatttcactctcaccatcagtagcctgcagctgaagacgtggcagtttatattgtactaaacaattatttagaacttctatcactttcggacgaggaccagagtagagatacaaaacgaactgtggctgacaccatctacgtcttac

SEQ ID NO: 326882 - DNA, 506 bp, Homo sapiens
  misc_feature: GZ8MTXP02IP0SL.44.39.D06.1.454.CMB.2.raw
  modified_base (309)..(309): a, c, t, g, unknown or other
  misc_feature (309)..(309): n is a, c, g, or t
  modified_base (356)..(356): a, c, t, g, unknown or other
  misc_feature (356)..(356): n is a, c, g, or t
  modified_base (426)..(426): a, c, t, g, unknown or other
  misc_feature (426)..(426): n is a, c, g, or t
  modified_base (434)..(434): a, c, t, g, unknown or other
  misc_feature (434)..(434): n is a, c, g, or t
tcagacagtatatacacgaccggtgctcgatttagtgacatctcgcagttctttgggggaggaactgctcagttaggacccagagggaaccatggaagccccagctcagcttctcttcctcctgctactctggctcccagagatcaccggagatattgtgttgacacagtctccaggcaccctgtctttgtctccgaggggagagagccacctctcctgtagggccagtcggagtgttgctaagtacctagcctggtaccaacagaaacctggccaggctcccagctcctcatctatgatgcatccaanagggtcacgtggccaccccagacaggtcagtgcagtggtctgggacngcttcactctcacgtcagcaatgtacagcctagaatattttgctagtttatactgtcagcagtcgttccnccaggccnctctacgttcgggcgggggacagggtcgagatcgaagacgacgtgtgctgccactactctcgtcttactacg

SEQ ID NO: 326883 - DNA, 512 bp, Homo sapiens
  misc_feature: GZ8MTXP02IH1BK.44.39.D06.1.454.CMB.2.raw
  modified_base (204)..(204): a, c, t, g, unknown or other
  misc_feature (204)..(204): n is a, c, g, or t
  modified_base (293)..(293): a, c, t, g, unknown or other
  misc_feature (293)..(293): n is a, c, g, or t
  modified_base (312)..(312): a, c, t, g, unknown or other
  misc_feature (312)..(312): n is a, c, g, or t
  modified_base (357)..(357): a, c, t, g, unknown or other
  misc_feature (357)..(357): n is a, c, g, or t
  modified_base (373)..(373): a, c, t, g, unknown or other
  misc_feature (373)..(373): n is a, c, g, or t
  modified_base (477)..(477): a, c, t, g, unknown or other
  misc_feature (477)..(477): n is a, c, g, or t
tcagacagtatatacacgaccggtgctcgatttagtgacatctcgcagttctttgggggaggaactgctcagttaggacccagagggaaccatggaagccccagctcagcttctcttcctcctgctactctggctcccagagatcaccggagatattgtgttgacacagtctccaggcaccctgtctttgtctccgaggggganagagcccacctctcctgtagggccagtcggagtgttgctaagtcctagcctggtaaccaacagaaacctggccaggctcccaggctccncatctatgatgcatccaanagggtcactggccacccagacaggtcagtgcagtggtctgggacngcttcactctcacgtnagcaatgtacagcctagaagtattttgacttagtttattactgtcagtcagtcgttcctccgacggccgctcgtacgtttcgggcgggggaccgaaggtggagntcgagacgacgtgtgctgcactatctcgtctctac

SEQ ID NO: 326884 - DNA, 550 bp, Homo sapiens
  misc_feature: GZ8MTXP02IY92G.44.39.D06.1.454.CMB.2.raw
  modified_base (317)..(317): a, c, t, g, unknown or other
  misc_feature (317)..(317): n is a, c, g, or t
  modified_base (365)..(365): a, c, t, g, unknown or other
  misc_feature (365)..(365): n is a, c, g, or t
  modified_base (422)..(422): a, c, t, g, unknown or other
  misc_feature (422)..(422): n is a, c, g, or t
tcagacagtatatacacgaccggtgctcgatttagtgacatctcgcagttctttggggggtcacaagaggcagcgctctcgggacgtctccaccatggcctgggctctgctcctcctcaccctcctcactcaggcacaggatcctgggctcagtctgccctggctcagcctccctccgtgtccggtctcctggacagtcagtcaccatctcctgcactggaaccaacagtgacgtcggtcgttttgaccgtgtctcctggtaccagcacgaccccagaaacacgcccccaaatcatttattatgcgtacaatgttcncccttcgtctccctgagtcgcttctccgtggtccaagtctggacaacncggcctcctgaccatctcgtcgggcctccgagctagagacgagctagtattatacgngacagtctacatactacgaagtacgtaacttacttacgtacgtcgacgacgaacggtacagccgtacgaccgtcgtacgtacacgaccgaacgtcctaccgtccccgtacgtacctaccgttcgtccg

SEQ ID NO: 326885 - DNA, 538 bp, Homo sapiens
  misc_feature: GZ8MTXP02F6NK3.44.39.D06.1.454.CMB.2.raw
  modified_base (225)..(225): a, c, t, g, unknown or other
  misc_feature (225)..(225): n is a, c, g, or t
  modified_base (285)..(285): a, c, t, g, unknown or other
  misc_feature (285)..(285): n is a, c, g, or t
  modified_base (427)..(427): a, c, t, g, unknown or other
  misc_feature (427)..(427): n is a, c, g, or t
  modified_base (454)..(454): a, c, t, g, unknown or other
  misc_feature (454)..(454): n is a, c, g, or t
tcagacagtatatacacgaccggtgctcgatttagtgacatctcgcagttctttgggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactgganccagcggtaatattcttagtcttaactttgtctcctgtatcaacatcatccaggtaaacnccccaaatcatcatctatgagcctataagaggccctgagggtttcaatccgcttcactgcctcaagtccggacaacacggccctccctagacaatctctggctccgagctgacggacgaggctgatttattattgttgcttnagtatgttcgcgcaatcctaactttangtttcttcggaaagtcgggaaacctaaagggtcctaaccgtcctaggtccacgaccccaaaggccccaaaaccctactgtaccc

SEQ ID NO: 326886 - DNA, 519 bp, Homo sapiens
  misc_feature: GZ8MTXP02J3QZJ.44.39.D06.1.454.CMB.2.raw
  modified_base (288)..(288): a, c, t, g, unknown or other
  misc_feature (288)..(288): n is a, c, g, or t
  modified_base (447)..(447): a, c, t, g, unknown or other
  misc_feature (447)..(447): n is a, c, g, or t
  modified_base (498)..(498): a, c, t, g, unknown or other
  misc_feature (498)..(498): n is a, c, g, or t
tcagacagtatatacacgaccggtgctcgatttagtgacatctcgcagttctttgggggagctacaacaggcaggcaggggcagcaagatggtgttgcagacccaggtcttcatttctctgttgctctggatctctggtgcctgcggggacatcgcgatgagccagtctccagactccctggctgtgtctctgggcgagagggccaccgtcaactgcaactccagccaaagtgtctttatgtccccaatagtaagaactatttagcctggtaccaacagaaaccgganagtctacctaaattactcttttatggcatctactcggggagtccggggtccctgaccgattcagtggcggcgggtctggggcacatttcactctcaccatcagtagcctgccagctagaagacgtgggctagtttattattgtcaactattagttttanaactcctatctacgtttgcggaggaccagagtagagatacaaaacgactgnggctgcaccatcctgtctttc

SEQ ID NO: 326887 - DNA, 514 bp, Homo sapiens
  misc_feature: GZ8MTXP02GC88G.44.39.D06.1.454.CMB.2.raw
  modified_base (202)..(202): a, c, t, g, unknown or other
  misc_feature (202)..(202): n is a, c, g, or t
  modified_base (309)..(309): a, c, t, g, unknown or other
  misc_feature (309)..(309): n is a, c, g, or t
  modified_base (350)..(350): a, c, t, g, unknown or other
  misc_feature (350)..(350): n is a, c, g, or t
  modified_base (356)..(356): a, c, t, g, unknown or other
  misc_feature (356)..(356): n is a, c, g, or t
  modified_base (372)..(372): a, c, t, g, unknown or other
  misc_feature (372)..(372): n is a, c, g, or t
tcagacagtatatacacgaccggtgctcgatttagtgacatctcgcagttctttgggggaggaactgctcagttaggacccagagggaaccatggaagccccagctcagcttctcttcctcctgctactctggctcccagagatcaccggagatattgtgttgacacagtctccaggcaccctgtctttgtctccagggganagagccaccctctcctgtagggccagtcggagtgttgctaagtcctagcctggtaccaacagaaacctggccaggctcccaggctcctcatctatgatgcatccaanagggtcactggcaccccagacaggttcagtgcagtgggtcngggacngcttcactctcacgtnagcaatgtacagcctgaagtattttgctagtttattactgtcagcagtcgttcctccacggccgctcgtacgtttcgggacgggggaccgaagggtcggagagtcaggacgaacgtgtggactgcacgatctcgtctctacg

SEQ ID NO: 326888 - DNA, 536 bp, Homo sapiens
  misc_feature: GZ8MTXP02HSFL9.44.39.D06.1.454.CMB.2.raw
  modified_base (422)..(422): a, c, t, g, unknown or other
  misc_feature (422)..(422): n is a, c, g, or t
tcagacagtatatacacgaccggtgctcgatttagtgacatctcgcagttctttgggggggtcacaagaggcagcgctctcgggacgtctccaccatggcctgggctctgctgctcctcactctcctcactcaggacacagggtcctgggcccagtctgtcctgactcagcctgcctccgtgtctggttctcctggacagtcgatcaccatctcctgcactgggtccagcaatgacattgggagatataaccttgtctcctggtatcaacaacatccaggcaaacgcccccaaactcatacttttgagtccagtgagcgcgtcaggtcgtttctaatcgcttctctggctccaagtctgccacacgccctccctgcgtatctcgtgggctcccggactggagacgaggctgacttattacgngcggctctatttacaacttctagacgtacgttggggtcgttcgggcggacgggactcgaccgtcggtaacccgtcgtaacggtcacggacccaaggcctccgtcccccgtccgg

SEQ ID NO: 326889 - DNA, 526 bp, Homo sapiens
  misc_feature: GZ8MTXP02G3P5I.44.39.D06.1.454.CMB.2.raw
  modified_base (203)..(203): a, c, t, g, unknown or other
  misc_feature (203)..(203): n is a, c, g, or t
  modified_base (264)..(264): a, c, t, g, unknown or other
  misc_feature (264)..(264): n is a, c, g, or t
  modified_base (311)..(311): a, c, t, g, unknown or other
  misc_feature (311)..(311): n is a, c, g, or t
  modified_base (361)..(361): a, c, t, g, unknown or other
  misc_feature (361)..(361): n is a, c, g, or t
  modified_base (401)..(401): a, c, t, g, unknown or other
  misc_feature (401)..(401): n is a, c, g, or t
tcagacagtatatacacgaccggtgctcgatttagtgacatctcgcagttctttgggggaggaactgctcagttaggacccagagggaaccatggaagccccagctcagcttctcttcctcctgctactctggctcccagagatcaccggagatattgtgttgacacagtctccaggcaccctgtctttgtctccaggggganagagccaccctctcctggtagggccagtcggagtgttgctaagtcctagcctggtaccaanagaaacctggccaggctcccaggctcctcatctatgatgcatccaanagggtcactggccaccccagacaggttcagtggcagtgggtctggggacngacttcactctcacgtcagcaatgtacagcctgaaacgtntttgacttaagtttattactgtactagctagtcgttcctaccgacgggccctctctacgtttcgggaccgggggtacaagggtggagatcgagacgacgtgtggctgcaccatcctgtcttctac

SEQ ID NO: 326890 - DNA, 509 bp, Homo sapiens
  misc_feature: GZ8MTXP02I91MZ.44.39.D06.1.454.CMB.2.raw
  modified_base (375)..(375): a, c, t, g, unknown or other
  misc_feature (375)..(375): n is a, c, g, or t
tcagacagtatatacacgaccggtgctcgatttagtgacatctcgcagttctttgggggggtcacaagaggcagcgctctcgggacgtctccaccatggcctgggctctgctattcctcaccctcctcactcagggcacagggtcctgggcccagtctgccctgactcagcctgcctccgtgtctgggtcacctggacagtcgatcaccatctcctgcattggaaccagcggtaatattcttagtcttaacttgtctcctggtatcaacatcatccaggtaaagcccccaaactcatcatctatgagcctataagagcctcaggggtttcaatcgcttcactgcctcagtcgcacacggcctccctgacatctcnggctccaggctgagcgaggctgattattattgttgatcagtattgttcgtgctatcactttatgtctttacggagttgggacccaaaggtcaccgtctaggtcaacgcccaaggcccaacccactcgtactacc

SEQ ID NO: 326891 - DNA, 613 bp, Homo sapiens
  misc_feature: GZ8MTXP02IWLE7.44.39.D06.1.454.CMB.2.raw
  modified_base (204)..(204): a, c, t, g, unknown or other
  misc_feature (204)..(204): n is a, c, g, or t
  modified_base (294)..(294): a, c, t, g, unknown or other
  misc_feature (294)..(294): n is a, c, g, or t
  modified_base (312)..(312): a, c, t, g, unknown or other
  misc_feature (312)..(312): n is a, c, g, or t
  modified_base (360)..(360): a, c, t, g, unknown or other
  misc_feature (360)..(360): n is a, c, g, or t
tcagacagtatatacacgaccggtgctcgatttagtgacatctcgcagttctttgggggaggaactgctcagttaggacccagagggaaccatggaagccccagctcagcttctcttcctcctgctactctggctcccagagatcaccggagatattgtgttgacacagtctccaggcaccctgtctttgtctccgaggggganagagcccacctctcctgtagggccaggtcggagtgttgctaagtacctagcctggtacaacagaaacctggccaggctcccaggctcctnatctatgatgcatccaanagggtcactggcaccccagacaggttcagtggcaggtggtctgggacngacttcactcctcaccgtcagcaatgtacagcctgaatattttgacttagtttattattgtcagctagtccgtttctccgacggcccgtacgttccgtaaccggttttccgggggaccggggggtaacccgtaaaggggtacggggtaacggtaacgttaccggaaacggtaaaccggtaaaaccgtggggttacggtaccgttcggacctaacccgtaacgttcgttacggtttccgtttacgtttaacccg

SEQ ID NO: 326892 - DNA, 520 bp, Homo sapiens
  misc_feature: GZ8MTXP02HBME1.44.39.D06.1.454.CMB.2.raw
tcagacagtatatacacgaccggtgctcgatttagtgacatctcgcagttctttgggggagctacaacaggcaggcaggggcagcaagatggtgttgcagacccaggtcttcatttctctgttgctctggatctctggtgcctgcggggacatcgcgatgagccagtctccagactccctggctgtgtctctgggcgagagggccaccgtcaactgcaactccagccaaagtgtctttatgtccccaatagtaagaactattagcctaggtaccaacagaaaccggacagtctacctaaattactactttatggctatctactcgggagtccggggtcctgaccgattcagtcggcggcggtctgggcacatttcactctcaccatcagtagcctgcagctagaagacgtggactagtttattattgtacaaactaattatttaagaacttctaatctacgtttggacggtaggaccagagtagagatacaaacgaactgtagctgacacatctgtctac

SEQ ID NO: 326893 - DNA, 574 bp, Homo sapiens
  misc_feature: GZ8MTXP02GS9EJ.44.39.D06.1.454.CMB.2.raw
  modified_base (201)..(201): a, c, t, g, unknown or other
  misc_feature (201)..(201): n is a, c, g, or t
  modified_base (360)..(360): a, c, t, g, unknown or other
  misc_feature (360)..(360): n is a, c, g, or t
tcagacagtatatacacgaccggtgctcgatttagtgacatctcgcagttctttgggggaggaactgctcagttaggacccagagggaaccatggaagccccagctcagcttctcttcctcctgctactctggctcccagagatcaccggagatattgtgttgacacagtctccaggcaccctgtctttgctccagggganagagccaccctctcctgtagggccagtcggagtgttgctaagtcctagcctggtaccaacagaaacctggccaggctcccaggctcctcatctatgatgcatccaacagggtcacgtggccaccccagacaggttcagtggcaggtgggtctggggacngcttcactctcaccgtcagcaatgtacagcctgaaagtatttgactaagtttattacttgtcaagtcagtcgttacctccgacggcccgcctcgtaccgtttccggggacgggggtacccgaaaggggtcggacggacgtaccgaacggaaccggtaaacgttcgggtcggtacgtcggaccgaacccgtattccgtcgttacctttcgtaccg

SEQ ID NO: 326894 - DNA, 584 bp, Homo sapiens
  misc_feature: GZ8MTXP02GSS3R.44.39.D06.1.454.CMB.2.raw
tcagacagtatatacacgaccggtgctcgatttagtgacatctcgcagttctttgggggagctacaacaggcaggcaggggcagcaagatggtgttgcagacccaggtcttcatttctctgttgctctggatctctggtgcctgcggggacatcgcgatgagccagtctccagacctccctggctgtgtctctgggcgaggacgggccaccgtcaactgccaactccagaccaaagtgtctttatgtaccccaatagtaagaactattagcctggtaccaacagaaaccggacagtctacctaaattactctttatggctatctacgtcgggacgtccggggtcctgaccgtatcgagtggcggtcgggtctgggcactattcactctcaccatacagtacgcctgcaggctagaagtcgtggactagtttattagttgtactaaataactttatttaagaaccttaccttaattccgtacgtttcggacgggtacggaaccgtaaggaggtaagaacgtaaataccgtaaaacgtaacctaggtacggtaacgtcgtacacctagttccttacgtttcttacc

SEQ ID NO: 326895 - DNA, 540 bp, Homo sapiens
  misc_feature: GZ8MTXP02GEK59.44.39.D06.1.454.CMB.2.raw
  modified_base (424)..(424): a, c, t, g, unknown or other
  misc_feature (424)..(424): n is a, c, g, or t
tcagacagtatatacacgaccggtgctcgatttagtgacatctcgcagttctttggggggggtcacaagaggcagcgctctcgggacgtctccaccatggcctgggctctgctgctcctcactctcctcactcaggacacagggtcctgggcccagtctgccctgactcagcctgcctccgtgtctggttctcctggacagtcgatcaccatctcctgcactgggtccagcaatgacattggagatataaccttgtctcctgtatcaacaacatccaggacaaacgcccccaaactcatacttttgagtccagtgacgcggccgtctaggttcgtttactaatcgcttctctggcctcaagtctgccacacggcctcctgtcgatctctgggctccggctgaggacgaggctagacttattacngcggctactattacaacttctgagtacgttgggtcgttcggaggacggtactcgaccgtacgtacccgttcgtaacggtcaccggtaccccgaaggccctaccggcccccgttcgg

SEQ ID NO: 326896 - DNA, 529 bp, Homo sapiens
  misc_feature: GZ8MTXP02IDP58.44.39.D06.1.454.CMB.2.raw
  modified_base (241)..(241): a, c, t, g, unknown or other
  misc_feature (241)..(241): n is a, c, g, or t
tcagacagtatatacacgaccggtgctcgatttagtgacatctcgcagttctttgggggagctacaacaggcaggcaggggcagcaagatggtgttgcagacccaggtcttcatttctctgttgctctggatctctggtgcctgcggggacatcgcgatgagccagtctccagactccctggctgtgtctctgggcgagagggccaccgtcaactgcaactccagccaaagtgtcttttangtccccaatagtaagaactattagcctggtaccaacagaaaccggacagtctacctaaattactctttatggcatctactcggagtccgggtcctgaccgatccagtggcggcggtctgggcactatttcactctcacatcagtagcctgcagctgaagacgtgctagtttattattagtactaaactaattatttaagaacttctaatctactttcggacggtaggaccgagagtagagtaactacaaacgaacgtgtacggaactcgacacctatctacgtcttac

SEQ ID NO: 326897 - DNA, 545 bp, Homo sapiens
  misc_feature: GZ8MTXP02JKDRY.44.39.D06.1.454.CMB.2.raw
  modified_base (292)..(292): a, c, t, g, unknown or other
  misc_feature (292)..(292): n is a, c, g, or t
  modified_base (306)..(306): a, c, t, g, unknown or other
  misc_feature (306)..(306): n is a, c, g, or t
  modified_base (374)..(374): a, c, t, g, unknown or other
  misc_feature (374)..(374): n is a, c, g, or t
  modified_base (404)..(404): a, c, t, g, unknown or other
  misc_feature (404)..(404): n is a, c, g, or t
  modified_base (426)..(426): a, c, t, g, unknown or other
  misc_feature (426)..(426): n is a, c, g, or t
tcagacagtatatacacgaccggtgctcgatttagtgacatctcgcagttctttgggggagagacgagcccagcactggaagtcgccggtgtttccattcggtgatcatcactgaacacagaggactcaccatggagtttgggctgagctgggttttcctcgttgctcttttaagaggtgtccagtgtcaggagcacttggtggagtctgggggaggcgtggtccaggaccgggaggtccctgagactctcctgtgtagcctgtgggttctcattcgattagattttggttncacgtggggtcccnccaggcctccgaggcaaggggccggagtgggtgcagtcatcgtcgagatggaagtgagaagtattacnagactccggtagaagggccattcaccatcnccagagacaatccaaagaatangctagtatttgacaaatgaacagcgtagaggagttgacgactacgtcttagtttatactgtgcggacgggacctcgaaacgggaacggtacgggaatacgaataaactacgtacttaag

SEQ ID NO: 326898 - DNA, 544 bp, Homo sapiens
  misc_feature: GZ8MTXP02GN99M.44.39.D06.1.454.CMB.2.raw
  modified_base (202)..(202): a, c, t, g, unknown or other
  misc_feature (202)..(202): n is a, c, g, or t
  modified_base (309)..(309): a, c, t, g, unknown or other
  misc_feature (309)..(309): n is a, c, g, or t
  modified_base (355)..(355): a, c, t, g, unknown or other
  misc_feature (355)..(355): n is a, c, g, or t
  modified_base (367)..(367): a, c, t, g, unknown or other
  misc_feature (367)..(367): n is a, c, g, or t
  modified_base (395)..(395): a, c, t, g, unknown or other
  misc_feature (395)..(395): n is a, c, g, or t
tcagacagtatatacacgaccggtgctcgatttagtgacatctcgcagttctttgggggaggaactgctcagttaggacccagagggaaccatggaagccccagctcagcttctcttcctcctgctactctggctcccagagatcaccggagatattgtgttgacacagtctccaggcaccctgtctttgctccaggggganagagccaccctctcctgtagggccagtcggagtgttgctaagtcctagcctggtaccaacagaaacctggccaggctcccaggctcctcatctatgatgcatccaangggtcacgtgccaccccagacaggttcagtgcagtggtctgggacngtacttcactcncacgtcagcaatgtacagcctagaagtntttgactagtttattactgtacagctagccgttacctcgacggtccgactccgtacgtttccggggacgggggtacccgtaaaggggtcggacgacgtacgacggaaccgtaacgtgtgggctggccaactctcgtcgttcttcgtacc

SEQ ID NO: 326899 - DNA, 556 bp, Homo sapiens
  misc_feature: GZ8MTXP02IDZXP.44.39.D06.1.454.CMB.2.raw
tcagacagtatatacacgaccggtgctcgatttagtgacatctcgcagttctttgggggagctacaacaggcaggcaggggcagcaagatggtgttgcagacccaggtcttcatttctctgttgctctggatctctggtgcctgcggggacatcgcgatgagccagtctccagactccctggctgtgtctcgtgggcgagagggccaccgtcaactgcaactccagccaaagtgtcttttatcgtccccaatagtaagactattagcctggtaccaacagaaaccggacagtctcctaaattactcttttatgggctatctacgtcgggagtccggggtcctgaccgattcgaggtggcgggcgggtcgtggggacacgtatttccacttcctcaccatccagtacgccctgaccagggctggaaagacgtggactagtttattatttgtacaactaattatttaagaaccttctatctaacgtttggacggtaggacctaggagtagagatacgaaaacgaactgtaggctcggacacctatcttagtctttacc

SEQ ID NO: 326900 - DNA, 536 bp, Homo sapiens
  misc_feature: GZ8MTXP02HP2ZH.44.39.D06.1.454.CMB.2.raw
  modified_base (202)..(202): a, c, t, g, unknown or other
  misc_feature (202)..(202): n is a, c, g, or t
  modified_base (263)..(263): a, c, t, g, unknown or other
  misc_feature (263)..(263): n is a, c, g, or t
  modified_base (382)..(382): a, c, t, g, unknown or other
  misc_feature (382)..(382): n is a, c, g, or t
tcagacagtatatacacgaccggtgctcgatttagtgacatctcgcagttctttgggggaggaactgctcagttaggacccagagggaaccatggaagccccagctcagcttctcttcctcctgctactctggctcccagagatcaccggagatattgtgttgacacagtctccaggcaccctgtctttgtctccagggganagagcccaccctccctgtacgggccagtcggagtgttgctaagtcctagcctggtaccaanagaaacctggccaggctccgaggcctcctcatctatgatgcatccaagagggtcacgtggccaccccagacctaggtcagtcggcaggtgggctgggacagtcttcactctccaccgtnagcaatgtacagctgaagtattttgacttagtttattactgtacagtcaggtccttcctccgacggccgtctcgtacgtttcggggcgggggtaccaagggtcggagagtcgacgtacggaactggcgctgcaccatctgtcttctacttcccg

SEQ ID NO: 326901 - DNA, 523 bp, Homo sapiens
  misc_feature: GZ8MTXP02G3U2A.44.39.D06.1.454.CMB.2.raw
  modified_base (499)..(499): a, c, t, g, unknown or other
  misc_feature (499)..(499): n is a, c, g, or t
  modified_base (506)..(506): a, c, t, g, unknown or other
  misc_feature (506)..(506): n is a, c, g, or t
tcagacagtatatacacgaccggtgctcgatttagtgacatctcgcagttctttgggggcgggagtcagacccagtcaagacacagcgtggacatgagggtccccgctcagctcctggggctcctgctgctctggctcccaggtgccgactgtgccgtccagatgacccagtctccttccaccctgtctgcgtctctgggcgacagagtcaccatcacttgccgggcagtgagagtggctggatggcctggtatcgaggaaaagcccgggaggtccccaagctcctggtctataacgcctctattttagactattggggtccctcaaggttcagtggcagaaacgtctggtcactatttctctctcacatcaatgcctgcagcctgatgtattttgccgaccttacttctgccagcctaactattaattcgtttcctcccctgtccgttccgggcccggggactagttgtcggaccctccgaacgtactgtgactcgcncatcgtntctcatcctccgcttac

SEQ ID NO: 326902 - DNA, 541 bp, Homo sapiens
  misc_feature: GZ8MTXP02JTU5U.44.39.D06.1.454.CMB.2.raw
  modified_base (342)..(342): a, c, t, g, unknown or other
  misc_feature (342)..(342): n is a, c, g, or t
tcagacagtatatacacgaccggtgctcgatttagtgacatctcgcagttctttgggggggtcacaagaggcagcgctctcgggacgtctccaccatggcctgggctctgctgctcctcactctcctcactcaggacacagggtcctgggcccagtctgccctgactcagcctgcctccgtgtctggttctcctggacagtcgatcaccatctcctgcactgggtccagcaatgacattggagatataaccttgtctcctggtatcaacaacatccaggcaaagcccccaaatcatacttttgagtccagtgagcgccgtcaggtcgttactaatcgcttcnctggctccaagtctgccacgcgcctccctgtcgatctgtcgggcctccggcctagaggaccgagggtcctgacttatacgtgccggtctctactttacaacttcgttagacgtacgttgggtcgttcgggacggtacgggactcgtacccgtcgaccgtccttaagggccacgccccgaaggccttccgcccccttcgg

SEQ ID NO: 326903 - DNA, 527 bp, Homo sapiens
  misc_feature: GZ8MTXP02JWXUA.44.39.D06.1.454.CMB.2.raw
tcagacagtatatacacgaccggtgctcgatttagtgacatctcgcagttctttgggggagctacaacaggcaggcaggggcagcaagatggtgttgcagacccaggtcttcatttctctgttgctctggatctctggtgcctgcggggacatcgcgatgagccagtctccagactccctggctgtgtctctgggcgagagggccaccgtcaactgcaactccagccaaagtgtctttatgtccccaatagtaagaactattagcctggtaccaacagaaaccggacagtctactaaattactctttatggcatctactcggagtccgggtcctgaccgattcagtggcggcggtctgggcacgtatttcactctcaccatcagtacgcctgcaggctagaagacgtggctagtttatattgacaaataattattttaagaaccttacctatctacgtttcggacggtagggacctaggacgtagacgtatacaaaacgaactgtaggctgacacatctcgtcttac

SEQ ID NO: 326904 - DNA, 516 bp, Homo sapiens
  misc_feature: GZ8MTXP02JR4S7.44.39.D06.1.454.CMB.2.raw
  modified_base (191)..(191): a, c, t, g, unknown or other
  misc_feature (191)..(191): n is a, c, g, or t
  modified_base (225)..(225): a, c, t, g, unknown or other
  misc_feature (225)..(225): n is a, c, g, or t
  modified_base (237)..(237): a, c, t, g, unknown or other
  misc_feature (237)..(237): n is a, c, g, or t
  modified_base (428)..(428): a, c, t, g, unknown or other
  misc_feature (428)..(428): n is a, c, g, or t
tcagacagtatatacacgaccggtgctcgatttagtgacatctcgcagttctttgggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactgganccagcggtaatnttcttagtcttaacttgtctctggtatcaacatcatccagtaacgcccccaaatcatcatctatgagcctataagagccctgagggtttcaatccgcttcactgcctccaagtccggacaacaccggccctcccgtagaccaaatcctcgtcgggctccgagctgaggacgaggctgattatattgtgctnagtatgttacgtcgctatctattatgtacttacggagtcggacaggtcaccgtctaggtcacgcccaacggcccaacccgactcgtac

SEQ ID NO: 326905 - DNA, 545 bp, Homo sapiens
  misc_feature: GZ8MTXP02IVZTQ.44.39.D06.1.454.CMB.2.raw
  modified_base (202)..(202): a, c, t, g, unknown or other
  misc_feature (202)..(202): n is a, c, g, or t
  modified_base (292)..(292): a, c, t, g, unknown or other
  misc_feature (292)..(292): n is a, c, g, or t
  modified_base (360)..(360): a, c, t, g, unknown or other
  misc_feature (360)..(360): n is a, c, g, or t
  modified_base (377)..(377): a, c, t, g, unknown or other
  misc_feature (377)..(377): n is a, c, g, or t
  modified_base (388)..(388): a, c, t, g, unknown or other
  misc_feature (388)..(388): n is a, c, g, or t
tcagacagtatatacacgaccggtgctcgatttagtgacatctcgcagttctttgggggaggaactgctcagttaggacccagagggaaccatggaagccccagctcagcttctcttcctcctgctactctggctcccagagatcaccggagatattgtgttgacacagtctccaggcaccctgtctttgtctccagggganagagccacctctcctgtagggccagtcggagtgttgctaagtacctagcctggtaccaacagaaacctggccaggctcccaggctccctnatctatgatgcataccaacgagggtcacgtggccaccccagacaggtcagtgcaggtggtctgggacngtcttcactctcacgtnagcaatgtacngcctagaagtatttgcttagtttatacttgtcagctagtccgttcctaccgacggcctctcgtaccggtttcggggacgggggacctaagggtcggagtactcgaacggtacgaacgtggtcgcgtggacctaaccgtacttcgtcgttcttactcg

SEQ ID NO: 326906 - DNA, 600 bp, Homo sapiens
  misc_feature: GZ8MTXP02F3UL4.44.39.D06.1.454.CMB.2.raw
  modified_base (200)..(200): a, c, t, g, unknown or other
  misc_feature (200)..(200): n is a, c, g, or t
  modified_base (230)..(230): a, c, t, g, unknown or other
  misc_feature (230)..(230): n is a, c, g, or t
  modified_base (256)..(256): a, c, t, g, unknown or other
  misc_feature (256)..(256): n is a, c, g, or t
tcagacagtatatacacgaccggtgctcgatttagtgacatctcgcagttctttgggggggtcacaagaggcagcgctctcgggacgtctccaccatggcctgggctctgctgctcctcactctcctcactcaggacacagggtcctgggcccagtctgtgctgacgcagccgccctcagtgtcgtcggggccccggggnaggagggtcaccatctcctgcacgtgggancagctccaatatcggggccagattangatgtgcactggtaccagcaacttccaggaaccacgacccccaaactcctacatctatacggtaaacaacaactccgacccctcgacggggtccccctacgaccgtattctctcgcctcaacgtctcggccacttcacgccctccctcggcccactccacgtcgggcctccacgcctagaggataggaggccggtaatttacttacgtcgaccacgtcggtacgaaacgagtacgttacgggacgggaagggtaacgtaacgcgttacggaccgttaccgtacggtaccgacggacccgaacggtcctaccggcccccgtcggtacctaccgttccgtttcccg

SEQ ID NO: 326907 - DNA, 591 bp, Homo sapiens
  misc_feature: GZ8MTXP02GPD5T.44.39.D06.1.454.CMB.2.raw
  modified_base (451)..(451): a, c, t, g, unknown or other
  misc_feature (451)..(451): n is a, c, g, or t
tcagacagtatatacacgaccggtgctcgatttagtgacatctcgcagttctttggggggggtcacaagaggcagcgctctcgggacgtctccaccatggcctgggctctgctgctcctcactctcctcactcaggacacagggtcctgggcccagtctgtcctgactcagcctgcctccgtgtctggttctcctggacagtcgatcaccatctcctgcactgggtccagcaatgacattgggagatataaccttgtctcctggtatcaacaacatccaggacaaacgcccccaaactcattacttttgacgtccagtgagcggccgtcgtaggtcgtttactaatcgtcttctcgtgctccaagtctcggccacgaccggcccttccctgtccgtatcgtcgtcggggtcctcccggctggacggacgagggctaggtacttagttacgngaccggtctactatttaaccaacttcgttagacgttacgttggggttcgttccgggacgggtacgggacttccgaccgtcggacccgttccgtaacggtcgaaccggtacccgaacggtcctcccggtcccccgttccgg

SEQ ID NO: 326908 - DNA, 540 bp, Homo sapiens
  misc_feature: GZ8MTXP02JQI8H.44.39.D06.1.454.CMB.2.raw
  modified_base (429)..(429): a, c, t, g, unknown or other
  misc_feature (429)..(429): n is a, c, g, or t
tcagacagtatatacacgaccggtgctcgatttagtgacatctcgcagttctttggggggggtcacaagaggcagcgctctcgggacgtctccaccatggcctgggctctgctgctcctcactctcctcactcaggacacagggtcctgggcccagtctgccctgactcagcctgcctccgtgtctggttctcctggacagtcgatcaccatctcctgcactgggtccagcaatgacattggagatataaccttgtctcctggtatcaacaacatccaggcaaacgcccccaaactcatacttttgacgtccagtgagcggccgtcaggttcgtttactaatcgtcttctctggctccaagtctggccacacggtccctccctgtcgatctcgtgggcctccggctggaggacgaggctgactattacngcgctctatttacaactcttgagtacgttgggttcgttcgggcgggtacggaccttcgaccgtcggacccgttcgtaaggtcacggacccgaaggcctccggccccgtcgg

SEQ ID NO: 326909 - DNA, 628 bp, Homo sapiens
  misc_feature: GZ8MTXP02IHBU5.44.39.D06.1.454.CMB.2.raw
  modified_base (226)..(226): a, c, t, g, unknown or other
  misc_feature (226)..(226): n is a, c, g, or t
tcagacagtatatacacgaccggtgctcgatttagtgacatctcgcagttctttggggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactgganccagcggtaatattcttagtcttaacttgtctctgtatcaacatcatccaggtaaacacccccaaatcatcatctatgagcctaataagagccctgaggggtttctaatccgtcttcactcgcctaccgaacgtcccggaccaaacgacccggtccctccccgtagactaaacttcctcgtcgggtacctccgaggccgtaggacgggacgaaggcttagtatttagtttatttgttagtccttacgagtatttcggttcgttcgctaacttctaactttattcggttacgtttacgggaaggttacggggaaacctaaacgggttcctaaccccggttcgttaacgggtcccaacggacccccgaaacggaccccctaaacccccgtacgttacggtaccc

SEQ ID NO: 326910 - DNA, 519 bp, Homo sapiens
  misc_feature: GZ8MTXP02FYMAM.44.39.D06.1.454.CMB.2.raw
  modified_base (202)..(202): a, c, t, g, unknown or other
  misc_feature (202)..(202): n is a, c, g, or t
  modified_base (311)..(311): a, c, t, g, unknown or other
  misc_feature (311)..(311): n is a, c, g, or t
  modified_base (359)..(359): a, c, t, g, unknown or other
  misc_feature (359)..(359): n is a, c, g, or t
  modified_base (371)..(371): a, c, t, g, unknown or other
  misc_feature (371)..(371): n is a, c, g, or t
tcagacagtatatacacgaccggtgctcgatttagtgacatctcgcagttctttgggggaggaactgctcagttaggacccagagggaaccatggaagccccagctcagcttctcttcctcctgctactctggctcccagagatcaccggagatattgtgttgacacagtctccaggcaccctgtctttgctccaggggganagagccaccctctcctggtagggccaggtcggagtgttgctaagtcctagcctggtaccaacagaaacctggccaggctcccaggctcctcatctatgatgcatccaangggtcactggccaccccagacaggtcagtggcaggtgggtctgggacnggacttcactcncacgtcagcaatgtacagcctagaagtatttgcttagtttattactgtcagcagtcgttcctcacggcctctcgtacgttcgggacgggggtaccaagggtcggtagatcgaagacgaacgtggacggctcgcacactctgtctctac

SEQ ID NO: 326911 - DNA, 557 bp, Homo sapiens
  misc_feature: GZ8MTXP02H884I.44.39.D06.1.454.CMB.2.raw
  modified_base (203)..(203): a, c, t, g, unknown or other
  misc_feature (203)..(203): n is a, c, g, or t
  modified_base (364)..(364): a, c, t, g, unknown or other
  misc_feature (364)..(364): n is a, c, g, or t
  modified_base (386)..(386): a, c, t, g, unknown or other
  misc_feature (386)..(386): n is a, c, g, or t
tcagacagtatatacacgaccggtgctcgatttagtgacatctcgcagttctttgggggaggaactgctcagttaggacccagagggaaccatggaagccccagctcagcttctcttcctcctgctactctggctcccagagatcaccggagatattgtgttgacacagtctccaggcaccctgtctttgctccgaggggganagagcccaccctctcctgtagggccagtcggagtgtgctaagtcctagcctggtaccaacagaaacctggccaggctcccaggcctcctcatctatgatgcatccaagagggtcacgtggccaccccagacaggttcaggtggcaggtgggtctggggacnggtaccttcacctctcaccgtnagacaatgtacagcctgaagtatttgctagtttatactgtacagctagtcgttcctccgacggccgtctcgtacggtttcggggaccgggggaccgaagggtggagagtacgaaggacgtaacgtggtcggacgtcggaccaaccgtacgttcgtcgttcctttactaccg

SEQ ID NO: 326912 - DNA, 520 bp, Homo sapiens
  misc_feature: GZ8MTXP02GXBGS.44.39.D06.1.454.CMB.2.raw
  modified_base (202)..(202): a, c, t, g, unknown or other
  misc_feature (202)..(202): n is a, c, g, or t
  modified_base (311)..(311): a, c, t, g, unknown or other
  misc_feature (311)..(311): n is a, c, g, or t
  modified_base (362)..(362): a, c, t, g, unknown or other
  misc_feature (362)..(362): n is a, c, g, or t
tcagacagtatatacacgaccggtgctcgatttagtgacatctcgcagttctttgggggaggaactgctcagttaggacccagagggaaccatggaagccccagctcagcttctcttcctcctgctactctggctcccagagatcaccggagatattgtgttgacacagtctccaggcaccctgtctttgtctccagggganagagcccaccctctcctgtagggccagtcggagtgttgctaagtacctagcctggtaccaacagaaacctggccaggctcccaggctcctcatctatgatgcatccaangggtcactggcaccccagaccaggttcacggtggcagtgggtctggggacngacttcactctcacgtcagcaatgtacagcctagaagtactttgactagtttattactgtcagctagtcgttcctcccgagccgtctcacgtttccgggcgggggtacaacgggtcggagatcgagacgacgtcgtgctgcacactctcgtctctacg

SEQ ID NO: 326913 - DNA, 517 bp, Homo sapiens
  misc_feature: GZ8MTXP02FN70W.44.39.D06.1.454.CMB.2.raw
  modified_base (241)..(241): a, c, t, g, unknown or other
  misc_feature (241)..(241): n is a, c, g, or t
  modified_base (430)..(430): a, c, t, g, unknown or other
  misc_feature (430)..(430): n is a, c, g, or t
tcagacagtatatacacgaccggtgctcgatttagtgacatctcgcagttctttgggggagctacaacaggcaggcaggggcagcaagatggtgttgcagacccaggtcttcatttctctgttgctctggatctctggtgcctgcggggacatcgcgatgagccagtctccagactccctggctgtgtctctgggcgagagggccaccgtcaactgcaactccagccaaagtgtcttttangtccccaatagtaagaactattagcctggtaccaacagaaaccgggacagtctacctaaattactcttttatggcatctactcgggagtccggggtcctgaccgattcagtggcggcggtctggggcacatttcactctcaccatcagtagcctgcaggctgaagcgtggacagtttattatgtacaanaattatttagaaacttctatcactttcggcgtaggacctagagtagagatacaaacgaactgtggaactgactacatctcgtcttac

SEQ ID NO: 326914 - DNA, 585 bp, Homo sapiens
  misc_feature: GZ8MTXP02GXZDW.44.39.D06.1.454.CMB.2.raw
  modified_base (435)..(435): a, c, t, g, unknown or other
  misc_feature (435)..(435): n is a, c, g, or t
  modified_base (463)..(463): a, c, t, g, unknown or other
  misc_feature (463)..(463): n is a, c, g, or t
tcagacagtatatacacgaccggtgctcgatttagtgacatctcgcagttctttggggggggtcacaagaggcagcgctctcgggacgtctccaccatggcctgggctctgctgctcctcactctcctcactcaggacacagggtcctgggcccagtctgccctgactcagcctgcctccgtgtctggttctcctggacagtcatcaccatctctgcacgtgggtccagcaatgacagttggagtatataaccttgtctcctgtatacaaacaacataccgaggaccaaacgacccccaaaactctaattacttttgactaccgagtggacgccggccgtcgtaggttctttactaatcgtcttctcgtgctacaagtcgtcgccacgaccgtccctcctgtccgactcgtcgtcggctccggctggaggaccgnggtctagtacttagttacgtgaccggtntacctaattacgacttcgtagtacgtagttcggggtcgttaccgggaggtacgggactaccgaccgtcgtaaccgttcgaacggtccaaccggccgaacggtcctcccggaccccgttccgg

SEQ ID NO: 326915 - DNA, 698 bp, Homo sapiens
  misc_feature: GZ8MTXP02HO026.44.39.D06.1.454.CMB.2.raw
  modified_base (201)..(201): a, c, t, g, unknown or other
  misc_feature (201)..(201): n is a, c, g, or t
  modified_base (304)..(304): a, c, t, g, unknown or other
  misc_feature (304)..(304): n is a, c, g, or t
tcagacagtatatacacgaccggtgctcgatttagtgacatctcgcagttctttgggggaggaactgctcagttaggacccagagggaaccatggaagcccagctcagcttctcttcctcctgctactctggctccagagatcaccggagatattgtgttgacacagtctccaggcaccctgtctttgtctccgagggganagacgccacctctcctggtacgggccaggtcggagttgtgactaagtacctagcctggtaaccaacagaaacctggccaggcctcccaggcctcctcatctangatgcactaccaacgagggtcacgtcggccaccccgaagactaggttcaggtcggactagggtcggggtcgttaggggaactacggtacctttcaaccgttcctaccaacccggtacaacgtcaaacgtcggtaaacacggtcctagtaaagttattttcggacttagttttaacttacgttagttaccgaagtcgttaacgtcccgttttcccgtaccgaaccgggtcccgtaccgttccgttaccgggttttccgggggaccggggggtaaacccgtaaaagggggtttacggaaacgggtacgttaccggtaaagggaaaccggtaaaccggttcgggttacggcgttaacggcctaacgtacgttaccgttcgtttcctttacttacccg

SEQ ID NO: 326916 - DNA, 561 bp, Homo sapiens
  misc_feature: GZ8MTXP02I8FHF.44.39.D06.1.454.CMB.2.raw
  modified_base (233)..(233): a, c, t, g, unknown or other
  misc_feature (233)..(233): n is a, c, g, or t
  modified_base (332)..(332): a, c, t, g, unknown or other
  misc_feature (332)..(332): n is a, c, g, or t
tcagacagtatatacacgaccggtgctcgatttagtgacatctcgcagttctttgggggcgggagtcagacccagtcaagacacagcgtggacatgagggtccccgctcagctcctggggctcctgctgctctggctcccaggtgccgactgtgccgtccagatgacccagtctccttccaccctgtctgcgtctctgggcacagagtcaccatcacttgccgggcagtgagngtggctggatggcctggtatcgaaggaaaacgcccggggacggtccccaagctccgtggtctataacgcctctattttagactagttcggggtcccgtnaaggtttcaggtggcaagaaacgtcgtgggtcatatttctctctcaccatacaatggcctgcagcctgatgtatttcgcgtaccttacttctcgccagactaacttaattaactttcgttttcctcccctggtccggtttccgggacccgggtacctgttacgtcggtaccctcgaaacgtactcggtcgctcgactaccatcctcgttactctacttcctaccgctac

SEQ ID NO: 326917 - DNA, 563 bp, Homo sapiens
  misc_feature: GZ8MTXP02IOEGE.44.39.D06.1.454.CMB.2.raw
  modified_base (203)..(203): a, c, t, g, unknown or other
  misc_feature (203)..(203): n is a, c, g, or t
  modified_base (214)..(214): a, c, t, g, unknown or other
  misc_feature (214)..(214): n is a, c, g, or t
  modified_base (307)..(307): a, c, t, g, unknown or other
  misc_feature (307)..(307): n is a, c, g, or t
  modified_base (352)..(352): a, c, t, g, unknown or other
  misc_feature (352)..(352): n is a, c, g, or t
  modified_base (379)..(379): a, c, t, g, unknown or other
  misc_feature (379)..(379): n is a, c, g, or t
tcagacagtatatacacgaccggtgctcgatttagtgacatctcgcagttctttgggggaggaactgctcagttaggacccagagggaaccatggaagccccagctcagcttctcttcctcctgctactctggctcccagagatcaccggagatattgtgttgacacagtctccaggcaccctgtctttgtctccaggggganagagccacctntcctgtagggccagtcggagtgttgctaagtccagcctggtaccaacagaaacctggccaggctcccagctcctcatctatgatgcatccaangggtcactggcaccccagacaggtcagtgcaggtggtctgggacngtacttcactctcaccgtcagactaangtacagcctagaagtatttgactagtttatactgtacagctagtcgttccaccgtggcccgtcgtcgtacggtttccggggaccgggggtaaccgtaaaggggttcggaacggtacgtacgaaggaaccggtaacgtaggtcggccgttaaggacctaccgtactcgtacgttccttacgtccg

SEQ ID NO: 326918 - DNA, 528 bp, Homo sapiens
  misc_feature: GZ8MTXP02FGK6Z.44.39.D06.1.454.CMB.2.raw
  modified_base (203)..(203): a, c, t, g, unknown or other
  misc_feature (203)..(203): n is a, c, g, or t
  modified_base (320)..(321): a, c, t, g, unknown or other
  misc_feature (320)..(321): n is a, c, g, or t
tcagacagtatatacacgaccggtgctcgatttagtgacatctcgcagttctttgggggaggaactgctcagttaggacccagagggaaccatggaagccccagctcagcttctcttcctcctgctactctggctcccagagatcaccggagatattgtgttgacacagtctccaggcaccctgtctttgtctccgagggganagagccaccctctcctggtagggccagtcggagtgttgctaagtacctagcctggtaccaacagaaacctggccaggctcccaggcctcctcatatacgatgcatccagcaaggccnnggcatcccagacaggttccagtggcaggtgggtctggggacaggacttcactctcagcatcagcgatggagccaggagtattcagctagtttactagtgtcagcagttagtgggttcgtcaccgtgtgtacgttcggacgtaaagggactaaagggtagaaactacgaaaacgactaggtaacgactcgacacgtatcgtcgttacc

SEQ ID NO: 326919 - DNA, 503 bp, Homo sapiens
  misc_feature: GZ8MTXP02FHMV5.44.39.D06.1.454.CMB.2.raw
  modified_base (200)..(200): a, c, t, g, unknown or other
  misc_feature (200)..(200): n is a, c, g, or t
  modified_base (311)..(311): a, c, t, g, unknown or other
  misc_feature (311)..(311): n is a, c, g, or t
  modified_base (360)..(360): a, c, t, g, unknown or other
  misc_feature (360)..(360): n is a, c, g, or t
tcagacagtatatacacgaccggtgctcgatttagtgacatctcgcagttctttgggggaggaactgctcagttaggacccagagggaaccatggaagccccagctcagcttctcttcctcctgctactctggctcccagagatcaccggagatattgtgttgacacagtctccaggcaccctgtctttgctccaggganagagccaccctctcctgtagggccagtcggagtgttgctaaagtacctagcctggtaccaacagaaacctggccaggctcccaggctcctcatctatgatgcatccaaacngggtcactggcaccccagacaggttcagtggcagtggggtctggggacngacttcactctcacgtcagcaaatgtacagcctgaagattttgctagtttattactgtcagcagcgttcctcagccgctcacttcgggcgggggtaccaagggtggagatcacacgaactgtggctgcaccatctgtctctac

SEQ ID NO: 326920 - DNA, 564 bp, Homo sapiens
  misc_feature: GZ8MTXP02I3PX3.44.39.D06.1.454.CMB.2.raw
  modified_base (224)..(224): a, c, t, g, unknown or other
  misc_feature (224)..(224): n is a, c, g, or t
  modified_base (236)..(236): a, c, t, g, unknown or other
  misc_feature (236)..(236): n is a, c, g, or t
  modified_base (281)..(281): a, c, t, g, unknown or other
  misc_feature (281)..(281): n is a, c, g, or t
  modified_base (319)..(319): a, c, t, g, unknown or other
  misc_feature (319)..(319): n is a, c, g, or t
tcagacagtatatacacgaccggtgctcgatttagtgacatctcgcagttctttggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactgganccagcggtaatnttcttagtcttaacttgtctctgtatcaacatcatccaggtaacncccccaaatcatcatctatgaggcctataagagccctntaggggttctaatccgcttcactgcctaccaagtccggcaacacggcctccctgacatctctggctccgaggctgacggacgaggtctagtatttaatttagtttgtttcgcttacgaggtatcggtttcgtcgcattctactttattgttactttcgggaaaggttcggggaaaccaacggggttccaaccgttccgtaagggtccacggcccaaaacgggccctaaaaccccacgtcgtaccc

SEQ ID NO: 326921 - DNA, 547 bp, Homo sapiens
  misc_feature: GZ8MTXP02FIY4F.44.39.D06.1.454.CMB.2.raw
  modified_base (201)..(201): a, c, t, g, unknown or other
  misc_feature (201)..(201): n is a, c, g, or t
  modified_base (259)..(259): a, c, t, g, unknown or other
  misc_feature (259)..(259): n is a, c, g, or t
  modified_base (307)..(307): a, c, t, g, unknown or other
  misc_feature (307)..(307): n is a, c, g, or t
  modified_base (351)..(351): a, c, t, g, unknown or other
  misc_feature (351)..(351): n is a, c, g, or t
  modified_base (358)..(358): a, c, t, g, unknown or other
  misc_feature (358)..(358): n is a, c, g, or t
tcagacagtatatacacgaccggtgctcgatttagtgacatctcgcagttctttgggggaggaactgctcagttaggacccagagggaaccatggaagccccagctcagcttctcttcctcctgctactctggctcccagagatcaccggagatattgtgttgacacagtctccaggcaccctgtctttgctccagggganagagccaccctctcctgtagggccagtcggagtgtgctaagtcctagcctggaccaanagaaacctggccaggctcccagcctcctcatctatgatgcatccaagngggtcactggccaccccagacaggttcagtggcaggtggggtcnggggacngacttcactctcaccgtcaagcaatgtacagcctagaagattttgacttagtttattactgtcagtcagtccgttcctccgacggcccgtctacgtaccgtttcggggaccgggggtaccgaacggggtggaacgagtacgaagaacgtaacgtggtcgcgtaacgcgaccatccgtcgtcctcgtacc

SEQ ID NO: 326922 - DNA, 535 bp, Homo sapiens
  misc_feature: GZ8MTXP02FRPBT.44.39.D06.1.454.CMB.2.raw
  modified_base (202)..(202): a, c, t, g, unknown or other
  misc_feature (202)..(202): n is a, c, g, or t
  modified_base (213)..(213): a, c, t, g, unknown or other
  misc_feature (213)..(213): n is a, c, g, or t
  modified_base (239)..(239): a, c, t, g, unknown or other
  misc_feature (239)..(239): n is a, c, g, or t
  modified_base (310)..(310): a, c, t, g, unknown or other
  misc_feature (310)..(310): n is a, c, g, or t
  modified_base (353)..(353): a, c, t, g, unknown or other
  misc_feature (353)..(353): n is a, c, g, or t
  modified_base (360)..(360): a, c, t, g, unknown or other
  misc_feature (360)..(360): n is a, c, g, or t
  modified_base (378)..(378): a, c, t, g, unknown or other
  misc_feature (378)..(378): n is a, c, g, or t
  modified_base (384)..(384): a, c, t, g, unknown or other
  misc_feature (384)..(384): n is a, c, g, or t
  modified_base (397)..(397): a, c, t, g, unknown or other
  misc_feature (397)..(397): n is a, c, g, or t
  modified_base (434)..(434): a, c, t, g, unknown or other
  misc_feature (434)..(434): n is a, c, g, or t
tcagacagtatatacacgaccggtgctcgatttagtgacatctcgcagttctttgggggaggaactgctcagttaggacccagagggaaccatggaagccccagctcagcttctcttcctcctgctactctggctcccagagatcaccggagatattgtgttgacacagtctccaggcaccctgtctttgctccgagggganagagccacctntcctggtacgggccagtcggatgttnctaagtcctagcctggtaccaacagaaacctggccaggctcccaggctcctcatctatgatgcatccaagngggtcacgtggccaccccagacaggttcagtgcaggtgggtcnggggacnggacttcactctcacgtnagcatntacagctagaatnttttagctagtttactactgtacagtcagtcgttccncgacgctctcgtacggttcggggacgggtacgaagggtgagtagtacgaaggacgtacgtcggtacgtcgtaacgaccacgtactcgttacgtctcgtacg

SEQ ID NO: 326923 - DNA, 596 bp, Homo sapiens
  misc_feature: GZ8MTXP02G7WJO.44.39.D06.1.454.CMB.2.raw
  modified_base (244)..(244): a, c, t, g, unknown or other
  misc_feature (244)..(244): n is a, c, g, or t
  modified_base (318)..(318): a, c, t, g, unknown or other
  misc_feature (318)..(318): n is a, c, g, or t
  modified_base (492)..(492): a, c, t, g, unknown or other
  misc_feature (492)..(492): n is a, c, g, or t
tcagacagtatatacacgaccggtgctcgatttagtgacatctcgcagttctttgggggagctacaacaggcaggcaggggcagcaagatggtgttgcagacccaggtcttcatttctctgttgctctggatctctggtgcctggcgggacatcgcgatgagccagtctccagactccctggctgtcgtctcgtgggcgaggcgggccaccgtcaactgacaactcagacctaagtgtctttancgtaccccaatagtaagtaacttattacgcctaggtaaccaacgaacgaaaccggactagtctactaaattctntttagtggctatctacgtcgggtacgtccggggtccagaccgtattcgaggtcgggcggtcggtacgcgggacctactagtttccacttcgtacactatcgagttacgctgacgagctaggaacgacgtggtacttagtttattattacgtactaaactaatttaacgtttaanaaccttactacttactacgtttcgggacggtacgacgaacgtagtaacgagaacgtactaaacgtacgtagtacggctacgacgtaccagttctcgttaccttc

SEQ ID NO: 326924 - DNA, 584 bp, Homo sapiens
  misc_feature: GZ8MTXP02IQXKE.44.39.D06.1.454.CMB.2.raw
  modified_base (367)..(367): a, c, t, g, unknown or other
  misc_feature (367)..(367): n is a, c, g, or t
tcagacagtatatacacgaccggtgctcgatttagtgacatctcgcagttctttgggggggtcacaagaggcagcgctctcgggacgtctccaccatggcctgggctctgctgctcctcactctcctcactcaggacacagggtcctgggcccagtctgccctgactcagcctgcctcgtgtctggttctcctggacagtcgatcaccatctcctgcacgtgggtccagcaatgacagttggagatataaccttgtctccgtgtactacaacaacactaccgaggaccaaacgacccccaaactctacttactttttgaacgtcccagtgacgcggtccgtcgtaggttctttactaatcgtcttcncttggctaccgaagtccgtcggccacgaccgtccctcccgtgacctatcctcgtcgggctccgagctaggacgtacgacggtcgtagtactttacgactggcaacgctacataactacaacgcacgaccacgtaccctaccccttaagtcgttacccgtacggaaccgtcggggaaccgtacggtcctacccggtcctacggtaccacggaaccccg

SEQ ID NO: 326925 - DNA, 657 bp, Homo sapiens
  misc_feature: GZ8MTXP02I8BWS.44.39.D06.1.454.CMB.2.raw
  modified_base (249)..(249): a, c, t, g, unknown or other
  misc_feature (249)..(249): n is a, c, g, or t
tcagacagtatatacacgaccggtgctcgatttagtgacatctcgcagttcgtttggggggggtcacaagaggcagcgctctcgggacgtctccaccatggcctgggctctgctgctcctcactctcctcactcaggacacagggtcctgggcccagtctgccctgactcagcctgcctccgtgtctggttctcctggacagtcgatcaccatcctcctgcacgtgggtccagcaatgactagttgganatataccttgtctctgtatacaacacataccagacaaaccgaccccaaactctaattacttttagacgttccaggtcgacggccggtaccgtgtaggttcgtttactacgtcgtctttctcgtcgtctaccaagttcctcggccctacgacccggtcccttccgtgtaccgtactccgtcggtcggggtcccttcccgggcgtacgggaacgggacgtacggtccttacggtaaccttacgttaccgtcggccggtacttacgtaactttaacctaacgttcgtagtacgttacgggttgggttcgggttacggggacggggtacggtacctaccgtaccgtacggtaccccgttacggtaaggtacccacggtaccccgaaggtcccgtcccggtacccccgttcgg

SEQ ID NO: 326926 - DNA, 536 bp, Homo sapiens
  misc_feature: GZ8MTXP02HZQCB.44.39.D06.1.454.CMB.2.raw
tcagacagtatatacacgaccggtgctcgatttagtgacatctcgcagttctttgggggggtcacaagaggcagcgctctcgggacgtctccaccatggcctgggctctgctgctcctcactctcctcactcaggacacagggtcctgggcccagtctgccctgactcagcctgcctccgtgtctggttctcctggacagtcgatcaccatctcctgcactgggtccagcaatgacattgggagatataaccttgtctcctggtatcaacaacatccaggcaaagcccccaaactcatacttttgagtccagtgagcggccgtcaggtgtttctaatcgcttctctgctcaatctggccacacggccctccctgtcgatctctgggcctccggcctggacggacgaggctgacttattacgtgcggctcgtatttacaacttcttgagtacttggggtcgttcgggcggacggtacgtcctaccgtcgtacccgttctaacggtcaacggcccctaaggccctcggtccccctcgg

SEQ ID NO: 326927 - DNA, 620 bp, Homo sapiens
  misc_feature: GZ8MTXP02IG1ZG.44.39.D06.1.454.CMB.2.raw
  modified_base (202)..(202): a, c, t, g, unknown or other
  misc_feature (202)..(202): n is a, c, g, or t
  modified_base (265)..(265): a, c, t, g, unknown or other
  misc_feature (265)..(265): n is a, c, g, or t
  modified_base (290)..(290): a, c, t, g, unknown or other
  misc_feature (290)..(290): n is a, c, g, or t
  modified_base (311)..(311): a, c, t, g, unknown or other
  misc_feature (311)..(311): n is a, c, g, or t
tcagacagtatatacacgaccggtgctcgatttagtgacatctcgcagttctttgggggaggaactgctcagttaggacccagagggaaccatggaagccccagctcagcttctcttcctcctgctactctggctcccagagatcaccggagatattgtgttgacacagtctccaggcaccctgtctttgctccgagggganagacgccacctctcctggtacgggccaggtcggagtgttgctaagtcctagcctggtaccaanagaactggccaggctccgagctccnatctatgatgcatacccaagngggtcacgtcggaccacccgagacctaggttcaggtcggcgtaggtcggggtctaggggactaggtacctttcaacgttcctccgaccggtcaacgtacctaaagtgtaacacgtacctagtaacgtttattttcgactttaagtttacttacgttcggtactacgtactaggttccctttccgccgtaccggccgttactcgtaaccgggtttcgggggacgggggtaaccgtaagggttacggacgtacgtacgaaacggtacgtacgtgggtcgacgtcgaccactacgtcttcgttctactaccg

SEQ ID NO: 326928 - DNA, 623 bp, Homo sapiens
  misc_feature: GZ8MTXP02G2B2G.44.39.D06.1.454.CMB.2.raw
  modified_base (191)..(191): a, c, t, g, unknown or other
  misc_feature (191)..(191): n is a, c, g, or t
  modified_base (225)..(225): a, c, t, g, unknown or other
  misc_feature (225)..(225): n is a, c, g, or t
  modified_base (236)..(236): a, c, t, g, unknown or other
  misc_feature (236)..(236): n is a, c, g, or t
  modified_base (268)..(268): a, c, t, g, unknown or other
  misc_feature (268)..(268): n is a, c, g, or t
  modified_base (282)..(282): a, c, t, g, unknown or other
  misc_feature (282)..(282): n is a, c, g, or t
tcagacagtatatacacgaccggtgctcgatttagtgacatctcgcagttctttgggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactgganccagcgtaatnttcttagtcttaacttgtctctggtatcaacntcatccaggtaacnccccaaatcatcatctatgagctaataagcgccctgtagggtttctaatccgtcttcactcgcctaccaacgtcccggcaaacgaccggtccctacccgtagaacaacttctagtcggggtacctccgaggctaggacgggacgagggtctagtaatttagtttagtttgttcgtacctacgtaggtattcggtttccgtcgtacctattactaacgtttagttcgttacgttacgggaaggttacggggaaaccctaaacgggttccctacccggttacgttacgggtaaccgaacgaacccccgaaacggacccccaaaccccgtacgtacggttaccc

SEQ ID NO: 326929 - DNA, 546 bp, Homo sapiens
  misc_feature: GZ8MTXP02ILCOW.44.39.D06.1.454.CMB.2.raw
  modified_base (364)..(364): a, c, t, g, unknown or other
  misc_feature (364)..(364): n is a, c, g, or t
  modified_base (381)..(381): a, c, t, g, unknown or other
  misc_feature (381)..(381): n is a, c, g, or t
  modified_base (422)..(422): a, c, t, g, unknown or other
  misc_feature (422)..(422): n is a, c, g, or t
tcagacagtatatacacgaccggtgctcgatttagtgacatctcgcagttctttgggggtcacaagaggcagcgctctcgggacgtctccaccatggcctgggctctgctgctcctcactctcctcactcaggacacagggtcctgggcccagtctgccctgactcagcctgcctcgtgtctgggtatcctggacagtcgatcaccttctcctgcactggactcagcagtgaggctcaacttcttaatgtcgcctcctggtatcaacacatccccggcaaacccccaaactcttgattcatgaaatctctaagcggcccctctgggatttcctgatcgcttctctggctccaggtccggcaacncggcctccctgacatcnctgggctcagctgagacgagactaaatatttctgttccctnatatacacgttcttcgttggtttgggtctttcgggacggtaggggtaccgagggttacgaccggttccgtaacgggttccaaggcccgtaaaggccgttcggcccccttcgggtccacttcccg

SEQ ID NO: 326930 - DNA, 540 bp, Homo sapiens
  misc_feature: GZ8MTXP02JHHTA.44.39.D06.1.454.CMB.2.raw
  modified_base (425)..(425): a, c, t, g, unknown or other
  misc_feature (425)..(425): n is a, c, g, or t
  modified_base (471)..(471): a, c, t, g, unknown or other
  misc_feature (471)..(471): n is a, c, g, or t
tcagacagtatatacacgaccggtgctcgatttagtgacatctcgcagttctttgggggggtcacaagaggcagcgctctcgggacgtctccaccatggcctgggctctgctgctcctcactctcctcactcaggacacagggtcctgggcccagtctgccctgactcagcctgcctccgtgtctggttctcctggacagtcgatcaccatctcctgcactgggtccagcaatgacattggagatataacctgtctctggtatcaacaacatccaggcaaacgcccccaaactcatactttttgagtccagtgagcggccgtcaggtcgtttctaatcgcttctctggctccaagtctggccacgacggccctccctgtccgatctctgggcctccgacctgaggacgaggctgacttattacgngcggtctactatttacaacttcttgatacgttgggtcgttccgggnggaacgggtcctcgtacccgtaggacccgttcgaacggtcaacggcccaaggcctccgcccccgttcgg

SEQ ID NO: 326931 - DNA, 613 bp, Homo sapiens
  misc_feature: GZ8MTXP02HB8OC.44.39.D06.1.454.CMB.2.raw
  modified_base (203)..(203): a, c, t, g, unknown or other
  misc_feature (203)..(203): n is a, c, g, or t
  modified_base (319)..(319): a, c, t, g, unknown or other
  misc_feature (319)..(319): n is a, c, g, or t
tcagacagtatatacacgaccggtgctcgatttagtgacatctcgcagttctttgggggaggaactgctcagttaggacccagagggaaccatggaagccccagctcagcttctcttcctcctgctactctggctcccagagatcaccggagatattgtgttgacacagtctccaggcaccctgtctttgtctccgagggganagacgccaccctctcctgtacgggccaggtcggagtgttgctaagtacctagcctggtaccaacagaaacctggccaggcctcccgaggctcctcatctatgatgcataccaacgngggtcacgtggaccaccccagacgaggttcaggtcggcgaggtcggggtcgtggggactaggtaccttcaccttcctaccgaacccgtcaacgactaaagttcgtacacgtccgtagtaaagttatttcgacttaagtttactacttgtacagtctagtatacgtacttactctaccttcgtacgtaccggttacggaccgaaacggggtaccgtaaagggtacggaaaactacgaaaacggtacgtaggtcggtacgtcggaacctacctacgttctacgttccttactaccg

SEQ ID NO: 326932 - DNA, 662 bp, Homo sapiens
  misc_feature: GZ8MTXP02IWGEY.44.39.D06.1.454.CMB.2.raw
  modified_base (191)..(191): a, c, t, g, unknown or other
  misc_feature (191)..(191): n is a, c, g, or t
  modified_base (226)..(226): a, c, t, g, unknown or other
  misc_feature (226)..(226): n is a, c, g, or t
  modified_base (238)..(238): a, c, t, g, unknown or other
  misc_feature (238)..(238): n is a, c, g, or t
  modified_base (270)..(270): a, c, t, g, unknown or other
  misc_feature (270)..(270): n is a, c, g, or t
  modified_base (285)..(285): a, c, t, g, unknown or other
  misc_feature (285)..(285): n is a, c, g, or t
tcagacagtatatacacgaccggtgctcgatttagtgacatctcgcagttctttgggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactggacnccagcggtaatnttcttagtcttaattgtctcctggtatcaacntcatccaggtaaacncccccaaatcatcatctatgagcctaataagagccctgtaggggtttcaatccgtcttacactgcctaccaagtccggactaaacaccggtccctccctagaacctaattcccgtcgtcggggtccctccgaaggccctaggacggacgaggcttagtaatttagttatttggtttcgcttaccaaggtacgttggttccgttacgctattaccgttaactttaagtcggtttaccgtttacgggggaaacggttaccgggggaaacctaaacggggttcccctaaacccgggtttccctaaagggggtttcccaaccgggaaccccccgtaaaacgggaccccccctaaaacccccctacgtttacggtacccccg

SEQ ID NO: 326933 - DNA, 576 bp, Homo sapiens
  misc_feature: GZ8MTXP02GBRFT.44.39.D06.1.454.CMB.2.raw
  modified_base (225)..(225): a, c, t, g, unknown or other
  misc_feature (225)..(225): n is a, c, g, or t
  modified_base (268)..(268): a, c, t, g, unknown or other
  misc_feature (268)..(268): n is a, c, g, or t
  modified_base (282)..(282): a, c, t, g, unknown or other
  misc_feature (282)..(282): n is a, c, g, or t
tcagacagtatatacacgaccggtgctcgatttagtgacatctcgcagttctttggggggggtcacaagaggcagcgctctcgggacgtctccaccatggcctgggctctgctgctcctcactctcctcacccaggacacagggtcctgggcccagtctgccctgactcagcctgcctcgtgtctgggtcgcctggacagtcggtcaccatctcctgcactgganccagcgtaatattctagtcttaactttgtctcctgtatcaacntcatccagtaaacnccccaaatcatcatctatgagcctataagcgtccctgagggtttactaatccgtcttcactgccctaccaagtccggacaacacggccctccctagactatcctactcgggctccgaggctaggagggtaccgagggacttgtaatttagtttattgttcgtctacagtattcgttcgtcgtactattctaactttagtcgttacgttacgggtaaggtcgggaaaccgtacggtcctaccggtctacggtccgacgtaccccgaaacggtacccccaacccgcttacgtaccc

SEQ ID NO: 326934 - DNA, 543 bp, Homo sapiens
  misc_feature: GZ8MTXP02JG4QU.44.39.D06.1.454.CMB.2.raw
  modified_base (240)..(240): a, c, t, g, unknown or other
  misc_feature (240)..(240): n is a, c, g, or t
  modified_base (368)..(368): a, c, t, g, unknown or other
  misc_feature (368)..(368): n is a, c, g, or t
  modified_base (385)..(385): a, c, t, g, unknown or other
  misc_feature (385)..(385): n is a, c, g, or t
  modified_base (389)..(389): a, c, t, g, unknown or other
  misc_feature (389)..(389): n is a, c, g, or t
  modified_base (397)..(397): a, c, t, g, unknown or other
  misc_feature (397)..(397): n is a, c, g, or t
tcagacagtatatacacgaccggtgctcgatttagtgacatctcgcagttctttgggggagctacaacaggcaggcaggggcagcaagatggtgttgcagacccaggtcttcatttctctgttgctctggatctctggtgcctgcggggacatcgcgatgagccagtctccagactccctggctgtgtctctgggcgagagggccaccggtcaactgcaactccagccaagtgtctttancgtaccccaatagtaagaacttattagcctaggtaccaacgacgaaaccggacagtctacctaaattactctttatggcatctacgtcggacgtccggggtcctgaccgtatcagtcggcggcggtcngggcactattcgactcncacntcagtacnctgcagctagaagacgtgactagtttatattgtacaaactattatttagacttctatctacgttcggacggtagacgagtacgtagaacgtatacgaaacgtaacgttgtacggctacgacctaccgtatcgttacgttacttacc

SEQ ID NO: 326935 - DNA, 555 bp, Homo sapiens
  misc_feature: GZ8MTXP02FNDQR.44.39.D06.1.454.CMB.2.raw
tcagacagtatatacacgaccggtgctcgatttagtgacatctcgcagttctttgggggggtcacaagaggcagcgctctcgggacgtctccaccatggcctgggctctgctgctcctcactctcctcactcaggacacagggtcctgggcccagtctgccctgactcagcctgcctccgtgtctggttctcctggacagtcgatcaccatctcctgcactgggtccagcaatgacagttgggagatataaccttgtctcctggtatcaacaacataccaggaccaaacgacccccaaactctaattactttttgagtcccagtgagcggccgtcaggtcgtttctaatcgtcttctctggtctccaagtctcgccacgacgccctccctgtccgtatctcgtggcctccggctggacgacgagctgacttatacgtgcgtctacatttacaacttctagagtacgttgggtcgttcgggacggacgggacctcgaccgtcgacccgttaccgtaacggtaccacgtacccgaaggtcctccgtcccccgttcgg

SEQ ID NO: 326936 - DNA, 579 bp, Homo sapiens
  misc_feature: GZ8MTXP02HFPPQ.44.39.D06.1.454.CMB.2.raw
  modified_base (192)..(192): a, c, t, g, unknown or other
  misc_feature (192)..(192): n is a, c, g, or t
  modified_base (226)..(226): a, c, t, g, unknown or other
  misc_feature (226)..(226): n is a, c, g, or t
  modified_base (281)..(281): a, c, t, g, unknown or other
  misc_feature (281)..(281): n is a, c, g, or t
  modified_base (300)..(300): a, c, t, g, unknown or other
  misc_feature (300)..(300): n is a, c, g, or t
  modified_base (341)..(341): a, c, t, g, unknown or other
  misc_feature (341)..(341): n is a, c, g, or t
  modified_base (431)..(431): a, c, t, g, unknown or other
  misc_feature (431)..(431): n is a, c, g, or t
  modified_base (441)..(441): a, c, t, g, unknown or other
  misc_feature (441)..(441): n is a, c, g, or t
tcagacagtatatacacgaccggtgctcgatttagtgacatctcgcagttctttggggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactgganccagcgtaatattctagtcttaattgtctctgtatcaacatcatccaaggtaacncccccaaatcatcatctangagcctataagcgcctgtagggttctatccgtcttcactcncctccaacgtccgacaacaccggccctcctagactaatcctcgtcggctccgagtcgtggacggacgaggtctagtatttattagttgtntctacaagtnttgttcgcgtactacttctaactttgtcgttacgttacgggtaaaggttccgggaaacgtaacgggtcccgtaccggttaccgtaacgggtccaaccgaccccggaaacggaccccctaaaccccgtacttacgtccc

SEQ ID NO: 326937 - DNA, 561 bp, Homo sapiens
  misc_feature: GZ8MTXP02HNWTB.44.39.D06.1.454.CMB.2.raw
  modified_base (244)..(244): a, c, t, g, unknown or other
  misc_feature (244)..(244): n is a, c, g, or t
  modified_base (429)..(429): a, c, t, g, unknown or other
  misc_feature (429)..(429): n is a, c, g, or t
  modified_base (460)..(460): a, c, t, g, unknown or other
  misc_feature (460)..(460): n is a, c, g, or t
tcagacagtatatacacgaccggtgctcgatttagtgacatctcgcagttctttgggggagctacaacaggcaggcagggggcagcaagatggtgttgcagacccaggtcttcatttctctgttgctctggatctctggtgcctgcggggacatcgcgatgagccagtctccagacctccctggctgtgtctcgtggggcgagagggccaccgtcaactgcaactccagccaaagtgtctttancgtccccaatagtaagaacttattagcctaggtaccaacagaaaccgggacagtcctacctaaattactcttttagtggctattctaacgtcggggtacgtcccggggtccctgaccgtattcgaggtcgggcgggtcgggtcgtggggacctacgtatttcaccttctacaccctatcagtacncctgcaggctagaagcgtgactagtttattnttgtactaaatattatttaacgacttctatctacgttcggacggtaggaccaggtagtagaagatacaaacgactggtggctgacacgtatctcgtcttac

SEQ ID NO: 326938 - DNA, 594 bp, Homo sapiens
  misc_feature: GZ8MTXP02GGRG6.44.39.D06.1.454.CMB.2.raw
  modified_base (202)..(202): a, c, t, g, unknown or other
  misc_feature (202)..(202): n is a, c, g, or t
  modified_base (369)..(369): a, c, t, g, unknown or other
  misc_feature (369)..(369): n is a, c, g, or t
  modified_base (376)..(376): a, c, t, g, unknown or other
  misc_feature (376)..(376): n is a, c, g, or t
tcagacagtatatacacgaccggtgctcgatttagtgacatctcgcagttctttgggggaggaactgctcagttaggacccagagggaaccatggaagccccagctcagcttctcttcctcctgctactctggctcccagagatcaccggagatattgtgttgacacagtctccaggcaccctgtctttgctccgagggganagagccaccctctcctggtacgggccaggtcggagttgttgctaagtcctagcctggtaaccaacagaaacctggccaggcctcccgaggcctcctcatctaatgatgacataccaacgagggtcacgtggaccaccccagacaggttcagtgactaggtcgggtcngggaacnggaccttcacttctaccgacgtcagacaatgtacagctagaagtatttgacttagtttatattgtacagtactagtcgttcctccgaacggtcccgcttccgtacggtttccgggaccggggggtaaccaaaggggtggaacgtacgtacgaacggaaccgtaaacgtggtcggacctaaggaccctaacgtacttcgttaccgttctttacttcccg

SEQ ID NO: 326939 - DNA, 584 bp, Homo sapiens
  misc_feature: GZ8MTXP02I0LGY.44.39.D06.1.454.CMB.2.raw
  modified_base (202)..(202): a, c, t, g, unknown or other
  misc_feature (202)..(202): n is a, c, g, or t
  modified_base (267)..(267): a, c, t, g, unknown or other
  misc_feature (267)..(267): n is a, c, g, or t
  modified_base (289)..(289): a, c, t, g, unknown or other
  misc_feature (289)..(289): n is a, c, g, or t
  modified_base (308)..(308): a, c, t, g, unknown or other
  misc_feature (308)..(308): n is a, c, g, or t
  modified_base (469)..(469): a, c, t, g, unknown or other
  misc_feature (469)..(469): n is a, c, g, or t
tcagacagtatatacacgaccggtgctcgatttagtgacatctcgcagttctttgggggaggaactgctcagttaggacccagagggaaccatggaagccccagctcagcttctcttcctcctgctactctggctcccagagatcaccggagatattgtgttgacacagtctccaggcaccctgtctttgctccgagggganagacgcccacctctcctggtagggccaggtcggagttgttgactaagtcctagcctggtaccaanagaaacctgcagctccagctcnatcatgatgcataccaagngggtccacgtggaccaccccagacaggttcaggtgcaggtgggtctggggacaggtcctttcacttctccaaccgtcaagccaaatcgtaacacggactagaaagttactttgactttaagtttattacgtagtcgaagcgtacgtacctttcccgaccgnggtcccgtctccgtacggtttccggggacgggggtaaccgaagggtcgggagtacgacggaagaaccgtacgtaggtcggactcggacctacctagtccgttgtccttactaccg

SEQ ID NO: 326940 - DNA, 551 bp, Homo sapiens
  misc_feature: GZ8MTXP02GWZHM.44.39.D06.1.454.CMB.2.raw
  modified_base (192)..(192): a, c, t, g, unknown or other
  misc_feature (192)..(192): n is a, c, g, or t
  modified_base (227)..(227): a, c, t, g, unknown or other
  misc_feature (227)..(227): n is a, c, g, or t
  modified_base (286)..(286): a, c, t, g, unknown or other
  misc_feature (286)..(286): n is a, c, g, or t
  modified_base (365)..(365): a, c, t, g, unknown or other
  misc_feature (365)..(365): n is a, c, g, or t
tcagacagtatatacacgaccggtgctcgatttagtgacatctcgcagttctttggggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtctgtcaccatcctcctgcactgganccagcgtaatattcttagtcttaactttgtctcctgtatcaacatcatccaggtaaacncccccaaactcatcatctatgaggcctataagacggcctgaggggtttcaactcgcttcactgcctcagtccgacaacncgccctcctgacatctctgggctccaggctggaggacgaggctagtaatttattagtttgttcgcttacgagtagttggttccgtcgactatactactttatcgttcgttacgggtaaggtacgggaacctaacggtcctaccgtacgtaacggtcacgacccaacggaccccaaccctacgtccg

SEQ ID NO: 326941 - DNA, 570 bp, Homo sapiens
  misc_feature: GZ8MTXP02G42HD.44.39.D06.1.454.CMB.2.raw
  modified_base (338)..(338): a, c, t, g, unknown or other
  misc_feature (338)..(338): n is a, c, g, or t
  modified_base (427)..(427): a, c, t, g, unknown or other
  misc_feature (427)..(427): n is a, c, g, or t
  modified_base (443)..(443): a, c, t, g, unknown or other
  misc_feature (443)..(443): n is a, c, g, or t
tcagacagtatatacacgaccggtgctcgatttagtgacatctcgcagttctttggggggggtcacaagaggcagcgctctcgggacgtctccaccatggcctgggctctgctgctcctcactctcctcactcaggacacagggtcctgggcccagtctgccctgactcagcctgcctcgtgtctggttctcctggacagtcgatcaccatctcctgcactgggtccagcaatgacagttgggagatataaccttgtctcctggtatcaaacaacatccaaggacaaacgcccccaaaactctattacttttgagtccagtgagcggccgtcaggttntttactaatcgcttctctggtctccgaagtctcggcccacgaccggtccctccctgtcgatctcgtgggcctcccggctggacggacgnggctgaactagttacngcgctctattacaactctagagtacgttgggtcgttcgggacggtacgggacctacgaccgtacggtacccgttaccgtaacggtccgaacggaccccgaagggtcctacccggtcccccgttccgg

SEQ ID NO: 326942 - DNA, 622 bp, Homo sapiens
  misc_feature: GZ8MTXP02HT49J.44.39.D06.1.454.CMB.2.raw
  modified_base (475)..(475): a, c, t, g, unknown or other
  misc_feature (475)..(475): n is a, c, g, or t
tcagacagtatatacacgaccggtgctcgatttagtgacatctcgcagttctttggggggggtcacaagaggcagcgctctcgggacgtctccaccatggcctgggctctgctgctcctcactctcctcactcaggacacagggtcctgggcccagtctgccctgactcagcctgcctccgtgtctggttctcctggacagtcgatcaccatctcctgcactgggtccagcaatgacagttgggagatataaccttgtctcctgtatacaacaacatccaggacaaacgcccccaaatcattacttttgacgtccagtgagcggtccgtgtaggttctttactaacttcgtctttctccgtggccttaccgaagttccgtccggacccacgaccggtccctcccgtgtccgtatccgtcgtcgggtccctcccgggtcgtggacgggacgaggcttacggtaacttagtttacgnggccggtaccttactaactttacctaacgttcgttaggacgttacggtttggggtcggtttcggggacgggtacggtaccttacgaccgttcggtacccgttcgtaacggtacgacggacccgaggtccctccggtcccccgttcgg

SEQ ID NO: 326943 - DNA, 609 bp, Homo sapiens
  misc_feature: GZ8MTXP02HS420.44.39.D06.1.454.CMB.2.raw
  modified_base (200)..(200): a, c, t, g, unknown or other
  misc_feature (200)..(200): n is a, c, g, or t
  modified_base (306)..(306): a, c, t, g, unknown or other
  misc_feature (306)..(306): n is a, c, g, or t
  modified_base (386)..(386): a, c, t, g, unknown or other
  misc_feature (386)..(386): n is a, c, g, or t
tcagacagtatatacacgaccggtgctcgatttagtgacatctcgcagttctttgggggaggaactgctcagttaggacccagagggaaccatggaagccccagctcagcttctcttcctcctgctactctggctcccagagatcaccggagatattgtgttgacacagtctccaggcacctgtctttgctcgagggganagagccgcctctcctggtacgggccagtcggagtgtgctaagtacctagcctgtaccaacagaacctggccaggctccaggctctcatctatgatgacatccaagngggtccacgtggaccaccccagactaggttcagtggctaggtgggtctaggggacaggtctttcgactccgtcaccgtanacgactaatcgtacgacgtccgtagtaagttagttttgacttagtttatactagtcagtctagtcgttaccgtaccgacggtccctcgttacgtaccggtttccggggaccgggggtaccgtaaaggggttcggaacggtacgtaccgaacggtaaacggtaacgtacggttacggccgtaacggacctaacggtacttccgttcggttcctttaccgtaccg

SEQ ID NO: 326944 - DNA, 549 bp, Homo sapiens
  misc_feature: GZ8MTXP02IVLU1.44.39.D06.1.454.CMB.2.raw
  modified_base (436)..(436): a, c, t, g, unknown or other
  misc_feature (436)..(436): n is a, c, g, or t
tcagacagtatatacacgaccggtgctcgatttagtgacatctcgcagttctttggggggggtcacaagaggcagcgctctcgggacgtctccaccatggcctgggctctgctgctcctcactctcctcactcaggacacagggtcctgggcccagtctgccctgactcagcctgcctccgtgtctggttctcctggacagtcgatcaccatctcctgcactgggtccagcaatgacattgggagatataaccttgtctcctgtatcaacaacatccaggcaaacgcccccaaactctattactttttgagttccagtgacgcggccgtcaggttgtttctaatcgcttctctgcctccaagtctcgccacacggtccctcccgtgtcgatctcgtcgggcctcccggctggaggacgaggctgtacttattacgngtcggctcgtatttacaacttcttagagtacgttgggtacgttcgggcggtacgggctccgtaccgtcgacccgttctaaggtccacgtacccaggcctccggtccccctcgg

SEQ ID NO: 326945 - DNA, 533 bp, Homo sapiens
  misc_feature: GZ8MTXP02FNPZT.44.39.D06.1.454.CMB.2.raw
  modified_base (192)..(192): a, c, t, g, unknown or other
  misc_feature (192)..(192): n is a, c, g, or t
  modified_base (237)..(237): a, c, t, g, unknown or other
  misc_feature (237)..(237): n is a, c, g, or t
  modified_base (285)..(285): a, c, t, g, unknown or other
  misc_feature (285)..(285): n is a, c, g, or t
  modified_base (380)..(380): a, c, t, g, unknown or other
  misc_feature (380)..(380): n is a, c, g, or t
  modified_base (387)..(387): a, c, t, g, unknown or other
  misc_feature (387)..(387): n is a, c, g, or t
  modified_base (525)..(525): a, c, t, g, unknown or other
  misc_feature (525)..(525): n is a, c, g, or t
tcagacagtatatacacgaccggtgctcgatttagtgacatctcgcagttctttggggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatcctcctgcatggagccagcgtaatnttcttagtcttaactttgtctcctgtatcaacatcatccaggtaaacncccccaaatcatcatctatgaggacctataagacggccctgtaggggtttctaatccgcttcactgcctccaagtccggacaacgacggcctccngacatcnctggctcgagctgaggacgagctagatttattattgttgctacagtattcgttacgtcgctaatctactttatcgttcttacggaggtcgggaacacggtccaccgtctaggtccacggtacccaaggccccaacccnctcgtacc

SEQ ID NO: 326946 - DNA, 530 bp, Homo sapiens
  misc_feature: GZ8MTXP02IYRZ2.44.39.D06.1.454.CMB.2.raw
  modified_base (255)..(255): a, c, t, g, unknown or other
  misc_feature (255)..(255): n is a, c, g, or t
  modified_base (287)..(287): a, c, t, g, unknown or other
  misc_feature (287)..(287): n is a, c, g, or t
  modified_base (368)..(368): a, c, t, g, unknown or other
  misc_feature (368)..(368): n is a, c, g, or t
  modified_base (385)..(385): a, c, t, g, unknown or other
  misc_feature (385)..(385): n is a, c, g, or t
  modified_base (491)..(491): a, c, t, g, unknown or other
  misc_feature (491)..(491): n is a, c, g, or t
tcagacagtatatacacgaccggtgctcgatttagtgacatctcgcagttctttgggggagctacaacaggcaggcaggggcagcaagatggtgttgcagacccaggtcttcatttctctgttgctctggatctctggtgcctgcggggacatcgcgatgagccagtctccagactccctggctgtgtctctgggcgagagggccaccgtcaactgcaactccagccaaagtgtctttatcgtcccaatagtaanactattagcctggtaaccaacagaaaccgganagtactacctaaattactctttatggtcatctacgtcggagtccggggtcctgaccgtatcagtggcggcggtctgggacnctattccactctcaccntcagtacgcctgctagctagaacgacgtggctagtttaatagtttgactaataattagttttaacaacttcttaatctactttcggacgtagggaccagagtaganagtacaacgaacgtgtgcgtgacacctatctcgtacttc

SEQ ID NO: 326947 - DNA, 549 bp, Homo sapiens
  misc_feature: GZ8MTXP02IRSDY.44.39.D06.1.454.CMB.2.raw
tcagacagtatatacacgaccggtgctcgatttagtgacatctcgcagttctttgggggagctacaacaggcaggcaggggcagcaagatggtgttgcagacccaggtcttcatttctctgttgctctggatctctggtgcctgcggggacatcgcgatgagccagtctccagactccctggctgtgtctctgggcgagagggccaccgtcaactgcaactccagccaaagtgtctttatgtccccaatagtaagactattagcctggtaccaacagaaaccggacagtctctaaatactctttatggctatctacgtcggagtccgggtcctgaccgattcagtggcggcggtcgtgggcactatttcgacctcctcaccattccagtacgcctgcagctgaagacgtgctagtttattagttgtactaactaaattatttaagaaccttccttaatccgtaacgttttcgggacggtaggggacctaggacggttagagtaatacgaaacgaaactgtaggctgacacgactacgtcgtactttacc

SEQ ID NO: 326948 - DNA, 571 bp, Homo sapiens
  misc_feature: GZ8MTXP02F223R.44.39.D06.1.454.CMB.2.raw
  modified_base (191)..(191): a, c, t, g, unknown or other
  misc_feature (191)..(191): n is a, c, g, or t
  modified_base (225)..(225): a, c, t, g, unknown or other
  misc_feature (225)..(225): n is a, c, g, or t
tcagacagtatatacacgaccggtgctcgatttagtgacatctcgcagttctttgggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactgganccagcgtaatattctagtcttaacttgtctctggtatcaacatcatccaggtaaacgccccaaatcatcatctatgaggcctaagtaagacggccctcgaggggtttctaatcccgtcttcactcgccctccaacgtcccgggacaaaccgaccggtccctcccctagaccaactcctcgtcgggcctccagggctaggaggacgagctagatttattattgttgctcagtattcgttcgttcgactatctactttatcgttacgttacggaagtcgggaacctaagggtccacccggtcgtacgggtccacgacccgaaacggcccaaaccccgactacgtaccc

SEQ ID NO: 326949 - DNA, 539 bp, Homo sapiens
  misc_feature: GZ8MTXP02FRO1J.44.39.D06.1.454.CMB.2.raw
  modified_base (233)..(233): a, c, t, g, unknown or other
  misc_feature (233)..(233): n is a, c, g, or t
tcagacagtatatacacgaccggtgctcgatttagtgacatctcgcagttctttgggggcgggagtcagacccagtcaagacacagcgtggacatgagggtccccgctcagctcctggggctcctgctgctctggctcccaggtgccgactgtgccgtccagatgacccagtctccttccaccctgtctgcgtctctgggcacagagtcaccatcacttgccggccagtgagngtggctggatggctggatcaggaaagccgggaggtccccaagctctggtctataacgcctctattttagactagttggggtccctcaaggttcagtggacagaaacgtcgtgggtcactatttctctctcacatcaatggcctgcagcctgatgtatttgcgtacctacttctgccagcaacttataattcgttttcctccccttgccgttcgggcccggggtactagttcgtcggacccttaccgaacgtaactcggtggctacgaccacctactcttcgtcctttacacttccttcccgcctac

SEQ ID NO: 326950 - DNA, 787 bp, Homo sapiens
  misc_feature: GZ8MTXP02I9QKD.44.39.D06.1.454.CMB.2.raw
  modified_base (201)..(201): a, c, t, g, unknown or other
  misc_feature (201)..(201): n is a, c, g, or t
tcagacagtatatacacgaccggtgctcgatttagtgacatctcgcagttctttgggggaggaactgctcagttaggacccagagggaaccatggaagccccagctcagcttctcttcctcctgctactctggctcccagagatcaccggagatattgtgttgacacagtctccaggcaccctgtctttgctccagggganagacgccaccctctcctggtacgggccaggtcggagtgttgactaagtcctagcctaggtaccaacagaaacctggaccaggcctcccgaggcctcctcatctatcgatgacatccaaacgtgggtcaacgtcgaccacccccgagaccgtaggttccaaggttcggccgtaagggttcggggtacgtacggggaactacgggtacctttaccgaaccctttcccgtacccgtaacccggttacgaacggtaacctaaaacgttccggttaaacccgacgggtacccgttaaggtaaaacgtttagttttttacgggaacccttttaaagggtttttaacctttaaaccgttggttaacccttaacggacccgttaacggttccccgtttaccccggtacccgtaaccgggtccccgttaccgttaccggttaacccgggtttccggggggaccggggggtaaacccgtaaagggggttaccgggtaaggaaccgtttacggaaaacggtaaaccggtaacgttacgggtcggtaccgtaacgtacccgacgttaacgttccttacggtttacccttacgttaccc

SEQ ID NO: 326951 - DNA, 753 bp, Homo sapiens
  misc_feature: GZ8MTXP02HS07D.44.39.D06.1.454.CMB.2.raw
tcagacagtatatacacgaccggtgctcgatttagtgacatctcgcagttctttgggggagagacgagcccagcactggaagtcgccggtgtttccattcggtgatcatcactgaacacagaggactcaccatggagtttgggctgagctgggttttcctcgttgctcttttaagaggtgtccagtgtcaggagcacttggtggagtctgggggaggcgtggtccagcccggggcggtccgtcgagactctctgtgtcgtcgtcgtcggttcgtctactcgtagtagtagtttggttgtcgtacgtcggtccggccgacggcgtccgacggacggacggggacggggacgggtggggtgggtcgacgtacgtacgtccgtaccgaccgtagtaggtaaggtaggtaaggtaaggttaacgttacgttacgtaacgtaccgtaccggtacggtaacggggtaccggtaccgtaccgtaccctacctaccgtaccgtaacgaacgtaaacgtaaacttaaccgtaaacgtaaacgtaacgttacgtacgttacgtttacgtttacgttaacgtaaagtaaacgtaacgtaacgacggtaggtaggtacggtacggtacgtaacgtaacgttacgtttacgtttacgtttacgttacggttacggtacgggtacggggtaaccggtaaccggtaaacgggtaaacggggttaacggggtaacggtaacgtaaacgttaaaacgttaaacgttaacg

SEQ ID NO: 326952 - DNA, 530 bp, Homo sapiens
  misc_feature: GZ8MTXP02IC719.44.39.D06.1.454.CMB.2.raw
tcagacagtatatacacgaccggtgctcgatttagtgacatctcgcagttctttgggggagctacaacaggcaggcaggggcagcaagatggtgttgcagacccaggtcttcatttctctgttgctctggatctctggtgcctgcggggacatcgcgatgagccagtctccagactccctggctgtgtctctgggcgagagggccaccgtcaactgcaactccagccaaagtgtctttatgtccccaatagtaagactatttagcctggtaccaaacagaaaccggacagtctctaaattactctttatgggcatctatcgggagtccggggtcctgaccgattcagtggcggcgggtctggggcacatttcactctcacatcagtagccctgcaggtcagaagacgtggcagtttataattgtacaactaattattttaagaaactcctaatctaacgtttcgggagtacgggacctaagagtagagtaatacaaaacgaactgtggaactgacacctatctgtcttac

SEQ ID NO: 326953 - DNA, 617 bp, Homo sapiens
  misc_feature: GZ8MTXP02HORYF.44.39.D06.1.454.CMB.2.raw
  modified_base (314)..(314): a, c, t, g, unknown or other
  misc_feature (314)..(314): n is a, c, g, or t
  modified_base (338)..(338): a, c, t, g, unknown or other
  misc_feature (338)..(338): n is a, c, g, or t
  modified_base (370)..(370): a, c, t, g, unknown or other
  misc_feature (370)..(370): n is a, c, g, or t
  modified_base (464)..(464): a, c, t, g, unknown or other
  misc_feature (464)..(464): n is a, c, g, or t
tcagacagtatatacacgaccggtgctcgatttagtgacatctcgcagttctttgggggaggaactgctcagttaggacccagagggaaccatggaagccccagctcagcttctcttcctcctgctactctggctcccagataacaccggacaacctgtgttgacgcagtctccaggcaccctgtctttgtctgcaggggatagagcctccctctcctgcagggccagtcggagtgttgctaagtacctagcctggtaccaacagaaacctggccaggcctcccaggcctcctcatcctatgatgcatccaacngggtcacgtcggccaccccagacnggttcacggtggctaggtggggtctggggacnggtacttcacttcctaccgaccgtcagcaatcgtaacaggaccggtaagttattttgacttaagttttatactgtacagtctacgtccgttccnccgacggcccgtcttcgtaccgggtttccgggggaccgggggtaaccgtaagggggtcggaacgtacgttaccgaacggttaaaccggaacgttcggtacggcgttacggaacctaccgactttccggtcgtttccgttacgtactttccccg

SEQ ID NO: 326954 - DNA, 767 bp, Homo sapiens
  misc_feature: GZ8MTXP02IUZBN.44.39.D06.1.454.CMB.2.raw
  modified_base (203)..(203): a, c, t, g, unknown or other
  misc_feature (203)..(203): n is a, c, g, or t
  modified_base (323)..(323): a, c, t, g, unknown or other
  misc_feature (323)..(323): n is a, c, g, or t
tcagacagtatatacacgaccggtgctcgatttagtgacatctcgcagttctttgggggaggaactgctcagttaggacccagagggaaccatggaagccccagctcagcttctcttcctcctgctactctggctcccagagatcaccggagatattgtgttgacacagtctccaggcaccctgtctttgtctccgagggganagagccaccctctcctggtacgggccaggtcggagttgttgactaagtacctagcctaggtaaccaacagaaacctggccaggcctcccgaggcctcctcatctatgatgcatccaacgngggtcacgtcggaccaccccgaagacgtaggttcaggtcggactaggtcggggtctaggggaactaggtacctttacaccgttcctaccgaacccgtcaaacggacctaaagttacgtaaccgacggtacccgttaaggtaaacgtttacgtttttacgaaccgtttaaaggtttttaaacgtttaaccgtttacggttacccgtaaggtaccgttaacggttccccggttttaccccgtacccggtaaccggggtcccccgttacccgttacccgttaaccggggttttcccggggggacccggggggttaaacccgtaaagggggttaccgggaaagtacggttaccggaaaacgggtaaccggtaaaccggttgggtaccggtaccgtaacggaaccctaaccggttacttccgtttacggtttccgtttacttaaccccg

SEQ ID NO: 326955 - DNA, 639 bp, Homo sapiens
  misc_feature: GZ8MTXP02F8M2T.44.39.D06.1.454.CMB.2.raw
  modified_base (192)..(192): a, c, t, g, unknown or other
  misc_feature (192)..(192): n is a, c, g, or t
  modified_base (269)..(269): a, c, t, g, unknown or other
  misc_feature (269)..(269): n is a, c, g, or t
tcagacagtatatacacgaccggtgctcgatttagtgacatctcgcagttctttggggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactggagccagcggtaatattcttagtcttaacttgtctctgtatcaacntcatccaaggtaaacgcccccaaatcatcatctatgaggacctagtaagacggccctagtaggggtttctaagtccgtcttcactcgacctaccgaacgtccggacaaccgaccggtccctaccctgaaccaattccgtcgtcggcctccgacggctagacgggacgagtcgtagtaactttaagtttattggttactcttacgaagttagttcgttaccggtcgtctattaccctaagtttacgtcggtttacgttacggggtaaaggttacgggtaaaccgtaaacgggtcccgtaaacccgtccggttaacggtcccgaaccggaccccgaaaccggacccccaaaaccccgtcgtacgttaccccg

SEQ ID NO: 326956 - DNA, 555 bp, Homo sapiens
  misc_feature: GZ8MTXP02FOXNP.44.39.D06.1.454.CMB.2.raw
  modified_base (181)..(181): a, c, t, g, unknown or other
  misc_feature (181)..(181): n is a, c, g, or t
  modified_base (242)..(242): a, c, t, g, unknown or other
  misc_feature (242)..(242): n is a, c, g, or t
  modified_base (293)..(293): a, c, t, g, unknown or other
  misc_feature (293)..(293): n is a, c, g, or t
  modified_base (429)..(429): a, c, t, g, unknown or other
  misc_feature (429)..(429): n is a, c, g, or t
  modified_base (535)..(535): a, c, t, g, unknown or other
  misc_feature (535)..(535): n is a, c, g, or t
tcagacagtatatacacgaccggtgctcgatttagtgacatctcgcagttctttgggggagctacaacaggcaggcaggggcagcaagatggtgttgcagacccaggtcttcatttctctgttgctctggatctctggtgcctggcgggacatcgcgatgagccagtctccagacctcccnggctgtgtctcgtgggcgagacgggccacgtcaactgcaactccagccaagtgttctttancgtcccaatagtaagaactattagcctaggtaaccaacgacgaaaccgganagtactaccttaaaatttactacttttatggactagtactacgtacgggtacgtcccggggtaccctaggtaccgatttccgagtcgggcggtcggggtctacgggacacgtatttcgacctctacacatcagtancctgcaggcagagacgtgatagtttattatgtacaataatttattagaacctctatacctaacgttcggacggaggacaggagtagagtacaacaacgaacagtgngtcgacacactatctacttc

SEQ ID NO: 326957 - DNA, 513 bp, Homo sapiens
  misc_feature: GZ8MTXP02HTLPV.44.39.D06.1.454.CMB.2.raw
  modified_base (256)..(257): a, c, t, g, unknown or other
  misc_feature (256)..(257): n is a, c, g, or t
  modified_base (274)..(274): a, c, t, g, unknown or other
  misc_feature (274)..(274): n is a, c, g, or t
  modified_base (276)..(276): a, c, t, g, unknown or other
  misc_feature (276)..(276): n is a, c, g, or t
  modified_base (280)..(280): a, c, t, g, unknown or other
  misc_feature (280)..(280): n is a, c, g, or t
  modified_base (286)..(286): a, c, t, g, unknown or other
  misc_feature (286)..(286): n is a, c, g, or t
  modified_base (297)..(297): a, c, t, g, unknown or other
  misc_feature (297)..(297): n is a, c, g, or t
  modified_base (311)..(311): a, c, t, g, unknown or other
  misc_feature (311)..(311): n is a, c, g, or t
  modified_base (316)..(316): a, c, t, g, unknown or other
  misc_feature (316)..(316): n is a, c, g, or t
  modified_base (356)..(356): a, c, t, g, unknown or other
  misc_feature (356)..(356): n is a, c, g, or t
  modified_base (362)..(362): a, c, t, g, unknown or other
  misc_feature (362)..(362): n is a, c, g, or t
  modified_base (389)..(389): a, c, t, g, unknown or other
  misc_feature (389)..(389): n is a, c, g, or t
tcagacagtatatacacgaccggtgctcgatttagtgacatctcgcagttctttgggggcgggagtcagacccagtcaagacacagcgtggacatgagggtccccgctcagctcctggggctccctgctgctctggctcccaggtgccgactgtgccgtccagatgacccagtctccttccaccctgtctgcgtctctgggcgacagagtcaccatcacttgccgggccagtgagagtggctggatggcctggtannagaaagcggacggccancnctgntatacnctctattatanatggtcgtcagtanagtgnagaagtatgtcactattctctctcacatactaatagctcncagctntatgtatttgtcgtacctacttactcncacacactattaattatttcttccctcgtcgtcggtccgggaccgtacgtagtgtacgtaccaacgaaactacgtcggtcgtcgtcaccactaactctcttctacttaccttaccctaccctac

SEQ ID NO: 326958 - DNA, 592 bp, Homo sapiens
  misc_feature: GZ8MTXP02HMC5B.44.39.D06.1.454.CMB.2.raw
  modified_base (189)..(189): a, c, t, g, unknown or other
  misc_feature (189)..(189): n is a, c, g, or t
  modified_base (222)..(222): a, c, t, g, unknown or other
  misc_feature (222)..(222): n is a, c, g, or t
tcagacagtatatacacgaccggtgctcgatttagtgacatctcgcagttctttgggggggtcacaagaggcagcgctctcgggacgtctccaccatggcctgggctctgctgctcctcactctcctcacccaggacacagggtcctgggcccagtctgccctgactcagcctgcctcgtgtctggtcncctggacagtcgtcaccatctactgcactgganccagcgtaatattcttagtctttaacttgtctcctgtatcaacatcataccaaggtaaacgacccccaaatcatcatctatgagtctaagtaagacgcctagtagggttactaatcccgtcttcactcgcctaccgaacgtccgacaaacgaccgtccctccctagaactaactctcgtcggcctcgagcgtagaacggacgacggtctagtaatttattagttgtgtctagagtattgttcgtcgactactctacgtttagtgtttaccgtaagggaaggttacggaaacctaacgggttccgtaaccgttccgttaacggtccgaaccgaccccgaaacggacccccaaaccccgtctaccgtacccg

SEQ ID NO: 326959 - DNA, 567 bp, Homo sapiens
  misc_feature: GZ8MTXP02HDTOM.44.39.D06.1.454.CMB.2.raw
  modified_base (157)..(157): a, c, t, g, unknown or other
  misc_feature (157)..(157): n is a, c, g, or t
  modified_base (405)..(405): a, c, t, g, unknown or other
  misc_feature (405)..(405): n is a, c, g, or t
tcagacagtatatacacgaccggtgctcgatttagtgacatctcgcagttctttgggggagctacaacaggcaggcaggggcagcaagatggtgttgcagacccaggtcttcatttctctgttgctctggatctctggtgcctggcggggacatcgngatgagccagtctccagactccctggctgtgtctcgtgggcgaggacgggccaccggtcaactgacaacctccagaccaaagttgttacttttatcgtaccccaatagtaagaacttattacgcctaggtaccaaacacggaaaccgggacagtctacctaaattacttctttatggcatctacgtcgggacgtccggggtcctgacattcgagtggcgggcggtctgggcactattcactctcaccntcgagtacgctgcaggtctgaagacgtgactagtttatagttagtactaaactaatttagtttaacaacttccttatcgtacgtttcgggacggtaacggaccgtagaggtagagtaactacgaaaacgtactgtacgcgtgacctacattcgtctacttac

SEQ ID NO: 326960 - DNA, 693 bp, Homo sapiens
  misc_feature: GZ8MTXP02H5ZLO.44.39.D06.1.454.CMB.2.raw
  modified_base (297)..(297): a, c, t, g, unknown or other
  misc_feature (297)..(297): n is a, c, g, or t
tcagacagtatatacacgaccggtgctcgatttagtgacatctcgcagttctttgggggaggaactgctcagttaggacccagagggaaccatggaagccccagctcagcttctcttcctcctgctactctggctcccagagatcaccggagatattgtgttgacacagtctcaggcacctgtctttgtctccgaggggagagacgcccaccctctccgtggtacgggccaggtcggagtgttgctaagtacctagcctggtaccaacagaacctgccaggcctccgaggcctcctnactctatgatgacactaccaacgtagggtccacgtcggaccaacccccgagaccgagggttcaggtcggacgtagggtggggtaccgtaggggaacctggtacctttcgacccttcctaccgacccgtactacggacctaaagtcgtacacgtaccgtagtaaagttatttcgtacgttagttttactagttcgtacgtagtcgtacgttcccgttccgttacccgacggtcccgtacgttcccgtaccgggttttaccgggggaccggggggtaaacccggttaacgggggtacggggtaacggtacggttaacggaaacgggtaaccggtaaaccgtcggggttaacggcgtaacggacctaaccgtcgtaccgtcgtttccgtttacctaccg

SEQ ID NO: 326961 - DNA, 613 bp, Homo sapiens
  misc_feature: GZ8MTXP02HD45Y.44.39.D06.1.454.CMB.2.raw
  modified_base (227)..(227): a, c, t, g, unknown or other
  misc_feature (227)..(227): n is a, c, g, or t
  modified_base (238)..(238): a, c, t, g, unknown or other
  misc_feature (238)..(238): n is a, c, g, or t
  modified_base (359)..(359): a, c, t, g, unknown or other
  misc_feature (359)..(359): n is a, c, g, or t
tcagacagtatatacacgaccggtgctcgatttagtgacatctcgcagttctttggggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacaggtcggtcaccatctcctgcactgganccagcgtaatnttcttagtcttaacttgtctctgtatcaacatcataccaaggtaaccgacccccaaatcatcatctatgacgcctaagtacgacgtcccgtagtagggtttactaatcccgtcttcactcncctacacgtccgacaacgaccggccctccgtagacctactctacgtcggcctacgagtcgtaggacggacgacgtctagtaactttattagtttagtcgtacttacgtagtacgttcgttcgtcgtactaacttcgttaactttagttccgttacgttacggggtaaggtaccgggtaaccgtaacggtccgtacccgttacgtacggtaaccgaccgtacccgaaccggtaccccacccgtacgtacgtaccc

SEQ ID NO: 326962 - DNA, 612 bp, Homo sapiens
  misc_feature: GZ8MTXP02GT0V7.44.39.D06.1.454.CMB.2.raw
  modified_base (200)..(200): a, c, t, g, unknown or other
  misc_feature (200)..(200): n is a, c, g, or t
  modified_base (270)..(270): a, c, t, g, unknown or other
  misc_feature (270)..(270): n is a, c, g, or t
  modified_base (303)..(303): a, c, t, g, unknown or other
  misc_feature (303)..(303): n is a, c, g, or t
  modified_base (424)..(424): a, c, t, g, unknown or other
  misc_feature (424)..(424): n is a, c, g, or t
tcagacagtatatacacgaccggtgctcgatttagtgacatctcgcagttctttgggggaggaactgctcagttaggacccagagggaaccatggaagccccagctcagcttctcttcctcctgctactctggctcccagagatcaccggagatattgtgttgacacagtctccaggcacctgtcttgctccgagggganagacgcccaccctctccgtggtacgggccaggtcggagttgttgactaagtcctagcctaggtaaccaanacgaaacctggccaggcctcccgaggcctcctnatctatgatcgacactaccaaagtgggtccacgtggacccacccagacgtaggttcaggtcgacgtaggtcgggtcgtaggggaactacggtacctttcgaaccttcgtaccgaccggtanaacgtacctaagttcggaacacgtccgtaagtaaagttattttgactttagtttacgttacttggtacaagtcgtagtccgttacctcgacgtccgtctcgtacggttcgggggaccggggtaacaggggtcgagtacgtacgaacggaacgtacgtgtcgctcgacacctagtcgtactctactccg

SEQ ID NO: 326963 - DNA, 673 bp, Homo sapiens
  misc_feature: GZ8MTXP02IGFM1.44.39.D06.1.454.CMB.2.raw
  modified_base (203)..(203): a, c, t, g, unknown or other
  misc_feature (203)..(203): n is a, c, g, or t
  modified_base (206)..(206): a, c, t, g, unknown or other
  misc_feature (206)..(206): n is a, c, g, or t
  modified_base (267)..(267): a, c, t, g, unknown or other
  misc_feature (267)..(267): n is a, c, g, or t
  modified_base (293)..(293): a, c, t, g, unknown or other
  misc_feature (293)..(293): n is a, c, g, or t
  modified_base (300)..(300): a, c, t, g, unknown or other
  misc_feature (300)..(300): n is a, c, g, or t
  modified_base (377)..(377): a, c, t, g, unknown or other
  misc_feature (377)..(377): n is a, c, g, or t
tcagacagtatatacacgaccggtgctcgatttagtgacatctcgcagttctttgggggaggaactgctcagttaggacccagagggaaccatggaagccccagctcagcttctcttcctcctgctactctggctcccagagatcaccggagatatttgtgttgacacagtctccaggcaccctgtctttgctccgagggganagngccacctctcctggtagggccaggtcggagtgttgactaagtacctagcctggtaaccaanacgaactggccaggctccgagcctcncatctangatgcactaccaagacggtcacgtgaccacccgagaccgtggttacaggtggccgtaggtcggggttcaggggaccngggttaccttcaccttcgtacccgaacggttcaacgtactaagtacgtaaccgagtaccgtaagtaaggtttacttttacggtactttaaggtttaattcgtagtaccgtaaggtcttacggttcccgtttacccgtacgaccggtccgtaccgttcggttaaccggggtttccgggggtacggggggacccgtaaggggttacggtacggaggttacgtaaacggaacgtaaccggtggttaccggtacgtaaccgaccgtaacgtacgttacgtttccgttcgtttaccgtccg

SEQ ID NO: 326964 - DNA, 539 bp, Homo sapiens
  misc_feature: GZ8MTXP02G7UZ9.44.39.D06.1.454.CMB.2.raw
  modified_base (369)..(369): a, c, t, g, unknown or other
  misc_feature (369)..(369): n is a, c, g, or t
  modified_base (376)..(376): a, c, t, g, unknown or other
  misc_feature (376)..(376): n is a, c, g, or t
  modified_base (381)..(381): a, c, t, g, unknown or other
  misc_feature (381)..(381): n is a, c, g, or t
tcagacagtatatacacgaccggtgctcgatttagtgacatctcgcagttctttgggggagctacaacaggcaggcaggggcagcaagatggtgttgcagacccaggtcttcatttctctgttgctctggatctctggtgcctgcggggacatcgcgatgagccagtctccagacctccctggctgtgtctcgtgggcgagacgggccaccgtcaactgccaactccagaccaaagtgtctttatgtccccaatagtaagaactattagcctggtaccaacagaaccggacagtctactaaattactcttttatggctatcctacgtcgggacgtcccggggtccctgtaccgattcgagtcggccggngggttcngggcncgtatttccgactcctcaccatcagtacgcctgcgaggctagaagacgtgactagtttattattgtacaataattatttagaactctatctacgttcggcggagacagagtagagactacgaaaacgacgtgtagcgtagctacgtatctcgtcttac

SEQ ID NO: 326965 - DNA, 613 bp, Homo sapiens
  misc_feature: GZ8MTXP02IH05J.44.39.D06.1.454.CMB.2.raw
  modified_base (187)..(187): a, c, t, g, unknown or other
  misc_feature (187)..(187): n is a, c, g, or t
  modified_base (208)..(208): a, c, t, g, unknown or other
  misc_feature (208)..(208): n is a, c, g, or t
  modified_base (309)..(309): a, c, t, g, unknown or other
  misc_feature (309)..(309): n is a, c, g, or t
  modified_base (321)..(321): a, c, t, g, unknown or other
  misc_feature (321)..(321): n is a, c, g, or t
tcagacagtatatacacgaccggtgctcgatttagtgacatctcgcagttctttggggagcttcagctgtggtagagaagacaggattcaggacaatctccagcatggccggcttccctctcctcctcaccctcctcactcactgtgcagggtcctgggcccagtctgtgctgactcagccatcctnagcgtctcggggacccccggnagacggtcacgattctttttgtctggaagtaggtccaacatcggaaagtaattacgtatactggtatcggcaattcacaggagccggtccccagacccctnatctagtagganaatcaggccgccctcgacggggtccctgaccccgtattctctcgcctccaagtcgtcggcctaccgtcacgtccctcccgtggcccatccgtacggtcgggtcctccgggtaccgagggacgtcggacggtcttggtaatttacgtttcgtggttcggcgggttcgttagggatcgtactagttccgtaggtacgtcggtacttgtacgttaggttccggggacgggaacgggaccaacggtcctacggaaccgttacgtaacgtccgacgacccgtaacggccctacccgg

SEQ ID NO: 326966 - DNA, 523 bp, Homo sapiens
  misc_feature: GZ8MTXP02H3ZKJ.44.39.D06.1.454.CMB.2.raw
  modified_base (204)..(204): a, c, t, g, unknown or other
  misc_feature (204)..(204): n is a, c, g, or t
  modified_base (264)..(264): a, c, t, g, unknown or other
  misc_feature (264)..(264): n is a, c, g, or t
  modified_base (313)..(313): a, c, t, g, unknown or other
  misc_feature (313)..(313): n is a, c, g, or t
  modified_base (380)..(380): a, c, t, g, unknown or other
  misc_feature (380)..(380): n is a, c, g, or t
tcagacagtatatacacgaccggtgctcgatttagtgacatctcgcagttctttgggggaggaactgctcagttaggacccagagggaaccatggaagccccagctcagcttctcttcctcctgctactctggctcccagagatcaccggagatattgtgttgacacagtctccaggcaccctgtctttgtctccgaggggganagagcccaccctccctgtagggccagtcggagtgttgctaagtcctagcctggtaccaanagaaacctggccaggctcccgaggctcctcatctatgatgcatccaagnggtcacgtggccaccccagacaggtcaggtcggcaggtgggtctgggacagcttcactctcaccgtnagcaatgacagctgaagtattttgcttagtttattctgtcagtcagtcgttcctcgagcccgctcgtacgttcggggccgggggacaagggtcggagagtcgagacgaactggtagctgcaccgatcgtgtcttctactcccg

SEQ ID NO: 326967 - DNA, 538 bp, Homo sapiens
  misc_feature: GZ8MTXP02FGOI8.44.39.D06.1.454.CMB.2.raw
  modified_base (191)..(191): a, c, t, g, unknown or other
  misc_feature (191)..(191): n is a, c, g, or t
  modified_base (225)..(225): a, c, t, g, unknown or other
  misc_feature (225)..(225): n is a, c, g, or t
  modified_base (265)..(265): a, c, t, g, unknown or other
  misc_feature (265)..(265): n is a, c, g, or t
  modified_base (281)..(281): a, c, t, g, unknown or other
  misc_feature (281)..(281): n is a, c, g, or t
  modified_base (529)..(529): a, c, t, g, unknown or other
  misc_feature (529)..(529): n is a, c, g, or t
tcagacagtatatacacgaccggtgctcgatttagtgacatctcgcagttctttgggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactgganccagcgtaatattctagtcttaatttgtctctgtatcaanatcatccaggtaaacnccccaaatcatcatctatgagcctataagacggccctgagggtttctaatccgcttcactcgcctccaagtccgcaaacacggtccctcctagacaatctcgtcggctccaggctggaggacgagctagtatttattattgtagtctcgaggtattgtttacgcgtacattccactttatcgtcgttacggaaagttcgggaactacgggtctacccgtctaggtcacgacccacggacccaaacccncgacgtacc

SEQ ID NO: 326968 - DNA, 551 bp, Homo sapiens
  misc_feature: GZ8MTXP02IHH1H.44.39.D06.1.454.CMB.2.raw
tcagacagtatatacacgaccggtgctcgatttagtgacatctcgcagttctttgggggagctacaacaggcaggcagggggcagcaagatggtgttgcagacccaggtcttcatttctctgttgctctggatctctggtgcctggcggggacatcgcgatgagccagtctccagacctccctggctgtgtctcgtgggcgagacgggccaccgtcaactgcaactccagccaaagtgttctttatgtccccaatagtaagaactattagcctggtaccaacagaaccggacagtctctaaatctctttatggcatctacgtcgggacgtcccggggtccctgaccgtacttcaggtggcgggcgggtctggggacactatttccgactcctcgacatccagacgcctgcaggctggaacgacggtggactagtttacttattgtacaactaattattttaacgactacttatctacgtttcggcggaggaccagagtagataactacgaaacgaactgacggaacgttcgactacattccgtattcttac

SEQ ID NO: 326969 - DNA, 567 bp, Homo sapiens
  misc_feature: GZ8MTXP02GS5K6.44.39.D06.1.454.CMB.2.raw
  modified_base (192)..(192): a, c, t, g, unknown or other
  misc_feature (192)..(192): n is a, c, g, or t
  modified_base (211)..(211): a, c, t, g, unknown or other
  misc_feature (211)..(211): n is a, c, g, or t
  modified_base (226)..(226): a, c, t, g, unknown or other
  misc_feature (226)..(226): n is a, c, g, or t
  modified_base (238)..(238): a, c, t, g, unknown or other
  misc_feature (238)..(238): n is a, c, g, or t
  modified_base (287)..(287): a, c, t, g, unknown or other
  misc_feature (287)..(287): n is a, c, g, or t
  modified_base (486)..(486): a, c, t, g, unknown or other
  misc_feature (486)..(486): n is a, c, g, or t
  modified_base (498)..(498): a, c, t, g, unknown or other
  misc_feature (498)..(498): n is a, c, g, or t
  modified_base (509)..(509): a, c, t, g, unknown or other
  misc_feature (509)..(509): n is a, c, g, or t
tcagacagtatatacacgaccggtgctcgatttagtgacatctcgcagttctttggggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccntctcctgcactgganccagcggtaatnttcttagtcttaatttgtctctggtatcaacatcataccaaggtaaacncccccaaatcatacatactatggaggacctaagtaaacgacggtaccctcgtacggggtttactaaactcccggtacttacactcgacccttaccgaagtcccgggaacaaaccgtaccgggccctccctacgactaaactcgtctacgggcctaccgaggcctaggacggacgaggctagaatttattattgtagctnagtatcgttgcnactctaacttntgtctaggagtcggacgaagtccacgtctaggctacgccacgccaacctactcgtacc

SEQ ID NO: 326970 - DNA, 620 bp, Homo sapiens
  misc_feature: GZ8MTXP02JV8J6.44.39.D06.1.454.CMB.2.raw
  modified_base (248)..(248): a, c, t, g, unknown or other
  misc_feature (248)..(248): n is a, c, g, or t
  modified_base (458)..(458): a, c, t, g, unknown or other
  misc_feature (458)..(458): n is a, c, g, or t
tcagacagtatatacacgaccggtgctcgatttagtgacatctcgcagttctttggggggggtcacaagaggcagcgctctcgggacgtctccaccatggcctgggctctgctgctcctcactctcctcactcaggacacagggtcctgggcccagtctgtcctgactcagcctgcctccgtgtctggttctcctggacagtcgatcaccatctcctgcacgtgggtccagcaatgactagttggganatataacttgtctctgtatcaacaacatccaggacaaacgcccccaaatctattacttttgatccagtgagcggccgtcgaggttcgtttactaatcgtcttctctggtcctaccgaagttcctcggacctaccgaccggtccctcccgtgtaccgatctcgtcgggctcccggctggacgggacgaggtctaggtaacttacgttacgnggtccggtacttaccgttaactttaacctaacgtttccgttaggtaacgttaccgttgggggttacggttccggggacgggtacgggtacctaccgtaccgtcggtaaccccgttcgtaacggtacaccggacccaaggtccctcccggtcccccgttccgg

SEQ ID NO: 326971 - DNA, 712 bp, Homo sapiens
  misc_feature: GZ8MTXP02JO7W4.44.39.D06.1.454.CMB.2.raw
  modified_base (204)..(204): a, c, t, g, unknown or other
  misc_feature (204)..(204): n is a, c, g, or t
tcagacagtatatacacgaccggtgctcgatttagtgacatctcgcagttctttgggggaggaactgctcagttaggacccagagggaaccatggaagccccagctcagcttctcttcctcctgctactctggctcccagagatcaccggagatattgtgttgacacagtctccaggcacccttgtctttgtctccgagggganagagcccaccctctcctggtacgggccaggtcggagtgttgactaagtacctagcctaggtaccaacgagaaacctggccaggcctcccgaggctcctcatctatgatcgacactacccgaaacgacggggtaccacggtccggacccaacccccgaaggacctacggggtttacaggtcggggactaggggtcggggtcgtaggggactacggtactttacgacccttcgtaccgtaacccggtcacgggtacctaaagtttacggaaaccacggtacccgttaaggtaaacgtttacgtttttacgaacgtttaagttttacttaacgttgtacgtagacgttacgtcccgtttcccgacgacggtcccgcccgtttcggtaccggtttccgggggaaccgggggtacctaagggggtacggtacgtagtacccggaggtaaccggtaaacgtcggtcggtaaccgtcggacctaaccgtacgtcttcggttaccttacgtacccg

SEQ ID NO: 326972 - DNA, 667 bp, Homo sapiens
  misc_feature: GZ8MTXP02I3ZAW.44.39.D06.1.454.CMB.2.raw
  modified_base (202)..(202): a, c, t, g, unknown or other
  misc_feature (202)..(202): n is a, c, g, or t
  modified_base (408)..(408): a, c, t, g, unknown or other
  misc_feature (408)..(408): n is a, c, g, or t
  modified_base (435)..(435): a, c, t, g, unknown or other
  misc_feature (435)..(435): n is a, c, g, or t
tcagacagtatatacacgaccggtgctcgatttagtgacatctcgcagttctttgggggaggaactgctcagttaggacccagagggaaccatggaagccccagctcagcttctcttcctcctgctactctggctcccagagatcaccggagatattgtgttgacacagtctccaggcaccctgtctttgctccgagggganagagcccacctctccgtgtacgggccaggtcggagtgttgctaagtcctagcctggtaaccaacagaaacctggccaggcctcccgaggcctcctcatctagtgatcgactaactcccaacgagggtcaacgtcggacctaccccgagaccaggttcaggtcggctaggtcggggtctggggacaggtcttcgactcaccgacgtnagacaagtgtacagtcctagtaagttnttttagacgttaagtttacttacgtagttacgtaagtctacggtcccgtttaccgacccgacggtcccgtccgttaccggtaccgggtttccgggggaacggggggtaacctaagggggttcgggaaacgttacggtaccggaaaacggtaaccggtaaacggttcgggtcggtaccgttaacggaccctaaccggttacttcggttaccggtttctttaacccggttcccg

SEQ ID NO: 326973 - DNA, 593 bp, Homo sapiens
  misc_feature: GZ8MTXP02HTEHU.44.39.D06.1.454.CMB.2.raw
  modified_base (306)..(306): a, c, t, g, unknown or other
  misc_feature (306)..(306): n is a, c, g, or t
  modified_base (373)..(373): a, c, t, g, unknown or other
  misc_feature (373)..(373): n is a, c, g, or t
  modified_base (379)..(379): a, c, t, g, unknown or other
  misc_feature (379)..(379): n is a, c, g, or t
tcagacagtatatacacgaccggtgctcgatttagtgacatctcgcagttctttgggggagagacgagcccagcactggaagtcgccggtgtttccattcggtgatcatcactgaacacagaggactcaccatggagtttgggctgagctgggttttcctcgttgctcttttaagaggtgtccagtgtcaggagcacgttggtggagtcgtgggggaggcgtggtccaggcccgggagtccctgagactctcctgtgtagcctcgtggtctcattcgatagtatttggttgctacgtggggtcccnccaggcctccgaggcgaaggggccgaggtgggtgcagtcatctccgagagtggaagtgagtaagttnttactnagactccgtagaacgggccaattccacatctaccagagactaattaccaaagaactatgtcttagttatttgactaaatgaacagcgtagagtagttgaacgtactacgtcttagtttattacgtgtcggacggtacgggggacccttacggaaagggtaaaccgggttacggggaaacttaccgaagttaaaaccgttactttaacgtttaag

SEQ ID NO: 326974 - DNA, 570 bp, Homo sapiens
  misc_feature: GZ8MTXP02IGVNO.44.39.D06.1.454.CMB.2.raw
  modified_base (204)..(204): a, c, t, g, unknown or other
  misc_feature (204)..(204): n is a, c, g, or t
  modified_base (262)..(262): a, c, t, g, unknown or other
  misc_feature (262)..(262): n is a, c, g, or t
  modified_base (282)..(282): a, c, t, g, unknown or other
  misc_feature (282)..(282): n is a, c, g, or t
  modified_base (300)..(300): a, c, t, g, unknown or other
  misc_feature (300)..(300): n is a, c, g, or t
  modified_base (322)..(322): a, c, t, g, unknown or other
  misc_feature (322)..(322): n is a, c, g, or t
  modified_base (347)..(347): a, c, t, g, unknown or other
  misc_feature (347)..(347): n is a, c, g, or t
  modified_base (368)..(368): a, c, t, g, unknown or other
  misc_feature (368)..(368): n is a, c, g, or t
tcagacagtatatacacgaccggtgctcgatttagtgacatctcgcagttctttgggggaggaactgctcagttaggacccagagggaaccatggaagccccagctcagcttctcttcctcctgctactctggctcccagagatcaccggagatattgtgttgacacagtctccaggcaccctgtctttgtctccgaggggganagagcccacctctcctggtagggccagtcggagtgttgctaagtccagcctggtacanagaactgcagctccagctcnatctatgatgcatccaanagggtcacgtggcacccagacnggttcagtgcagtgggtctgggacnggtacttcgactctccacgtnagacatgtacagcctagagtattttgctagtttatactgttacagtcagtcctttccgccgtacggccgtcgttacgtaccggtttcggggccgggggtaacctaaggggttacggaggacgtacgaaacggaacggtaaccgtggttacggcgtaacgggacctaacccgtattacccggtttcgtttaccgttactaccg

SEQ ID NO: 326975 - DNA, 553 bp, Homo sapiens
  misc_feature: GZ8MTXP02I8BLO.44.39.D06.1.454.CMB.2.raw
  modified_base (447)..(447): a, c, t, g, unknown or other
  misc_feature (447)..(447): n is a, c, g, or t
tcagacagtatatacacgaccggtgctcgatttagtgacatctcgcagttctttggggggggtcacaagaggcagcgctctcgggacgtctccaccatggcctgggctctgctgctcctcactctcctcactcaggacacagggtcctgggcccagtctgccctgactcagcctgcctccgtgtctggttctcctggacagtcgatcaccatctcctgcactgggtccagcaatgacattgggagatataaccttgtctcctggtatcaacaacatccaggacaaacgacccccaaactcaattactttttgacgtccagtgagcggccgtgaggttcgtttactaatcgtcttctctggtcctccaagtctcggcccacaccggtccctcccgtgtccgatcgtcgtggggcctcccggcctggacggacgagctgactattacgngcgctcgtattacaacttctgagtcgttgggtacgttcgggcggtacgggactcgaccgtcggaccgtcgaacggtcaacgcccgaaggtcctaccggcccctcgg

SEQ ID NO: 326976 - DNA, 688 bp, Homo sapiens
  misc_feature: GZ8MTXP02J1M00.44.39.D06.1.454.CMB.2.raw
  modified_base (200)..(200): a, c, t, g, unknown or other
  misc_feature (200)..(200): n is a, c, g, or t
tcagacagtatatacacgaccggtgctcgatttagtgacatctcgcagttctttggggggggtcacaagaggcagcgctctcgggacgtctccaccatggcctgggctctgctgctcctcactctcctcactcaggacacagggtcctgggcccagtctgccctgactcagcctgcctccgtgtctggttctcctggacngtcgatcaccatcctcctgcacgtcgggtccagcaatgactagttgggatatactaccttgtctcctgtactacaacaacactaccaggaccaaaccgaccccctaaactctattacttttgacgtccagtgacggccgtccgtcgtaggttcctttactatcgtctttctcgttcggtcctacgtaacgtcctcggacccacgtacccggtccctcccgtggtccgtacttccgtccggtcggggtcccgtacccgggtccgtacgggacggggaccgtacgggtcctaggttaaccttacgttaccggtcggtcccggtaccttaacttaaccgttttaaccaaccgtttccgttaggtacggttacggtttcgggggttacggttaccggggacgggtaccgggtaccttcccgtaccgtaccggtacccgttacgtaacggtaccgaccgacccggtacggtcccgtccccggtccccgttcgg

SEQ ID NO: 326977 - DNA, 597 bp, Homo sapiens
  misc_feature: GZ8MTXP02IJQZ9.44.39.D06.1.454.CMB.2.raw
  modified_base (192)..(192): a, c, t, g, unknown or other
  misc_feature (192)..(192): n is a, c, g, or t
  modified_base (226)..(226): a, c, t, g, unknown or other
  misc_feature (226)..(226): n is a, c, g, or t
tcagacagtatatacacgaccggtgctcgatttagtgacatctcgcagttcttttgggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactgganccagcggtaatattcttagtcttaactttgtctcctggtatcaacatcatccaggtaaacgcccccaaatcaatcatctatgaggcctataagagccctcaggggtttctaatccgcttcactcgcctaccaacgtcccggacaaaccgaccggccccttccctagaacctaatccttcgcgggtctccgaggcctaggacggacgagggctagtaactttagtttagtttgttgtcttcgagtattgttacgtacgtactatactactttaagtcgtccgttaggaacggtacggtaaccaacgggttccaccggttactacggttaacgacgacccgaaacggacccctaaacccctacgtacgtaccc

SEQ ID NO: 326978 - DNA, 731 bp, Homo sapiens
  misc_feature: GZ8MTXP02IK5M8.44.39.D06.1.454.CMB.2.raw
  modified_base (204)..(204): a, c, t, g, unknown or other
  misc_feature (204)..(204): n is a, c, g, or t
  modified_base (435)..(435): a, c, t, g, unknown or other
  misc_feature (435)..(435): n is a, c, g, or t
  modified_base (576)..(576): a, c, t, g, unknown or other
  misc_feature (576)..(576): n is a, c, g, or t
tcagacagtatatacacgaccggtgctcgatttagtgacatctcgcagttctttgggggaggaactgctcagttaggacccagagggaaccatggaagccccagctcagcttctcttcctcctgctactctggctcccagagatcaccggagatattgtgttgacacagtctccaggcaccctgtctttgtctccgaggggganagacgcccaccctctccgtggtacgggcctaggtcggagttgttgacttaagtacctagccgtaggtaaccaagaacgaaaccgtggaccaaggtcctacccaggtcctccgtactattctaagtgactgacctatacccaaacggtagggtacctaacgtcgggacccaaacccccgtagaaccgtacggtttcaggtcggacgtaggggttcggggtcgtacgggaacncggttacttcaccgttccgtacccgtccgtaatactaactaacgttacgtaacgtacgtacctaagtaaacgttagttttacgactttaaaggttttactacgttcgtacgtactacgtacgttccgtttcccgacccggnggtcccgtaccgttacgttaccgggtttaccgggggaccggggggtaaaccctaagggggttacgggaacggtacgtaacggtaaacgggtaacgtaacgttcggtcgtacgtaacggtaccaaccgtacttcgttcgtttaccttacttacccg

SEQ ID NO: 326979 - DNA, 627 bp, Homo sapiens
  misc_feature: GZ8MTXP02HY4JK.44.39.D06.1.454.CMB.2.raw
  modified_base (192)..(192): a, c, t, g, unknown or other
  misc_feature (192)..(192): n is a, c, g, or t
  modified_base (226)..(226): a, c, t, g, unknown or other
  misc_feature (226)..(226): n is a, c, g, or t
  modified_base (240)..(240): a, c, t, g, unknown or other
  misc_feature (240)..(240): n is a, c, g, or t
tcagacagtatatacacgaccggtgctcgatttagtgacatctcgcagttctttggggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcgtcaccatcctcctgcactgganccagacggtaattnttcttatctttaacttgtctctgtatcaacatcataccgaaggtaaaccgaccccctaaatcactctactactatgacggtactaagtaaacggacgtcccgtacgtacggggtttactaacgtcccgtcttactacgtccgtacctaccgaacgtccggaccaacgaccggtccctccgtacgactactctcgtcggcctcgagcgtgacggcgagctagtactttattcgttgttagtctacgtagtcgtttcgttcgtcgtactcttacttacgttagttcgtttacgttacggtaagggttaccggacgtaaacggttccgtaccgttaccgtacggtaaccgaacgacccgtaaccggacccaaccccgtacttcgtacccg

SEQ ID NO: 326980 - DNA, 599 bp, Homo sapiens
  misc_feature: GZ8MTXP02GI6GC.44.39.D06.1.454.CMB.2.raw
  modified_base (205)..(205): a, c, t, g, unknown or other
  misc_feature (205)..(205): n is a, c, g, or t
  modified_base (324)..(324): a, c, t, g, unknown or other
  misc_feature (324)..(324): n is a, c, g, or t
tcagacagtatatacacgaccggtgctcgatttagtgacatctcgcagttctttgggggaggaactgctcagttaggacccagagggaaccatggaagccccagctcagcttctcttcctcctgctactctggctcccagagatcaccggagatattgtgttgacacagtctccaggccaccctgtctttgtctccgaggggganagagccaccctctcctggtagggccaggtcggagtgttgctaagtacctagcctggtaaccaacagaaacctggccaaggcctcccgaggcctccgtcatctatgatgcataccaaagngggtcacgtcggcccaaccccgaagactagggttcaaggtcggctaggtgggtcgtagggacaggaccttcactcctcaccgtcagcaatgtacagcctagtaatagtttgacttagtttaactacttgactaggctaggtcctttccgccgacggtccgtcttcggtaccggtttacgggggcgggggtaaaccaaggggtcggaagtacgttaccgaaggaaccgtaacgtggtcggtacgtcgacaacctttctcgttacgttcctactacg

SEQ ID NO: 326981 - DNA, 795 bp, Homo sapiens
  misc_feature: GZ8MTXP02ILSSG.44.39.D06.1.454.CMB.2.raw
tcagacagtatatacacgaccggtgctcgatttagtgacatctcgcagttctttgggggaggaactgctcagttaggacccagagggaaccatggaagccccagctcagcttctcttcctcctgctactctggctcccagagatcaccggagatattgtgttgacacagtctccaggcaccctgtctttgtctccgagggggagagacgccaccctctcctggtacgggccctaggtcggagtgttgacttaagtacctagcctggtaaccaacagaaaccgtggccaaggcctcccgaggcctcctcactctatgatcgcactaccgaaagtacgggtccacgtcggacccacccccgaaggaccgtaacgggtttccaagggttcgggaccgtaggggtttcgggggttaccgttagggggaacctacggggttacctttacccgtaaaccgtttcccgtacccgtacccggtttacaaacgggtaccctaaagttacggttaaaccacggtacccgttaaggtaaaagtttacgtttttacggtaacgttttaaaggtttttaaacctttacgtttacggttaccgtaacggtaccgttaacggtttcccgtttaccccggtaccccgtaccgggggtccccttaacccgtttccggttaaccgggtttccgggggaacccggggggtaaaccgtaagggggttaccggaggtaaacgtccggtaaacggaaccggtaccgttaggttcggacttaacgccgtaacctcgttacgtcgtttcctaacgttcc

SEQ ID NO: 326982 - DNA, 570 bp, Homo sapiens
  misc_feature: GZ8MTXP02G97X4.44.39.D06.1.454.CMB.2.raw
  modified_base (453)..(453): a, c, t, g, unknown or other
  misc_feature (453)..(453): n is a, c, g, or t
  modified_base (470)..(470): a, c, t, g, unknown or other
  misc_feature (470)..(470): n is a, c, g, or t
tcagacagtatatacacgaccggtgctcgatttagtgacatctcgcagttctttggggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtaatattctagtcttaacttgtctcctgtatcaacatcataccgagtaaacacccccaatcatcatcatgagcctaagaagagccctagtagggttctaatccgcttacactcgccctacgaacgtccgctaaacgacccggtcctcctagactaaatccgtactgggcctccgacgcgtagacgggacgtaggctagtaaattagttattggtctacgntaagtgtcgttcggacntactacctatagtcgttacgtaggtagtacgggtaacaaacgtcgaacccgttcgtaacggccaacgcccgaaacggaccccaaaccgtacgtctacccg

SEQ ID NO: 326983 - DNA, 546 bp, Homo sapiens
  misc_feature: GZ8MTXP02HNV03.44.39.D06.1.454.CMB.2.raw
  modified_base (368)..(368): a, c, t, g, unknown or other
  misc_feature (368)..(368): n is a, c, g, or t
  modified_base (388)..(388): a, c, t, g, unknown or other
  misc_feature (388)..(388): n is a, c, g, or t
  modified_base (397)..(397): a, c, t, g, unknown or other
  misc_feature (397)..(397): n is a, c, g, or t
tcagacagtatatacacgaccggtgctcgatttagtgacatctcgcagttctttggggggcgggagtcagacccagtcaagacacagcgtggacatgagggtccccgctcagctcctggggctcctgctgctctggctcccaggtgtcgactgtgccgtccagatgacccagtcctccttccaccctgtctgcgtctcgtgggcacagagtcaccatcacttgccgggcagtgagagtggctgatggctggtatcgaaggaaacggcccgggaggtcccaagctccgtggtctactacgtccttctatttagactagttcggggtccctagaggttcagtggacaggaacgtcgtggtcactatttcnctctcacatcatcggctgcngctgatgtntttcgcctactacttcgcgccagctacttaattattctttcctcccgtgtccggttccgggcccggtactgttcgacgtaccctacgtaaacgtactcggtacgctcgaccactagtcgttcgttccttctacttccctcccgtactac

SEQ ID NO: 326984 - DNA, 765 bp, Homo sapiens
  misc_feature: GZ8MTXP02FXBKN.44.39.D06.1.454.CMB.2.raw
  modified_base (202)..(202): a, c, t, g, unknown or other
  misc_feature (202)..(202): n is a, c, g, or t
tcagacagtatatacacgaccggtgctcgatttagtgacatctcgcagttctttgggggaggaactgctcagttaggacccagagggaaccatggaagccccagctcagcttctcttcctcctgctactctggctcccagagatcaccggagatattgtgttgacacagtctccaggcaccctgtctttgctccgagggganagacgccaccctctcctggtacgggccaggtcggagttgttgacgttaagtcctagcctggtaaccaacagaaacctggcaggcctcccgagcctcctctatctatgatgctaactaccgaacgtcgggtaccacgtcggacccaacccccgaagaccgtaggttacgacggtcggacgtagggtcggggttacgtacggggaacctacggtacctttaccgaaccgtttcccgttacccgtaacccggtactaaccggtacctaaacgtttacggtaaaccgtaaccgtacccggttaaggttaaaacgttagttttttacggaaccgttttaagttttaaacgttaccgttacggttacccgtaggtaacccgtaacggttcccccgttttaccccgacccgtaccgggttcccgttaccttaccccgggtacgggttttacccggggggaaccgggggttaacccgtaggggttaaggacggtaacgtacggaacggtaccggtaaacgtcgggtcggactccgcgtaacgttacttcgttacgtaccttacgtttaccc

SEQ ID NO: 326985 - DNA, 666 bp, Homo sapiens
  misc_feature: GZ8MTXP02FOK3P.44.39.D06.1.454.CMB.2.raw
tcagacagtatatacacgaccggtgctcgatttagtgacatctcgcagttctttggggggggtcacaagaggcagcgctctcgggacgtctccaccatggcctgggctctgctgctcctcactctcctcactcaggacacagggtcctgggcccagtctgccctgactcagcctgcctcgtgtctggttctcctggacagtcgatcaccatctcctgctacgtgggtccagcaatgactagttgggagatataaccttgtctccgtggtatcaacaacactaccaggacaaacgacccccaaactctattacttttgatccagtgagcgcgtcgtaggtcgttactaatcgtcttctccgtgtcctccgaagtccgttacgggccctaacgaccgggtccctcccgtgtaccgtctcctcgtcggggtcctcccggtacgtacgggaacggaccgacggtaccgttgaaccgttaacgtttacgtcgccgggtctaacccgtaacttttaaccgaacgtttaccgttagtaaacgggttccggtttcgggggttaaggttccggggacggggtaaacgggtccttaccgaccgtaaccgtcccgttaccggtaacggtaccgtaacgaccccggtaacgtccggtacccccgtccccgtttcccgg

SEQ ID NO: 326986 - DNA, 550 bp, Homo sapiens
  misc_feature: GZ8MTXP02FW2DD.44.39.D06.1.454.CMB.2.raw
tcagacagtatatacacgaccggtgctcgatttagtgacatctcgcagttctttggggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtaatattcttagtcttaacttgtctctgtatcacatcatcaggtaaacgccccaaactcatcatctatgaggcctagtaagacggccctcgaggggtttactaactccgtacttcactcgacctaccgaagtcccggacaacgaccggtccctcccctagaacctaaacttcctcgttcggcctccgaggcctaggacggtacgaggctagtatttatttagttgttgctcagtattcgtcgtcgctatcattatgtcgttggagtcggaacgaggtccacgtctaggtcacgaccgacgcccaacccgctcgtacc

SEQ ID NO: 326987 - DNA, 617 bp, Homo sapiens
  misc_feature: GZ8MTXP02IEMSM.44.39.D06.1.454.CMB.2.raw
  modified_base (190)..(190): a, c, t, g, unknown or other
  misc_feature (190)..(190): n is a, c, g, or t
  modified_base (225)..(225): a, c, t, g, unknown or other
  misc_feature (225)..(225): n is a, c, g, or t
  modified_base (237)..(237): a, c, t, g, unknown or other
  misc_feature (237)..(237): n is a, c, g, or t
  modified_base (254)..(254): a, c, t, g, unknown or other
  misc_feature (254)..(254): n is a, c, g, or t
  modified_base (305)..(305): a, c, t, g, unknown or other
  misc_feature (305)..(305): n is a, c, g, or t
  modified_base (314)..(314): a, c, t, g, unknown or other
  misc_feature (314)..(314): n is a, c, g, or t
  modified_base (468)..(468): a, c, t, g, unknown or other
  misc_feature (468)..(468): n is a, c, g, or t
tcagacagtatatacacgaccggtgctcgatttagtgacatctcgcagttctttgggggggtcacaagaggcagcgctctcgggacgtctccaccatggcctgggctctgctgctcctcactctcctcacccaggacacagggtcctgggcccagtctgccctgactcagcctgcctcgtgtctgggtcncctggacagtcgtcaccatcctcctgcacgtgganccagcgtaattnttcttagtcttaacttntctcctgtatacaacatcatccaaggtaaacacccccaaatcatcatctangacgctaanaacgcgcctagtaggtttactaagtccgcttcactcgcctacgaacgtccgactaaacgccgtccctccctagaacctaatcctcgtacggcctaccgaggccgtaggacggtaacgaggtctagtaatttagtttagttgtgtactcgaagtnttggttcgactactattacctaactttgtacgttacgttacgggaaacgttacgggaaacccgtaaaggtccccaaaccgttccgttaaagggcccaacggaaaccccgaaccggtaaccccaaaccccgtaacgtttccgtaaccccg

SEQ ID NO: 326988 - DNA, 748 bp, Homo sapiens
  misc_feature: GZ8MTXP02JXQCG.44.39.D06.1.454.CMB.2.raw
  modified_base (168)..(168): a, c, t, g, unknown or other
  misc_feature (168)..(168): n is a, c, g, or t
  modified_base (202)..(202): a, c, t, g, unknown or other
  misc_feature (202)..(202): n is a, c, g, or t
tcagacagtatatacacgaccggtgctcgatttagtgacatctcgcagttctttggggggaggaactgctcagttaggacccagagggaaccatggaagccccagctcagcttctcttcctcctgctactctggctcccagagatcaccggagatattgtgttgacanagtctcaggcaccctgtctttgctccgagggganagagccaccctctcctggtacgggccaggtcggagttgttgactaagtcctagtccgtaggtaacccaacgagaaacctggaccaggcctccgagcctcctacatctatgattcgacactaccgaaacgtaggggtacctacgtacggacccaaaccccgagtaaccgtagggtttacgacggttcgggcgtaaggggtcggggttaccgtaggggacacggtaacctttcaccgtacctccgtaaccggtacaacggacctaaagttacggtaacgtacggtacccttaggtaaaagtttagtttacgttaaccgtttaaaggttttactttaacgttacgtaaccgtaaggtacctaacggttcccgttcccgtacccggtaaccgggtccctcgttacccgttaccgggggtttcccgggggaacggggggtaacctaacgggggtaggaacggttagtaccggaaacggaaccggtaacggtcgggtcgggtacctaacggacccgtaaactcggttcttacggtttccttaccgttacccg

SEQ ID NO: 326989 - DNA, 662 bp, Homo sapiens
  misc_feature: GZ8MTXP02FKR2R.44.39.D06.1.454.CMB.2.raw
  modified_base (245)..(245): a, c, t, g, unknown or other
  misc_feature (245)..(245): n is a, c, g, or t
tcagacagtatatacacgaccggtgctcgatttagtgacatctcgcagttctttggggggggtcacaagaggcagcgctctcgggacgtctccaccatggcctgggctctgctgctcctcactctcctcactcaggacacagggtcctgggcccagtctgccctgactcagcctgcctccgtgtctggttctcctggacagtcgatcaccatctcctgcacgtgggtccagcaatgacagtgganatataccttgtctctgtatacaacacatccaggacaaacgacccccaaatctattacttttgacgtccaggtcgacgccggcgtcgtagggttctttactaatcgtctttctcgtcgtctaccgaagtctcggacctacgaccggtccctaccgtgtcgtactccgtcgtcgggtcccgcccggtacgtaggacgggacgacgggtccgtaggtaaccttacgttccgcggtccggtacttacttaactttaacctaaccgtttgttaacggtaacggttccgggtttggggtcggtttaccgggggacgggggtaacgggtaaccctccggttaaaccggttccggtacccggtttaccgtaacggggacctaacccggacccgtaacggtccgttccccggcccccgtttaccgg

SEQ ID NO: 326990 - DNA, 770 bp, Homo sapiens
  misc_feature: GZ8MTXP02HQWML.44.39.D06.1.454.CMB.2.raw
  modified_base (192)..(192): a, c, t, g, unknown or other
  misc_feature (192)..(192): n is a, c, g, or t
  modified_base (289)..(289): a, c, t, g, unknown or other
  misc_feature (289)..(289): n is a, c, g, or t
tcagacagtatatacacgaccggtgctcgatttagtgacatctcgcagttctttggggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcacgtggacgccagcgtaatattcttagttcttaatttgtctcctggtatcaacatcatccaaggtaaacncccccaaactcatcatctatgacgacctaataacggacggtaccctacgtaggggtttctaacgtcccgtaccttacactcgtaccttacccgaagttcccggacaaaccgacccggtccccttacccgttaacgaacctaaacttccctccggttcggggacccttaccgacgggccgttagggaaccgggggtaacggacgggtaccgtttaggttaaattttaaacgtttttagttttcggtttacgttaccgttacgttaagggttaaccgtttcgggtttacccgttccggtactaaacgtttaccttaacgtttttacggttacggtttaccggtttaaccggggtaaagggtttcccgggtaaaccggttaaaacgggtttccccgtaaaccggtttcccgtaacggttaaccgaaccggacccccggtaaaaccggacccccaaacccccgtacgttacccggtttaaccccg

SEQ ID NO: 326991 - DNA, 704 bp, Homo sapiens
  misc_feature: GZ8MTXP02HCHDB.44.39.D06.1.454.CMB.2.raw
  modified_base (204)..(204): a, c, t, g, unknown or other
  misc_feature (204)..(204): n is a, c, g, or t
  modified_base (273)..(273): a, c, t, g, unknown or other
  misc_feature (273)..(273): n is a, c, g, or t
  modified_base (280)..(280): a, c, t, g, unknown or other
  misc_feature (280)..(280): n is a, c, g, or t
  modified_base (301)..(301): a, c, t, g, unknown or other
  misc_feature (301)..(301): n is a, c, g, or t
tcagacagtatatacacgaccggtgctcgatttagtgacatctcgcagttctttggggggaggaactgctcagttaggacccagagggaaccatggaagccccagctcagcttctcttcctcctgctactctggctcccagagatcaccggagatattgtgttgacacagtctccaggcacctgtctttgtctccgaggggganagacgcccacctctccgtggtacggccaggtcggagttgttgactaagtacctagcctaggtaaccaanagaaccnggccaggcctccaggcctccnactctatgatgcaactccaaagcgggtcacgtcggacccaccccgagacgtacggttcaacgggtggacgtagggtcggggtacgtacggggaactaccggtacctttacccgaacttcccgtacccgtaccgtcgaacgtacaaagtttcgaaccgtacggaccgtttaaggtaaactttgttttacgaacgttttaagttttacgttaacttcgtacgtagcgtttaccgtccccgtttaccaccggaccgggtccctcgttcccggttaccgggttccggggggtaaccgggggaactacgggggttacggcgtaaggtccggaaagggttaaccggtaagttcgggtcggtacgtccggtacctacggttacgtcctacggtttcctttaaacgcccgg

SEQ ID NO: 326992 - DNA, 1060 bp, Homo sapiens
  misc_feature: GZ8MTXP02HI5Q2.44.39.D06.1.454.CMB.2.raw
  modified_base (190)..(190): a, c, t, g, unknown or other
  misc_feature (190)..(190): n is a, c, g, or t
tcagacagtatatacacgaccggtgctcgatttagtgacatctcgcagttctttggggggggtcacaagaggcagcgctctcgggacgtctccaccatggcctgggctctgctgctcctcactctcctcacccaggacacagggtcctgggcccagtctgccctgactcagcctgcctcgtgtctggtcncctggacagtcggtcaccatcctcctgcacgtggacgccagcggttaaattactttacttacgttactttaactttcgtcttccgtggtactacaactataccacttacccgaaagggtaaaacccacccccctaaaactacctaacttacctaacttaccttaagtacggtaacgggtaccctttaaaagtaaacgggaaccggttacccccttacgggttaaaccgggggtttttaccttaaaacgttcccccggttacctttaccgtaacccgttaccggttacccccttaccccggtaaaaccgggttcccccggggaaacccgtaaaacccggtaacccccgggggtaccccccctttcccccggttaaacggtaaaaccccttaaaccgtttcccgtttacccgggttaccgggggtccccctttaaccccgggaacgggggtaccccgttagggggaaaaccgggggttaacccggggaaacggggtacccgtttagggttaaaactttttaaccggtttttaaagtttttccgggttacggtttaaccgttacccggttaaaagggttaccggtttccgggttttcccggtaaccgggttaccgtttaaaacgtttcccccgtttaaatttttaacgggtttacccgggtttaccggtttaacccgggggtttaaacggggttaaacccgggggttaaaccccggtttaaacggggttaaccccccggttaaaacccccgggtttacccggtttaaaacccggggttaacccgtaaaccccggaaaaccccccggggttaaaacccccggggtaaccccctaaaacccccccggtacgttttaaaaccccggttacccccgg

SEQ ID NO: 326993 - DNA, 665 bp, Homo sapiens
  misc_feature: GZ8MTXP02GUF6I.44.39.D06.1.454.CMB.2.raw
  modified_base (227)..(227): a, c, t, g, unknown or other
  misc_feature (227)..(227): n is a, c, g, or t
  modified_base (277)..(277): a, c, t, g, unknown or other
  misc_feature (277)..(277): n is a, c, g, or t
tcagacagtatatacacgaccggtgctcgatttagtgacatctcgcagttcgtttggggggggtcacaagaggcagcgctctcgggacgtctccaccatggcctgggctctgctgctcctcactctcctcactcaggacacgagggtcctgggcccagtctgccctgactcagcctgcctccgtgtctggttctcgtggacagtcgtcactatctctgcagtggacncgaggtcggtaattattcttagttacttaacttgtctccgtgtatcaatntcataccgaagtaaaccaccccaaatcatcatcatgacgtactaagtaacgcgtccgtaggtacggtttacaacgtcgtacctacactcgaccctacgaccggtccgacaaccgaccgtccctacctagaactactctacggtcgacctcgagggtcacgggaacggaccggtagacgttagttaatttaaagttaggtttcgtacgtcttaacggtagtaacgtttcggttaccgtacgtactacttaactacgtttaacgttcggttacggttaaccgggtaaggtacccgggtaacctaacgggttaccctacccggttacgttaaccggaaccgacccggtaaaaccccgaacccggaacccccaacccgttacgttaaccccg

SEQ ID NO: 326994 - DNA, 689 bp, Homo sapiens
  misc_feature: GZ8MTXP02IVVM8.44.39.D06.1.454.CMB.2.raw
  modified_base (225)..(225): a, c, t, g, unknown or other
  misc_feature (225)..(225): n is a, c, g, or t
tcagacagtatatacacgaccggtgctcgatttagtgacatctcgcagttctttggggggggtcacaagaggcagcgctctcgggacgtctccaccatggcctgggctctgctgctcctcactctcctcactcaggacacagggtcctgggcccagtctgccctgactcagcctgcctcgtgtctggttctcctggacagtcgtcaccatctctgcacgtggacnccagtacggtaattattcttagttacttaacttgtctctggtactacaacactacactaccgaacggtaaacccacccctaaatctaactactatactagtagacgtactaaagtaacggaccgtacccttacggtaagggtttaccaaccgtccgtcttacgacctcgtacccctaaccgacggtcccgaactaaacccgacccgtccctaccgtaacgtacctaaacgttccgttacgcgggtacctcggtaaggtcccgtagggaacggtacggaggtaccttaagttaattttaagtttacggtttccggttatacccgtagtaaccgtagtttccggttacggctaacttactaccgtttagttaacgttcgtacgttaagggtaacgtacggaacgtacgtcctaaccgtcgtaacgtaccaaccgacccgaccgtaacccctaaccgtcttaacccg

SEQ ID NO: 326995 - DNA, 773 bp, Homo sapiens
  misc_feature: GZ8MTXP02JI6WG.44.39.D06.1.454.CMB.2.raw
tcagacagtatatacacgaccggtgctcgatttagtgacatctcgcagttctttggggggggtcacaagaggcagcgctctcgggacgtctccaccatggcctgggctctgctgctcctcactctcctcactcaggacacagggtcctgggcccagtctgccctgactcagcctgcctccgtgtctggttctcctggacagtcgatcaccatcctcctgcacgtgggtccagcaatgactagttgggagatataaccttgtctcctggtatcaacacatccaggacaaaccgaccccctaaactctaacttacttttagacgtaccctagtcgacggccgtccgtacgtaggttcgtttactaaacgttccgtaccttttcgtccgttcggtccctccgtaaacggttccgttacgggccccaacgacccgggtccccttccccgttacggtacccgtacttcccgttacggttcggggtcccgttccccggggaccgttacgggaacgggtacccggaggtaccttacggtaaaccttaacgtttcgtacggtccgggtacttacctaacgttttaacccaaccgtttacgttacggtaaacggttaccggtttgggggtttaccgggtttaccggggaccgggggtaacggggtaacccttacccggacccgtttaccggggaacccccgtttaccggtaacggttccccgaaccggttaacccccggaaacggtacccccgttaccccgggtccccccgtttacccgggg

SEQ ID NO: 326996 - DNA, 766 bp, Homo sapiens
  misc_feature: GZ8MTXP02FHUS8.44.39.D06.1.454.CMB.2.raw
  modified_base (204)..(204): a, c, t, g, unknown or other
  misc_feature (204)..(204): n is a, c, g, or t
tcagacagtatatacacgaccggtgctcgatttagtgacatctcgcagttctttgggggaggaactgctcagttaggacccagagggaaccatggaagccccagctcagcttctcttcctcctgctactctggctcccagagatcaccggagatattgtgttgacacagtctccaggccaccctgttctttgctccgagggganagacgccaccctctccgtggtacgggccaggtcggagttgttgacttaagtacctaggcctaggtacccaacagaaacctggccaggctcccgaggcctccacatctatgatgacatacccgaaacgacggggttccaaccgtcgggacccaaccccccgaagaccgtagggtttacacggttcgggccgtaaggggttcggggtcgtaggggaacctaggtaccttcaaccttcctacccgaaccgttacaaggtacctaaagttcgtaacacgtacccgttaagaaacgttatttttacggacgtttaagtttttaaacgttacgttacggttaccgacgtaccgtaacggttcccggtttacccgtacccgtaaccggggtccccgtacgttaacccggttacccgggtttacccggggggaccgggggggttaaacccaaagggggttacggaacgggtaacgttaccgaaacgggtaaaccggttaacgtacggggtcggtaccgttaaccggacctaacccgtacgttaccgttcggtttacctttacttaacccg

SEQ ID NO: 326997 - DNA, 573 bp, Homo sapiens
  misc_feature: GZ8MTXP02FYNC1.44.39.D06.1.454.CMB.2.raw
  modified_base (310)..(310): a, c, t, g, unknown or other
  misc_feature (310)..(310): n is a, c, g, or t
  modified_base (457)..(457): a, c, t, g, unknown or other
  misc_feature (457)..(457): n is a, c, g, or t
  modified_base (461)..(461): a, c, t, g, unknown or other
  misc_feature (461)..(461): n is a, c, g, or t
tcagacagtatatacacgaccggtgctcgatttagtgacatctcgcagttctttggggagcttcagctgtggtagagaagacaggattcaggacaatctccagcatggccagcttccctctcctcctcaccctcctcactcactgtgcaggtcctgggcccagtctgtgatgtctcagccaccctcagcgtcgtcggggacccccgggcgagggggtcaccatctcttgttctaggaagagtccaatatcggatcttatcctgtcaactgtagtcgggactccgagcaccgcccccgatcctatctagtnactactaatcagccggaccctcgacggggtccctgcccccgtattcctcgtggcctaccgaagttccgacggacaactaccgagtccttaccgcggaccctattccttgaactctaccagtctagaggatgagactggacttaactntgtnacacgacgagtaggagagacgacgacgggacggtacggtgggtcggtacgggtacgggtacggtaacgtaaggtacgtaaccgtacgtacgtacgacgaccgacgacgtccg

SEQ ID NO: 326998 - DNA, 627 bp, Homo sapiens
  misc_feature: GZ8MTXP02JFT62.44.39.D06.1.454.CMB.2.raw
  modified_base (191)..(191): a, c, t, g, unknown or other
  misc_feature (191)..(191): n is a, c, g, or t
  modified_base (199)..(199): a, c, t, g, unknown or other
  misc_feature (199)..(199): n is a, c, g, or t
  modified_base (226)..(226): a, c, t, g, unknown or other
  misc_feature (226)..(226): n is a, c, g, or t
  modified_base (239)..(239): a, c, t, g, unknown or other
  misc_feature (239)..(239): n is a, c, g, or t
  modified_base (366)..(366): a, c, t, g, unknown or other
  misc_feature (366)..(366): n is a, c, g, or t
  modified_base (422)..(422): a, c, t, g, unknown or other
  misc_feature (422)..(422): n is a, c, g, or t
tcagacagtatatacacgaccggtgctcgatttagtgacatctcgcagttctttggggggggtcacaagaggcagcgctctcgggacgtctccaccatggcctgggctctgctgctcctcactctcctcacccaggacacagggtcctgggcccagtctgccctgactcagcctgcctcgtgtctgggtcncctggacnggtcggtcaccatctctgcactggacnccaggtcgtaatnttcttagtcttaactttgtctcctggtactacaactatcataccaacggtaaaccacccccaaatcatacatctatgacgtactaataacgacgtcctacggtagggttactaactcccgtcttacnctacgcctacgacgtccgacacgacgtccctccgagtacatcctcgtcgggtcccncgtaggtcgtaggacggacggtacgtacgttattagtttattcgttagtctacgtagtagttagttcgttacgtcgtactacttacgttacgtttcgtcggtttacggtacgggtacggttaccggaacgttaccggtaccgtaccggtaccgtacgtaaccgtacccggacccgaacccgtaccctacccgtacttaccgtacc

SEQ ID NO: 326999 - DNA, 655 bp, Homo sapiens
  misc_feature: GZ8MTXP02ITB50.44.39.D06.1.454.CMB.2.raw
  modified_base (191)..(191): a, c, t, g, unknown or other
  misc_feature (191)..(191): n is a, c, g, or t
  modified_base (199)..(199): a, c, t, g, unknown or other
  misc_feature (199)..(199): n is a, c, g, or t
  modified_base (225)..(225): a, c, t, g, unknown or other
  misc_feature (225)..(225): n is a, c, g, or t
  modified_base (266)..(266): a, c, t, g, unknown or other
  misc_feature (266)..(266): n is a, c, g, or t
tcagacagtatatacacgaccggtgctcgatttagtgacatctcgcagttctttggggggggtcacaagaggcagcgctctcgggacgtctccaccatggcctgggctctgctgctcctcactctcctcacccaggacacagggtcctgggcccagtctgccctgactcagcctgcctcgtgtctgggtcncctggacngtcgtcaccatctcctgcactggacnccagcgtaatattcttagtcttaattgtctctgtatacacntcactccaacgtaacaccccaatcatacatctatgagactaagtacgacgcctacgtaggttactacgtccgtacttcacgtcgacctaccgtaacgcccggtacaaccgtacccggtcccttacccacgtaaacctacttccgtcgtcggtcctaccgacggtacgtacggaacgggacggacggtacgttagtaacgttttagtttagtttggttacgtctacgtagttacgttgttccgtcgtactaacgttcttaacgtttacgttacggttacgtttaacgggaagggttaccggtaaaccggttacggttaccgtaaccgttacgttacgtaacccgacggtaacccgaaccggtacccctaaaccctcgttaccgttaaccc

SEQ ID NO: 327000 - DNA, 803 bp, Homo sapiens
  misc_feature: GZ8MTXP02I9ZPA.44.39.D06.1.454.CMB.2.raw
  modified_base (208)..(208): a, c, t, g, unknown or other
  misc_feature (208)..(208): n is a, c, g, or t
  modified_base (213)..(213): a, c, t, g, unknown or other
  misc_feature (213)..(213): n is a, c, g, or t
tcagacagtatatacacgaccggtgctcgatttagtgacatctcgcagttctttggggggggtcacaagaggcagcgctctcgggacgtctccaccatggcctgggctctgctgctcctcactctcctcactcaggacacagggtcctgggcccagtctgccctgactcagcctgcctcgtgtctggttctcgtgacagtcgatcacntctcngcacgtggtccagcaatgactagttaggatattataacctgtactctagtatacaaacaactactaccgaaggaccaaaaccgacccccaaaacttactaacttttaccttttagacgttacccgtaaggttacggaccggtccgggtacccgtaggttacggtttaccggttttacctaacgttccgttcctttccgttcgttaccggtcccttacccgtaagttcccggttaccggaccccaaccggtcccccggtccccctttacccgtcgttcccgtacgttccgttccggttacccggggtcccgtacccggggtccgttacggggaaccgggtaccggtaacgggtccgttaacgtttaaccgttaacgtttaccggtacggtcccggtactttaacccttaacggtttaaccctaaccggtttagttacggttaaaccgggtttgggtttcggggtttccggggttaccgggggtcggggtaacgggtaccctaccggtaaacccgttcggtaccccggttaccgtaacgggttccgaacccggtaccggtaacggtcccctccccggtaccccgtttcccgg

SEQ ID NO: 327001 - DNA, 613 bp, Homo sapiens
  misc_feature: GZ8MTXP02HRNB7.44.39.D06.1.454.CMB.2.raw
  modified_base (225)..(225): a, c, t, g, unknown or other
  misc_feature (225)..(225): n is a, c, g, or t
  modified_base (281)..(281): a, c, t, g, unknown or other
  misc_feature (281)..(281): n is a, c, g, or t
  modified_base (404)..(404): a, c, t, g, unknown or other
  misc_feature (404)..(404): n is a, c, g, or t
  modified_base (411)..(411): a, c, t, g, unknown or other
  misc_feature (411)..(411): n is a, c, g, or t
  modified_base (464)..(464): a, c, t, g, unknown or other
  misc_feature (464)..(464): n is a, c, g, or t
  modified_base (472)..(472): a, c, t, g, unknown or other
  misc_feature (472)..(472): n is a, c, g, or t
  modified_base (477)..(477): a, c, t, g, unknown or other
  misc_feature (477)..(477): n is a, c, g, or t
tcagacagtatatacacgaccggtgctcgatttagtgacatctcgcagttctttggggggggtcacaagaggcagcgctctcgggacgtctccaccatggcctgggctctgctgctcctcactctcctcacccaggacacagggtcctgggcccagtctgccctgactcagcctgcctccgtgtctggtcgcctggacagtcggtcaccatctcctgcactgganccagcgtaatattcttagtcttaattgtctcctgtatcaacatcatcgaagtaaancccccaaatcaactcatactatagacggaccttaagtaagacggtcctacgtaggggtttcaaatcccgctttcacttcgcctaccagtccgacaaacaccggtccctccctagacctaaacnctaccgnggcctacgaaggctcggaaggaccgaaggctagtaatttagtttacttggttntacgttanagttnttcgtcgtctactctacttaacgttagtcgttacggttacgggaagttacgggaaacgttaaacggtaccgtacccgttacggtaccggtaacgacccgaacccgaccggaacccctaaccccgtacgttcgtacc

SEQ ID NO: 327002 - DNA, 624 bp, Homo sapiens
  misc_feature: GZ8MTXP02G9MEL.44.39.D06.1.454.CMB.2.raw
tcagacagtatatacacgaccggtgctcgatttagtgacatctcgcagttctttgggggaggaactgctcagttaggacccagagggaaccatggaagccccagctcagcttctcttcctcctgctactctggctcccagattccaccggcgaaattgtgttgacacaatctccagccaccctgtctttgtctccgggggaacagccaccctctcttgcagggccgcagactgttgacgacgacttagcctggtaccaacagaagcctggccaggctccagacctcctcatctatcgaattacttctaaggtacgggcctgtggccactccccgacgtccccgtcttcgaggtcggcacggtggggtaccgtggggacctaggtaccttcaccgtctccaacctactccaacccagccctagacgccgtacgaagtatttgacttagtttattactgtactacgtaaccgtaagaacgtcggacctacgtattaacttccgtacgtttcggacccgtagggtaacctaaaggtgtaataacgaaccgtaaacggtaacttggtacggcttacggacctaaccgtaagttcttacgttccttaccgtactttcccgtacccgtac

SEQ ID NO: 327003 - DNA, 776 bp, Homo sapiens
  misc_feature: GZ8MTXP02JW4IS.44.39.D06.1.454.CMB.2.raw
tcagacagtatatacacgaccggtgctcgatttagtgacatctcgcagttctttgggggggggtcacaagaggcagcgctctcgggacgtctccaccatggcctgggctctgctgctcctcactctcctcacccaggacacgagggtcctgggcccagtctcgcctgactcagcctcgcctccgtgtcgtgggtccgccgtaggacgtaggtccggtaccacctactcctcctgcctacggtgggacgcccgaaggtacggttaaattatttactttagttacctttaactttcgtcctcgttggtactacaacatcactacgaacggtaacgacccctaaactctactactatactactacggagtacctaagtaaacggccggtaccgttacggtaggggtttacttaacgtccctacgttactacgtctacctaccgtacgtcccgacgaaccgaccggtccctacctacgaacctaacgtcgttcgtcggccctcggacggtcgtaacggacggacggtacgggtactaggttactttaaagtttagttcggttacgtagtaccgttaagttacgtttcggttccggttaccgaacgttcgttaaacgtttcctttaacggtttactttaccgggtaacggggtaacgggttacccgggtaaaccggtaaccgggttaccgttaaaccggtccggtttaaaccgggtaaccgtaaaccccgtaaaccccgggaccggaaaccccttaaaccccggactcccggtttaacccg

SEQ ID NO: 327004 - DNA, 684 bp, Homo sapiens
  misc_feature: GZ8MTXP02IQ3BI.44.39.D06.1.454.CMB.2.raw
  modified_base (203)..(203): a, c, t, g, unknown or other
  misc_feature (203)..(203): n is a, c, g, or t
  modified_base (281)..(281): a, c, t, g, unknown or other
  misc_feature (281)..(281): n is a, c, g, or t
  modified_base (621)..(621): a, c, t, g, unknown or other
  misc_feature (621)..(621): n is a, c, g, or t
  modified_base (665)..(665): a, c, t, g, unknown or other
  misc_feature (665)..(665): n is a, c, g, or t
tcagacagtatatacacgaccggtgctcgatttagtgacatctcgcagttctttgggggaggaactgctcagttaggacccagagggaaccatggaagccccagctcagcttctcttcctcctgctactctggctcccagagatcaccggagatattgtgttgacacagtctccaggcaccctgtctttgcctccgagggganagacgcccacccttctccgtggtacgggccctaggtcggagtcgttagacttaagtcctaggtcctaggtaaccaaancgaaacgtggccaggcctccgagctcctcatcctatgatcgcactaccaaacgtcgggtacacgtggaccccacccgaagacgtacggtttcaggtcggacctagggttcgggtacgttacggggactggtacctaccgtaaccgtcctacgaccgttacgagtaaccaaagttccgaaactcggtacccgttaagtaaagtacgttttacggtacctttaaagtttacgttacgttagttaccaaggttacccgagttcccgtttcccaaaccggtcgtcccgtattacccgttacggggtttccgggggaaccgggggtaccaaggggtcggtaacgngttacggaagtaaacgtccgttagggccgtaactgaccgacttntccggtcttactactcccg

SEQ ID NO: 327005 - DNA, 593 bp, Homo sapiens
  misc_feature: GZ8MTXP01DIUI8.45.83.H06.1.454.CMB.2.raw
tcagacgcgatcgacacgaccggtgctcgatttagatcacgtgcgtcgcgggggagagaggagcccagccctgggattttcaggtgttttcatttggtgatcaggactgaacagagagaactcaccatggagtttgggctgacctggctttttcttgtggctattttcaaaggtgtccagtgtgagatgcagttattggagtctgggggtgccttgggtccgacccgggggggtctctgagactctcctgtgctaattctggattcacctccaccacctatcccatgagctgggtccgccagccgccggggaagggccggaatggggtcgcagcaataactggtgagtggtggaagttccttcctacgcagacctccggtaggacggggccggttcaccatctacccagacgacaattcgaagagtatgttagtatctaacaaatgaaacacgtagaaagtcggaaggacactcgccgttctatttctgtgacgtaaacgttcccgaaccctaataggttgggtcttcgttatcttacgttgttaccctttttaattacgtttggtatgggttacgttcgttggggtaacccg

SEQ ID NO: 327006 - DNA, 486 bp, Homo sapiens
  misc_feature: GZ8MTXP01A2IZV.45.83.H06.1.454.CMB.2.raw
  modified_base (176)..(176): a, c, t, g, unknown or other
  misc_feature (176)..(176): n is a, c, g, or t
  modified_base (197)..(197): a, c, t, g, unknown or other
  misc_feature (197)..(197): n is a, c, g, or t
  modified_base (295)..(295): a, c, t, g, unknown or other
  misc_feature (295)..(295): n is a, c, g, or t
  modified_base (310)..(310): a, c, t, g, unknown or other
  misc_feature (310)..(310): n is a, c, g, or t
  modified_base (366)..(366): a, c, t, g, unknown or other
  misc_feature (366)..(366): n is a, c, g, or t
  modified_base (376)..(376): a, c, t, g, unknown or other
  misc_feature (376)..(376): n is a, c, g, or t
  modified_base (383)..(383): a, c, t, g, unknown or other
  misc_feature (383)..(383): n is a, c, g, or t
  modified_base (397)..(397): a, c, t, g, unknown or other
  misc_feature (397)..(397): n is a, c, g, or t
  modified_base (399)..(399): a, c, t, g, unknown or other
  misc_feature (399)..(399): n is a, c, g, or t
  modified_base (469)..(469): a, c, t, g, unknown or other
  misc_feature (469)..(469): n is a, c, g, or t
  modified_base (473)..(473): a, c, t, g, unknown or other
  misc_feature (473)..(473): n is a, c, g, or t
  modified_base (477)..(477): a, c, t, g, unknown or other
  misc_feature (477)..(477): n is a, c, g, or t
tcagacgcgatcgacacgaccggtgctcgatttagatcacgtgcgtcgcgggggagctgctcagttaggacccagagggaaccatggaaaccccagcgcagcttctcttcctcctgctactctggctcccagaaagtactggagagagtgtgttgacgcagtctccaggcaccctntctttgtctccaggggaaagngcaaccctctcctgcaggaccaccagagtgttaggagcaatcacttagcctggtaccagcagaaacctggccaggctccaaagctctcatctacggtncatccagtagggccntggcatcccagacaggttcagtggcaggtgggctgggacaagacttcactctcacntcacagtganctagatntttgctgtctattntntcatctgtgttcttctctttgtcgctttcgcctggtaccacgagtgaatcaaacgtattgtgcttgcacntctntctnatcttccgc

SEQ ID NO: 327007 - DNA, 617 bp, Homo sapiens
  misc_feature: GZ8MTXP01ESK9V.45.83.H06.1.454.CMB.2.raw
  modified_base (509)..(509): a, c, t, g, unknown or other
  misc_feature (509)..(509): n is a, c, g, or t
tcagacgcgatcgacacgaccggtgctcgatttagatcacgtgcgtcgcgggggagagaggagcccagccctgggattttcaggtgttttcatttggtgatcaggactgaacagagagaactcaccatggagtttgggctgacctggcttttcttgtggctattttcaaaggtgtccagtgtgagatgcagttattggagtcgtgggggtgccttgggtccgacccggggggtctctgagactctcctgtgcaatttctggattcacctccaccacctatcccatgagctgggtcccgccaggcccggccgggggaaggggcccggaagtcgggggtcgcgagcaaagtaacgtggtgagtggtaggaaacgtttccttcctacggcaggacctcccggtggacgggggccgttcaccatctaccagagactaattcgaagagtatgttgtaatctaacaaatgaacacgtagaaacgtcggggaagtacgacggcccgtatatttcgngtagaccgtaaacgttccccgaccttagaacgtgggcttcttaagtcctaacgttgttccttttttataacgtttggaattgggaccgttcgtcggggcctaacgggg

SEQ ID NO: 327008 - DNA, 631 bp, Homo sapiens
  misc_feature: GZ8MTXP01BML59.45.83.H06.1.454.CMB.2.raw
  modified_base (262)..(262): a, c, t, g, unknown or other
  misc_feature (262)..(262): n is a, c, g, or t
  modified_base (548)..(548): a, c, t, g, unknown or other
  misc_feature (548)..(548): n is a, c, g, or t
tcagacgcgatcgacacgaccggtgctcgatttagatcacgtgcgtcgcgggggagagaggagcccagccctgggattttcaggtgttttcatttggtgatcaggactgaacagagagaactcaccatggagtttgggctgacctggctttttcttgtggctattttcaaaggtgtccagtgtgagatgcagttattggagtcgtgggggtgccttgggtccgacccggggggtctcgtgagactctcctgtgctaatttcnggattcacctccaccacctactcccatgagctcgggtcccgccgacggcccggccgggggaaacggggcccggaagtgggggtcgcgaagcaaataacgtgggtagagttgggtaggaacgtttccttcgtacgcagaccgtccggtagggacgggggtcccgttcacccatcctaccgagacgacaagttcgaagtagtatgttagtatactaacaaatgaacacgtagaaacgtcggaggacgaccggcgtctattcgtgtcgacgtaaacgttcccgaacctntaaggtcgggttcttcgttatcctacgttgttcctttttattcgtttggtaacttgggacgttcggtggggcccgtaacgggg

SEQ ID NO: 327009 - DNA, 532 bp, Homo sapiens
  misc_feature: GZ8MTXP01EZKMU.45.83.H06.1.454.CMB.2.raw
  modified_base (176)..(176): a, c, t, g, unknown or other
  misc_feature (176)..(176): n is a, c, g, or t
  modified_base (312)..(312): a, c, t, g, unknown or other
  misc_feature (312)..(312): n is a, c, g, or t
  modified_base (381)..(381): a, c, t, g, unknown or other
  misc_feature (381)..(381): n is a, c, g, or t
tcagacgcgatcgacacgaccggtgctcgatttagatcacgtgcgtcgcgggggagctgctcagttaggacccagagggaaccatggaaaccccagcgcagcttctcttcctcctgctactctggctcccagaaagtactggagagagtgtgttgacgcagtctccaggcaccctntctttgtctccgaggggaaagagcaaccctctcctgcaggaccaccagagtgttaggagcaatcacttagcctggtaccagcagaaacctggccaggctcaaagctcctcatctacggtgcatccaggtagggccntggcatcccagacaggttcagtggccaggtgggtctgggacaagacttcactctcacatcacaagtganctagagtatttgctgtactattattgtacaaacttctagttcggttcgtttcttccgtttgttcgtcgttttccggcccttgggaccctagtaggtaggaaaatcaaaacgacttggtagcttgcacctaatctgtctcattccttccgcc

SEQ ID NO: 327010 - DNA, 609 bp, Homo sapiens
  misc_feature: GZ8MTXP01AWI18.45.83.H06.1.454.CMB.2.raw
  modified_base (457)..(457): a, c, t, g, unknown or other
  misc_feature (457)..(457): n is a, c, g, or t
tcagacgcgatcgacacgaccggtgctcgatttagatcacgtgcgtcgcgggggagagaggagcccagccctgggattttcaggtgttttcatttggtgatcaggactgaacagagagaactcaccatggagtttgggctgacctggctttttcttgtggctattttcaaaggtgtccagtgtgagatgcagttattggagtcgtgggggtgccgttgggtccgacccggggggtctcgtgagactctcctgtgctaatttctggattcacctccaccacctatccccatgagctcgggtcccgccaggcccggacccgggggaagggggcccggaagtcgggggtcgcgagacaaataacgtggtgagtggtggaagttccttctacgcagactccggtggagggccggttcaccatcctcagacgacaattcgaagagtatgttgtaatactaanaaagtgaacaaccgtagaaagtcgggaaggaccgaccggtccgtctatttcgtagtgacgtaaacgttcccgaacctgtaagtgggcttcttagtctacgttgttctttttataacgtttgtaacgtgggacgttcgtcggggcctaacggg

SEQ ID NO: 327011 - DNA, 749 bp, Homo sapiens
  misc_feature: GZ8MTXP01A7QLF.45.83.H06.1.454.CMB.2.raw
  modified_base (257)..(257): a, c, t, g, unknown or other
  misc_feature (257)..(257): n is a, c, g, or t
tcagacgcgatcgacacgaccggtgctcgatttagatcacgtgcgtcgcgggggagagaggagcccagccctgggattttcaggtgttttcatttggtgatcaggactgaacagagagaactcaccatggagtttgggctgacctggcttttcttgtggctatttcaaaggtgtccagtgtgagatgcagttattggagtcgtgggggtgccgttggtccgaccggggggtctctgagactctcctgtgctaattcnggattcacctccaccacctactcccatgagcgtgggtcccgccgacggcccggaccggggggaaaggggcccgggaaagtcgggggtccgcgaaggacaaagtaacgtgggtagagttggggtaggtaaacgtttcccttacgtaaccggcaacggtaccgtcccggtaagggaaccggggggtcccggttacaacccgtacttcccgtacccgaaggaacgtaaacctaaagtttccggaaagtagttattggttagtaactcttaaacaaagtcgaaaccaccggtagaaacgtcgggaaggtaccacggtccgttattaagttccgtagtacgaccggtaaaacgttccccgaacccttagtaacggtgggaccttacgttacgtaccgtacgggttcgtttcctttttttaaacgttaaccggttttggggtaactttcgggggtaccggttcccgggttcggggggaaccccgttaaacccgggggg

SEQ ID NO: 327012 - DNA, 869 bp, Homo sapiens
  misc_feature: GZ8MTXP01DJ09H.45.83.H06.1.454.CMB.2.raw
tcagacgcgatcgacacgaccggtgctcgatttagatcacgtgcgtcgcgggggagataggagcccagccctgggattttcaggtgttttcatttggtgatcaggactgaacagagagaactcaccatggagtttgggctgacctggctttttcttgtggctattttcaaaggtgtccagtgtgagatgcagttattggagtcgtgggggtgccgttgggtccgacccgggggggtctcgtgagactctcctgtgctaattctggattcacctccaccacctatcccatgacgcgtcgggtcccgccgacggcccgggaccgggggaaagggggccccgggaagtcgggggtcgacagaccaaagtaacgtgggtagagttggggtagggtaaacgtttcccctttaccgtaccggcgaacggtacccgttccccgggttaagggaaccggggggttccccggtttacgaaacccctaaagttccccgtaccccgaaagggaacggtaaaccctaaagttttacccggaaaaggtaacggttaagtttaggttttaggttaaactttaccgttaaaacaaaacgttaacggaaaacccgtaacccgggtaaggtaaaaacgggttaccgggggaacggggtaaacccgtaaccggggtccccggtttacttaacttttccgtaggttacggaaccggttaaaaccggttccccccgtaaacccttagttaacgggttcggggttacctttacgtttactaccgttaaccgggttttcgtttcccttttttttaaacgttccgtttttaggggtaatttcgggggtaccggtttccggtaacggggggttaaccccgtaaaaccgggggg

SEQ ID NO: 327013 - DNA, 798 bp, Homo sapiens
  misc_feature: GZ8MTXP01CPQQ3.45.83.H06.1.454.CMB.2.raw
tcagacgcgatcgacacgaccggtgctcgatttagatcacgtgcgtcgcgggggagagaggagcccagccctgggattttcaggtgttttcatttggtgatcaggactgaacagagagaactcaccatggagtttgggctgacctggtctttttcttgtggctattttcaaaggtgtccagtgtgagatgctagttattggagtcgtgggggtgtccgttgggtccgacccggggggtctcgtgagactctcctgtgctaattctggattccacctcccaccacctactcccatgacgcgtcgggtcccgccgacggcccgggaccgggggaacggggcccgggaagtcggggtcgcgaagaccaaagtaacgtgggtagagttgggtacggtaacgtttcctaccgtacgcagaccgtccggtgggacggggtcccgttacacctacgtcctcgaagacgaactaagttacgaaagtagttagtagtttagtaacttacgtaaactaaagtacggaaaccgtaaccggttaagaaaacgggttaccgggggaaaacggggtaaccccggtaaacccgggttcccggtttacctttaacgttttaccggttacggttaccggaacccggttaaaacccggttcccccgtaaacccgttaaggtaacgggttcggggttacctttacgtttaacgtaccttaacgggtttccttttacccgttttttaagtttaacggttttagggttaacgtttacgggggtacggttaccgggtcgggggaacccggtaaccggggg

SEQ ID NO: 327014 - DNA, 527 bp, Homo sapiens
  misc_feature: GZ8MTXP01DC1ZV.45.83.H06.1.454.CMB.2.raw
  modified_base (176)..(176): a, c, t, g, unknown or other
  misc_feature (176)..(176): n is a, c, g, or t
  modified_base (196)..(196): a, c, t, g, unknown or other
  misc_feature (196)..(196): n is a, c, g, or t
  modified_base (295)..(295): a, c, t, g, unknown or other
  misc_feature (295)..(295): n is a, c, g, or t
  modified_base (310)..(310): a, c, t, g, unknown or other
  misc_feature (310)..(310): n is a, c, g, or t
  modified_base (382)..(382): a, c, t, g, unknown or other
  misc_feature (382)..(382): n is a, c, g, or t
  modified_base (402)..(402): a, c, t, g, unknown or other
  misc_feature (402)..(402): n is a, c, g, or t
tcagacgcgatcgacacgaccggtgctcgatttagatcacgtgcgtcgcgggggagctgctcagttaggacccagagggaaccatggaaaccccagcgcagcttctcttcctcctgctactctggctcccagaaagtactggagagagtgtgttgacgcagtctccaggcaccctntctttgtctccaggggaaangcaacctctcctgcaggaccaccagagtgttaggagcaaatcacttagcctggtaccagcagaaacctggccaggctccaaagctcctcatctacggtncatccagtagggccntggcactcccagacaggttcagtcggccaggtgggtctggggacaagacttcactctcacatcacaagtganctgatatttgatgtctattnttgtctaatctagtcggttcgttcttcgtttgttcgtcgtttccggcctgggtaccctacgacgtggtaaatcgaaacgtacttgtcggtcttcgcacctaatctgtctcttactcgttcccgtc

SEQ ID NO: 327015 - DNA, 612 bp, Homo sapiens
  misc_feature: GZ8MTXP01D636U.45.83.H06.1.454.CMB.2.raw
  modified_base (505)..(505): a, c, t, g, unknown or other
  misc_feature (505)..(505): n is a, c, g, or t
  modified_base (511)..(511): a, c, t, g, unknown or other
  misc_feature (511)..(511): n is a, c, g, or t
  modified_base (551)..(551): a, c, t, g, unknown or other
  misc_feature (551)..(551): n is a, c, g, or t
tcagacgcgatcgacacgaccggtgctcgatttagatcacgtgcgtcgcgggggagagaggagcccagccctgggattttcaggtgttttcatttggtgatcaggactgaacagagagaactcaccatggagtttgggctgacctggtctttttcttgtggctattttcaaaggtgtccagtgtgagatgcagttattggagtcgtgggggtgccgttggtccgaccgggggtctcgtgagactctcctgtgctaattctggtattcacctccaccacctatcccatgagcgtcgggtccgccaggcccggccgggggaaaggggccggaagtggggtcgcgagcaaataacgtggtgattgggtagaagttcctaccgtacgcagactcccggtagggacggggtcccgttcaaccagttccaccaggacgacaatttcgaaagtatagtgttagtaatctaaacaaatcgaaacacgtagaaagtcggaggacacgggtcgtntattcngtcgactaaacgttccccacctaatggtcggttctcttancgtaacgttgttcctttttatcgtttggtaatgggtacttcggtcgggccgtaaaccgggg

SEQ ID NO: 327016 - DNA, 796 bp, Homo sapiens
  misc_feature: GZ8MTXP01C5IRD.45.83.H06.1.454.CMB.2.raw
tcagacgcgatcgacacgaccggtgctcgatttagatcacgtgcgtcgcgggggagagaggagcccagccctgggattttcaggtgttttcatttggtgatcaggactgaacagagagaactcaccatggagtttgggctgacctggtctttttcttgtggcttattttcaaaggtgtccagtgtgagatgctagttattggagtcgtgggggtgtccgttgggtcccggacccggggggtctcgtgagactctcctgtgctaattctgtacttccacctccacctacctactcccatgacgtcgtcgggtcccgccgacggcccgggaccgggggaacggggccggaagtcgggggtccgacgagacaaagtaacgtgggtagtagttgggtacggtaacgtttccttaccgtacggacgtacggtaccgtcccggtaaggggaccgggggtcccggttaccaacccgtacttcccgtaccgaaggtaacgaaactaagtttaccggaaaaggttagttaagtttggtttaagtaaattacctaaacgaaacgttacgaaaacccgaccgggttaaagaaaaccgggttcggggaaacgggtacgtaacccgggtcccgttaactttacgtttcgtcggtaacgtaccgtaaaccggttcccccgtaaaccgttaggtaacggtcgggttacctttacgttacgtaccgtcggtttctttaccttttttaagttaaccgtttgggtaacgttcgggggtaccgtttcgggtccgggggttaacccgtaaccgggg

SEQ ID NO: 327017 - DNA, 797 bp, Homo sapiens
  misc_feature: GZ8MTXP01EKO1D.45.83.H06.1.454.CMB.2.raw
  modified_base (213)..(213): a, c, t, g, unknown or other
  misc_feature (213)..(213): n is a, c, g, or t
tcagacgcgatcgacacgaccggtgctcgatttagatcacgtgcgtcgcgggggagagaggagcccagccctgggattttcaggtgttttcatttggtgatcaggactgaacagagagaactcaccatggagtttgggctgacctggtctttttcttgtggctattttcaaaggtgtccagtgtgagatgcagttattggagtcgtgggggtnccgttggtccgaccggggggtctctgagactctcctgtgctaattctggtacttcacctcccaccacctactcccatgagcgtcgggtcccgccgacggcccgggaccgggggaacggggccggaagtggggtccgacgagacaaataacgtggtagagttggtacggtaacgttccttacccgtacggacgacggtaccgtcccggtacgggaaccgggggtcccgggtttaccaacccgtaacttcccgtaccgaaggaacggtaaacctaaagttacggaaaaggagtttaagtggtttagttaactaccttaaaacaaagttacgaaaacccgtaaccggttaaagaaacggtaccgggggaaacgggtaacccgtaaccggggtccccgtttaattacgtttccgtagggttaaccggtaaccggtaaaaccggttttacccccgaacccgtttaaaggtcgggttcgggttaccttacgttttaaacgtccgttaacgttcgttttacccttttttaaagttcggtttgggttaacgtgggtaccgttcggggtccggggttaaccgtaaaccggggg

SEQ ID NO: 327018 - DNA, 886 bp, Homo sapiens
  misc_feature: GZ8MTXP01D32R9.45.83.H06.1.454.CMB.2.raw
  modified_base (312)..(312): a, c, t, g, unknown or other
  misc_feature (312)..(312): n is a, c, g, or t
tcagacgcgatcgacacgaccggtgctcgatttagatcacgtgcgtcgcgggggagagaggagcccagccctgggattttcaggtgttttcatttggtgatcaggactgaacagagagaactcaccatggagtttgggctgacctggtctttttcttgtggctattttcaaaggtgtccagtgtgagatgctagttattggagtcgtgggggtgtccgttgggtcccggacccggggggtctcgtgagactctcctgtgctaattctggtacttcacctccaccacctactcccatgacgcgtcgggtcccnccgacggcccgggaccggggggaaacggggcccgggtaaagtcgggggtccgacgaaggtaccaaagttaaaccgtggggtagtaggttgggttacgggtaaacgtttcccttaccgaccggacgtaggtacccgttcccgggtacggggaacgggggtccccggggtttaccaaacccgtacgttccccgtaccccgaagggtaaacggtaaaccctaaagtttacccggaaaaggttaacggttaagtttaggtttaacggtttaaacgttaacccgttaaaacctaaaagttaaccgggaaaaaccccgtaacccgggttaaaagggtaaaacgggttaccggggggaaacggggtaaacccgtaaccggggtaccccgtttagttaaacgttttccgaggtttacggaaaccggttaaaccggttcccccgtaaacccgttagtaacggttcggggttcctttacctttagttaccgtaacggtttcgttttacccttttttaagttaacggttttagggtaacgttcggggtaccgttcgggttaacggggaacccgtaaacccggggg

SEQ ID NO: 327019 - DNA, 715 bp, Homo sapiens
  misc_feature: GZ8MTXP01DQBKG.45.83.H06.1.454.CMB.2.raw
tcagacgcgatcgacacgaccggtgctcgatttagatcacgtgcgtcgcgggggagctgctcagttaggacccagagggaaccatggaaaccccagcgcagcttctcttcctcctgctactctggctcccagaaagtactggagagagtgtgttgacgcagtctccaggcaccctctctttgtctccaggggaaagagcaaccctctcctgcaggaccaccagagtgttaggagcaatcacttagcctaggtaccagcacgaaacctggccaggctacaaacgctacctcatctacggtgacatccgaggtacgggccgctggactaccgtaccccgaggtacctacgggtttacgaggttcggggacccgtaggggttcgggggtcgtacggggggaacctaaacgggtacccttttccgacctttccctaacccaaccccgtaacttacccgaaacccggttaaaggggtttacgggacgtacccgttagggtaaaacggtttattttttacggctttaggtttactttaatttaacgtttacgtacctaaactttccgttaagggtttcggtttccgtttcctttccgttttgttccggttctttccggtccgtacgggaccttacgagttacggtaaaataccggaaacgtacgttcggtacggtcttacggcttaactgttactcgttcttacttcttccccttcccgtc

SEQ ID NO: 327020 - DNA, 841 bp, Homo sapiens
  misc_feature: GZ8MTXP01A083R.45.83.H06.1.454.CMB.2.raw
tcagacgcgatcgacacgaccggtgctcgatttagatcacgtgcgtcgcgggggagagaggagcccagccctgggattttcaggtgttttcatttggtgatcaggactgaacagagagaactcaccatggagtttgggctgacctggtctttttcttgtggctattttcaaaggtgtccagtgtgagatgcagttatggagtcgtggggtgccgttggtccgaccggggggtctcgtgagactctcctgtgctaattctgacttcacctccaccacctactcccatcgagcgtcgggtcccgccgacggcccgggaccgggggaaacggggcccggaagtcggggtccgacgagactaaagttaacgtgggtagaggttgggtaggtaaacgtttcccgttaccgtacggacgaggtaccgttcccgggtagggaccgggggtcccgggtttaccaaaccccgtagttacccgtacccgaagggtaaacgaaacccgtaaagttaccgggaaaaggtacggtttaagttaggtttaggttaaacttaccgtaaaactaaaacgttcggaaaaaaccccgtaccgggttaaaggtaaaaaccgggttccgggggaaaacggggtaacccggtaaacccggggtccgtttaacctttaaacgtttccgtacgggttacgggtaacccggttaaaaaccgggttttccccccggaaacccgtttaagtaacgggtcgggttacctttacgtttaactccgttaacggttcttttaccgtttttaattcggttttaggtaacgttcggggtacgttccggtcgggggttaaccctaaaccggggg

SEQ ID NO: 327021 - DNA, 933 bp, Homo sapiens
  misc_feature: GZ8MTXP01CL2BN.45.83.H06.1.454.CMB.2.raw
tcagacgcgatcgacacgaccggtgctcgatttagatcacgtgcgtcgcgggggagagaggagcccagccctgggattttcaggtgttttcatttggtgatcaggactgaacagagagaactcaccatggagtttgggctgacctggtctttttcttgtggctattttcaaaggtgtccagtgtgagatgctagttattggagtcgtgggggtgccgttgggtccgacccggggggtctcgtgagactctcctgtgctaattctggattcacctccaccacctactcccatgacgcgtcgggtcccgccgacggcccgggaccggggggaaacgggggcccgggaaagtcgggggtccgacgaaggaccgtaaaagtaaaccgttgggtagtagttcgggtacggtaaacgtttcccgtttaccgtaccggacgacggtaacccgttcccgggttaacgggaaccgggggtccccgggtttaccaaacccgtaaacgttaccccgtaacccgaaaggaaacggtaaacctaaaacgttttaccggaaaaaggttaaggtttaaacgtttagggttttaacggttaaaactttaccccttaaaaaacgtaaaaaaggtttacggaaaaaacccccgtaaacccggggtttaaagggaaaaaaaccgggtttacccggggggaaaacggggttaaaccccggtaaccccgggggtaccccttttaactttaaacgttttttcccggaagggtttaaaccgggaaacccgggtttaaaaaacccggttttccccccgaaacccgtttaaggttaaccggggtcgggttacccttttaacgttacttaccggtacgtttcgtttcccttttttaagttaaccgtttaggtaagttcggggaacgttcgggtaacgggggttaacccgtaaaccgggg

SEQ ID NO: 327022 - DNA, 823 bp, Homo sapiens
  misc_feature: GZ8MTXP01AQGU8.45.83.H06.1.454.CMB.2.raw
  modified_base (265)..(265): a, c, t, g, unknown or other
  misc_feature (265)..(265): n is a, c, g, or t
tcagacgcgatcgacacgaccggtgctcgatttagatcacgtgcgtcgcgggggagagaggagcccagccctgggattttcaggtgttttcatttggtgatcaggactgaacagagagaactcaccatggagtttgggctgacctggtctttttcttgtggctattttcaaaggtgtccagtgtgagatgctagttattggagtcgtgggggtgtccgttgggtcccgacccggggggtctcgtgagactctcctgtgctattcnggtacttccacctcccaccacctactcccatcgagtcgtcgggtcccgccgacggcccgggacccgggggaaggggcccggaagtcggggtcgcgaagacaaagtaacgtgggtagagttgggtaggtaacgtttccgttaccgtacgcgaggtacccgtccgggtacgggaccgggggtcccgttaccaacccgttacgtcccgtacgaacgggaacgtaactaaagttacggaaaggttagttaagttaggtttagtaaacttacgtaaacgtaaaacgttacggaaaaccccgtaacccgggttaagggaaaaccggttaccggggggaaacggggtaacccggtaaccggggttaccccgtttacgttaacgttttcccggtagggttaccgtaaacccgggttaaaaccggtttcccccgtaaacccttaggttaacgggtcgggttaacctttctttacgtccgttaacgtttacgtttcccttttttaagtttaaccgtttgggtaacgttcggggtaccggttcggttcgggggaacccgttaaccgggg

SEQ ID NO: 327023 - DNA, 903 bp, Homo sapiens
  misc_feature: GZ8MTXP01D6RQ5.45.83.H06.1.454.CMB.2.raw
tcagacgcgatcgacacgaccggtgctcgatttagatcacgtgcgtcgcgggggagagaggagcccagccctgggattttcaggtgttttcatttggtgatcaggactgaacagagagaactcaccatggagtttgggctgacctggtctttttcttgtggcttattttcaaaggtgtccagtgtgagatgctagttattggagtcgtgggggtgtccgttggtccggacccggggggtctcgtgacgactctctgtgctaatttctggtacttccacctccacccacctactcccatcgacgcgtcgggtcccgccgacggccccgggaccggggggaaacggggcccgggtaaggtcgggggtccgacgtaagacctaaaagtaacggttagggtggtaggttgggttacggtaaacggtttccccttacccgtaccggcgtaacgtaaccgttcccggggtaaggggaaccgggggtcccggtttaccaaacccgttactaccccgtacccgaaagggtaacgtaaaccgtaaagtttaccgggaaaagttaggtttaatttagggttttaacgtaaacttaccgttaaaaccgtaaaagttaccggaaaaacccgtaacccgggttaaaggaaaaaccggttcccgggggaaaacggggtaaccccgtaaccgggggttacccctttacgtttaaacgttttcccggtaaggttacccgggtaaacccggttaaaacccggtttccccccgaaacccgtttaaggtaacgggtcgggttacctttaccgtttaactacccggttaacgtttccggttttacttttttaacgtttaaccggtttgggtaaccgttcggggtaccggttacggtccgggggttaacccgtaaacccggggg

SEQ ID NO: 327024 - DNA, 771 bp, Homo sapiens
  misc_feature: GZ8MTXP01BK7SY.45.83.H06.1.454.CMB.2.raw
tcagacgcgatcgacacgaccggtgctcgatttagatcacgtgcgtcgcgggggagagaggagcccagccctgggattttcaggtgttttcatttggtgatcaggactgaacagagagaactcaccatggagtttgggctgacctggctttttcttgtggctattttcaaaggtgtccagtgtgagatgcagttattggagtcgtggggtgccgttgggtccgacccggggggtctctgagactctcctgtgctaatttctggattcacctccaccacctactcccatgagcgtcgggtcccgccgacggcccgggaccgggggaaaggggcccgggaaagtcgggggtacgcgaggacctaaagtaaccgttgggtagtagttgggtacggtaaacggtttccccttaccgtacggacaacggtacccgttccccggtagggaacgggggtccccggtttaccaaacccgtacttccgtaccccgaaggaacgtaaacctaagtttacggaaaatagggttaattaggtttagtaattaccctaaataaaagtacgaaaacctaccgggtaagtaaacgggttacggggaaacgggtaaccgaaccggggtcccgttacttaagttttccgtaggttacgaaccgtaaaaccgtttccccgaaccttagtaacggtgggaccttcttatccgaacgtttcgtttccttttttaagtaaccgttttggtaagttcgggacgttcggtcgggggttaaccctaaaccggggg

SEQ ID NO: 327025 - DNA, 689 bp, Homo sapiens
  misc_feature: GZ8MTXP01BCY6W.45.83.H06.1.454.CMB.2.raw
  modified_base (608)..(608): a, c, t, g, unknown or other
  misc_feature (608)..(608): n is a, c, g, or t
tcagacgcgatcgacacgaccggtgctcgatttagatcacgtgcgtcgcgggggagagaggagcccagccctgggattttcaggtgttttcatttggtgatcaggactgaacagagagaactcaccatggagtttgggctgacctggctttttcttgtggctattttcaaaggtgtccagtgtgagatgcagttattggagtcgtgggggtgccgttgggtccgacccggggggtctcgtgagactctcctgtgctaattctggattcacctccaccacctatcccatgagcgtgggtccgccgaggcccggaccgggggaaggggcccggaaagtcggggtcgcgagacaagtaacgtgggtagagttgggtaggtaacgtttccttcctacggcagtacctccggtagggacgggggccgttacacccgatccgtaccgaaggacgaaactaagttacggaaagtagtaatggtttagtaacttacttaaacaaaattgaaaccgtaccggtaaggtaaacgtcggggaaggaccgaaccgggtccgttacttagtttctggtacgacgtaaacgttccccgacctagtaagtcggttctacgttntacgtaacgttgtttccctttttagtttccgtttaggtaacgttgggtaccgttccggtcggggttaacccgtaaacgggg

SEQ ID NO: 327026 - DNA, 806 bp, Homo sapiens
  misc_feature: GZ8MTXP01BEP0C.45.83.H06.1.454.CMB.2.raw
  modified_base (263)..(263): a, c, t, g, unknown or other
  misc_feature (263)..(263): n is a, c, g, or t
tcagacgcgatcgacacgaccggtgctcgatttagatcacgtgcgtcgcgggggagagaggagcccagccctgggattttcaggtgttttcatttggtgatcaggactgaacagagagaactcaccatggagtttgggctgacctggtctttttcttgtggcttattttcaaaggtgtccagtgtgagatgcagttattggagtcgtgggggtgccgttgggtccggacccggggggtctcgtgagactctctgtgctattcngacttcacctccaccacctactcccatgagcgtcgggtcccgccgacggccccgggaccggggggaaacggggcccgggaaaggtcgggggtaccgacgaaggacctaaagttaccgttggggtagtaggttgggtacggtaaacgttttcccttacgtaaccggacgtacggtacccgttcccgggtaaggggtaaccgggggtccccggtttaccaacccgtactccctaccgaaggaacgtaaacctaaagtttacggaaaggtagttagttacgtttagttaacgttaacctaaacaaagttacgaaaacccgtaaccgggttaaagtaaaaccggtcgggggaacggtaaaccggtaaccgggttccccgtttaagtttaaccgtttcgtacggttaaccggtaacccgttaaacccgtttcccccggaaaccctttaagggtaacggtcgggttcttacgttcgtaccgttaacgttcgttttccttttattaacggtttggtgtacgggtcgttcggtggggaacccgtaaccggg

SEQ ID NO: 327027 - DNA, 831 bp, Homo sapiens
  misc_feature: GZ8MTXP01AX63B.45.83.H06.1.454.CMB.2.raw
tcagacgcgatcgacacgaccggtgctcgatttagatcacgtgcgtcgcgggggagagaggagcccagccctgggattttcaggtgttttcatttggtgatcaggactgaacagagagaactcaccatggagtttgggctgacctggtctttttcttgtggctattttcaaaggtgtccagtgtgagatgctagttattggagtcgtgggggtcgtccgttgggtcccggacccggggggtctcgtgagactctcctgtgctaattctggtacttccacctccacctacctactcccatgacgtcgtcgggtcccgccgacggcccgggaccgggggaacggggccggaagtcgggggtacgacgacgacaaagtaacgtgggtacgagttgggtaggtaacgtttcccttccgtacggacgtacgtacccgtcccgggtaagggaccgggggttcccgttacaaacccgtacgttcccgtacccgaaggaacgtaaccctaaagtttaccggaaaggtagttagttcggtttagttaacttaaccttaaacgaaaagttacgaaaacccgtaaccgggttaagtaaaacgggtacgggggtaacggaaccgtaacccgggtccgttacttaacgtttccgtagggttaaccggtaccggttaaaacccggtttcccccgaaaccgtttaaggtaacgggtccgggttcctttaccgttagttaccccgttagggttttaccttttcccgtttttttaagttccggttttaggggtaacgtttcgggggtaccgttcggggtaaccgggggttaacccgtaaacccggggg

SEQ ID NO: 327028 - DNA, 777 bp, Homo sapiens
  misc_feature: GZ8MTXP01BKXHC.45.83.H06.1.454.CMB.2.raw
  modified_base (269)..(269): a, c, t, g, unknown or other
  misc_feature (269)..(269): n is a, c, g, or t
  modified_base (526)..(526): a, c, t, g, unknown or other
  misc_feature (526)..(526): n is a, c, g, or t
tcagacgcgatcgacacgaccggtgctcgatttagatcacgtgcgtcgcgggggagagaggagcccagccctgggattttcaggtgttttcatttggtgatcaggactgaacagagagaactcaccatggagtttgggctgacctggtctttttcttgtggcttattttcaaaggtgtccagtgtgagatgctagttattggagtcgtgggggtgccgttgggtcccggaccggggggtctcgtgagtactctcctgtgctaatttcgngtacttccaccctccacctacctactcccatcgacgcgtcgggtcccgccgacggccccgggaccgggggaacggggcccggaagtcggggtaccgcgagacgtaataacgtggtagagttggtagtacgttcctaccgtacgcgacgtaccgtccggtagggaccggggtccgttaccaaccgtactccgtaccgaaggaacgtaaacgtacgttacggaaaggtagttaagttggttaataacgttacctaaaanaaagttacgaaaccgtacggtaaaggaaacggttcggggaaacggggtaaccgtaaccggtcccggtttactttaacgtttccgttaggtaccggtaaaccggttaaacccggtttacccccgaacccgttaaaggttaacgggtcgggttcctttacgtttacgtaccgttacgtttccgttttacctttttagtttaaccgtttggtaacggttcggtacgggttcggtcggggttcccgtaaccgggg

SEQ ID NO: 327029 - DNA, 759 bp, Homo sapiens
  misc_feature: GZ8MTXP01D9BA0.45.83.H06.1.454.CMB.2.raw
tcagacgcgatcgacacgaccggtgctcgatttagatcacgtgcgtcgcgggggagagaggagcccagccctgggattttcaggtgttttcatttggtgatcaggactgaacagagagaactcaccatggagtttgggctgacctggtctttttcttgtggctattttcaaaggtgtccagtgtgagatgctagttattggagtcgtgggggtgtccgttgggtccggacccggggggtctcgtgagactctcctgtgctaattctggtattccacctccacctacctactcccatgacgtcgtcgggtcccgccgacggcccgggaccggggaaacggggccggaagtcggggtcgacgaagacgtaaagtacgtggtgtagttggtaggtaacgttccgttaccgacgactacggtaccgtccggtaacgggacgggggtcccgttacaacccgtacgtccgtaccgaaggtacgaaacctaaagtttccggaaaggtagttacgtttaggttacgtaaactacgtaaacaaagtacgaaacgaccggtaaagaacgttacggggaacggtaccgtacgggtccttatacgtttccgagtacggaaccgtaaaccgttccccgaaccgttagtaacggttcggttaccttactttaagaccgttaaccgttgttttacccgttttttaaagttaaccgggtttgtaaacggttcgggaccgtttcgggtaacccgggggttaacgtaaaccccgggg

SEQ ID NO: 327030 - DNA, 719 bp, Homo sapiens
  misc_feature: GZ8MTXP01AU5C1.45.83.H06.1.454.CMB.2.raw
tcagacgcgatcgacacgaccggtgctcgatttagatcacgtgcgtcgcgggggagagaggagcccagccctgggattttcaggtgttttcatttggtgatcaggactgaacagagagaactcaccatggagtttgggctgacctggtctttttcttgtggctattttcaaaggtgtccagtgtgagatgcagttattggagtcgtgggggtgccgttggtccgaccggggggtctcgtgagactctcctgtgctaatttctggtacttccaccctccacctacctactcccatgacgcgtcgggtcccgccgacggcccgggaccgggggaaggggccggaagtcgggggtcgacgaggacaaagtaacgtggtagacgttggtaggtaacgtttccttaccgtacgcgaacgtcccgtccggtacgggacgggggtcccgttaccaaccgtactccgtaccgaaggaacgaactaagttacgaaagtagtattgttagtaactactaaacaagtacgaaacctacggtaagaaacggtcggggaacggaccgtaccgggtacccgttacttaacgttcgtacggtacggaacgtaaaccgttccccgtaaccgttaggtaacggtcggttacttcttaacgtcgttaacgttcgtttcccttttagttccgtttggtaacgtcgggtacgttcggtcggggttaacccgtaacgggg

SEQ ID NO: 327031 - DNA, 766 bp, Homo sapiens
  misc_feature: GZ8MTXP01ARQUP.45.83.H06.1.454.CMB.2.raw
  modified_base (370)..(370): a, c, t, g, unknown or other
  misc_feature (370)..(370): n is a, c, g, or t
tcagacgcgatcgacacgaccggtgctcgatttagatcacgtgcgtcgcgggggagagaggagcccagccctgggattttcaggtgttttcatttggtgatcaggactgaacagagagaactcaccatggagtttgggctgacctggtctttttctgtggctattttcaaaggtgtccagtgtgagatgcagttattggagttcgtgggggtgtccgttgggtcccgtacccgggggggtctccgtgagtacctcctcctagtgtctaatttctggtacttccacctcccaccacctatcccatgacgcgtcggggtcccgccacggccccgggaccggggggaaacggggcccggaaagtgggggtccncgaagcaaatacgtggtgagtgggtgtaagttcctcgtacggcaaggtccgtccggtagggacggggtcccggtttacaccccgtattccctaccgaaggaacgtaaccaaagtttaccgggaaaaggttaacgttaagttgggtttacgtaaacttaccgttaaaccaaaagttcgaaaaccgtaacccggttaggaaaaacggttccggggaaacgggtaaccgtaaccgggtcccgtttaacttcgttttccgaggttacgaccgtaaaaccgtttccccgaaccttgtaacgggtcggttacttcttacgttcgacgtttcgtttaccctttttgttaaccggttggtaacgttcgggtacgttccggtaacgggggaaccctaaccggggg

SEQ ID NO: 327032 - DNA, 745 bp, Homo sapiens
  misc_feature: GZ8MTXP01D30L9.45.83.H06.1.454.CMB.2.raw
tcagacgcgatcgacacgaccggtgctcgatttagatcacgtgcgtcgcgggggagagaggagcccagccctgggattttcaggtgttttcatttggtgatcaggactgaacagagagaactcaccatggagtttgggctgacctggctttttcttgtggctattttcaaaggtgtccagtgtgagatgcagttattggagtcgtgggggtgccgttgggtccgacccggggggtctcgtgagactctcctgtgctaatttctggacttcacctcccaccacctatcccatgacgcgtgggtcccgccgacggccccggaccgggggaaacgggggccccgggaaagtcgggggtaccgacgaaggaccgaaaagttaaccgtgggtaggtaaggtttggggtacgggtaaacggttttccccctttaccgtaacccggactacggtaacccgttcccggtaaggggaaccgggggtccccgggtttacaaaccccgtacgttccctacccgaaggtaacgaaacctaagtttacggaaagtaagtattcggttagttaactacttaaacaaataggaaaccaccggtaagaaacgtcggggaagacgtacggtccgttatacttctggtacacgtaaacgttccccgacctaagtaaggtcggttactcgttaactcgtaacgttcgtttccttttaattcgtttaggtaacttgggacgttcgtggggaacccgtaaccgggg

SEQ ID NO: 327033 - DNA, 880 bp, Homo sapiens
  misc_feature: GZ8MTXP01A6KK5.45.83.H06.1.454.CMB.2.raw
  modified_base (664)..(664): a, c, t, g, unknown or other
  misc_feature (664)..(664): n is a, c, g, or t
tcagacgcgatcgacacgaccggtgctcgatttagatcacgtgcgtcgcgggggagagaggagcccagccctgggattttcaggtgttttcatttggtgatcaggactgaacagagagaactcaccatggagtttgggctgacctggtcttttctgtggcttattttcaaaggtgtccagtgtgagatgcagttattggagtcgtgggggtgccgttgggtccggacccggggggtctcgtgagactctcctgtgtctaatttctggtacttccacctccaccacctactcccatcgacgcgtcgggtcccgccgaggcccgggtaccgggggaaggggccccggaaagtcgggggtacgcgtaacgaccgtaaaattaaccgtgggggtgaagttgggggtaggtaaacgtttcccttacgtacggactacggtacccgtaccgggtagggtaaccggggggtccccgtttaccaaacccgtacgttccctacccggaaacggaacgggtaaaccttaaacgtttacggaaaacgttagggttacttagggtttaacggttaaacttaccttaaaacgtaaaaagttcggaaaaaccctaaccgggttaagaaaaccgggttcgggggaaacggtaaacccgtacccgggggttaccccgttntttaaacgtttcccgttaggttaccggtaaacggttaaaaccccgggtttacccccgtaaaccccgttaaggtaaccgggtttaacggggttcctttacctttaacgtacccggttaacgggtttcgttttaccctttttttagttaacccgtttaggggtaaccttacgggggtaccgttacggggttaacccgggggaaccggtaaacccgggg

SEQ ID NO: 327034 - DNA, 633 bp, Homo sapiens
  misc_feature: GZ8MTXP01ABZXH.45.83.H06.1.454.CMB.2.raw
  modified_base (230)..(230): a, c, t, g, unknown or other
  misc_feature (230)..(230): n is a, c, g, or t
  modified_base (256)..(256): a, c, t, g, unknown or other
  misc_feature (256)..(256): n is a, c, g, or t
  modified_base (276)..(276): a, c, t, g, unknown or other
  misc_feature (276)..(276): n is a, c, g, or t
  modified_base (450)..(450): a, c, t, g, unknown or other
  misc_feature (450)..(450): n is a, c, g, or t
tcagacgcgatcgacacgaccggtgctcgatttagatcacgtgcgtcgcgggggagagaggagcccagccctgggattttcaggtgttttcatttggtgatcaggactgaacagagagaactcaccatggagtttgggctgacctggctttttctgtggctattttcaaaggtgtccagtgtgagatgcagttatggagtcgtggggtgccttggtccacccggggggtntcgtgagactctcctgtgcaatttcnggattcacctccacacctancccatgagcgtggtaccgccagccgccggggaaagggcccggaagtggggcgcaagccaagtaaccgtggtagagtggtgaaacgtttccttccgacgcagacctccggtagacggggtcccgttcacccgatcctccagagaacacttgaagatagtgttcgaattccaaaanaagtacgaacacggtagaacgcgggacgacgaccgtacgtatagttcgtaggtacgacgtaaccgttcccgaccttaggtaacggtcggttcttacgttacgtaccgtacgtttcgtttaccgtttttacgttaacggtttggtaacgttcgggtaccgttcgggtcgggaacccgtaacggg

SEQ ID NO: 327035 - DNA, 754 bp, Homo sapiens
  misc_feature: GZ8MTXP01EHYF5.45.83.H06.1.454.CMB.2.raw
  modified_base (267)..(267): a, c, t, g, unknown or other
  misc_feature (267)..(267): n is a, c, g, or t
  modified_base (362)..(362): a, c, t, g, unknown or other
  misc_feature (362)..(362): n is a, c, g, or t
tcagacgcgatcgacacgaccggtgctcgatttagatcacgtgcgtcgcgggggagagaggagcccagccctgggattttcaggtgttttcatttggtgatcaggactgaacagagagaactcaccatggagtttgggctgacctggtctttttcttgtggctattttcaaaggtgtcagtgtgagatgctagttagttggagtcgtgggggtgtccgttgggtcccggaccggggggtctcgtgagactctcctgtgctaatttcngtacttccacctccaccacctactcccatcggacgtcgtcgggtcccgccgacggccccgggaccgggggaaaggggccggaagtgggggtaccncgaagactaaagtacggtggtagtagtgggtaggtacgtttcccgttccaccggcacggtaccgtcccgggtaggggaaccgggggttcccgttaccaaacccgtacgtacccgtacccgaaggtaactaaccgtaagttacggaaagttagtattgttagtatactaactaagtagaaaccgtacgtaagaacggtcggggaacgtacgtaccggtaccgttattagttccggttagtaccgtaacggtaaacccggttaccccgtaacccgtaagggttcggtacgggttccttaacgtttacgttaacgttacggtttcgttttacctttttaggttaacgtttaggtaacgtcgggtcggttacgggtcggggttaaccgtaaccggg

SEQ ID NO: 327036 - DNA, 720 bp, Homo sapiens
  misc_feature: GZ8MTXP01BD1G7.45.83.H06.1.454.CMB.2.raw
  modified_base (595)..(595): a, c, t, g, unknown or other
  misc_feature (595)..(595): n is a, c, g, or t
tcagacgcgatcgacacgaccggtgctcgatttagatcacgtgcgtcgcgggggagagaggagcccagccctgggattttcaggtgttttcatttggtgatcaggactgaacagagagaactcaccatggagtttgggctgacctggtctttttctgtggctattttcaaaggtgtccagtgtgagatgcagttattggagtcgtgggggtgccgttgggtcccgacccgggggggtctcgtgagactctcctgtgctaatttctggtacttccacctcccaccacctactccccatcgacgcgtcgggtccgccgacggccgggaccgggggaacggggccggaagtcgggtcgacgagactaagtaacgtggtagagttgggtaggtaacgtttccttaccgtaccgacgacggtacccgttcgggtacgggacgggggtcccggttacaccctacgtcctacgaagacgaactaacgttacggaaagtaggttattaggttagtaacgtaactaaacgaaaagtcggaaaactaaccgggtaagtaaacggtcgggggaaacggtaacggtccggtccgttatacgtttcgngtacggacgttaaccgtcccgtacctaggtcgttcgggcttcttagtcgtacgttctttccttttttaagtcgttttgggaacgttcggggtacgttacggggtcgggttaacccgtaacggggg

SEQ ID NO: 327037 - DNA, 746 bp, Homo sapiens
  misc_feature: GZ8MTXP01C5N16.45.83.H06.1.454.CMB.2.raw
  modified_base (608)..(608): a, c, t, g, unknown or other
  misc_feature (608)..(608): n is a, c, g, or t
tcagacgcgatcgacacgaccggtgctcgatttagatcacgtgcgtcgcgggggagagaggagcccagccctgggattttcaggtgttttcatttggtgatcaggactgaacagagagaactcaccatggagtttgggctgacctggtctttttcttgtggcttattttcaaaggtgtccagtgtgagatgctagttattggagtcgtgggggtgccgttcgggtccgacccggggggtctcgtgagtactctcctgtgctaatttctaggtacttccacctcccaacctacctactccccatgacgtcgtcggggtcccgcccgacggcccgggacccggggggaaacgggggcccggtaagtcgggggtccgacgaagactaaagttaaacgtgggtagtagttgggtaggtaacgtttccttaccgtacgcgacgtaccgtccggtaagggacggggtccgttaccacctatccgtaccaagacgaactaagttacgaaagtagttagtcgtttagtaacttactaaactaaaacgtcgaaaacctaccggtaaaggaaacgttcggggaaacggaccgtaaccggtcccgttattacgtttcgngtacggaacgtaaaccgttccccgaaccttaggtaacggtcggttcttacgttagtcccgttacgtttcgtttcccttttttaagttccgtttaggtgttcggggaccgttcgggtcggggaaccgttaacccggggg

SEQ ID NO: 327038 - DNA, 755 bp, Homo sapiens
  misc_feature: GZ8MTXP01B7JGU.45.83.H06.1.454.CMB.2.raw
tcagacgcgatcgacacgaccggtgctcgatttagatcacgtgcgtcgcgggggagagaggagcccagccctgggattttcaggtgttttcatttggtgatcaggactgaacagagagaactcaccatggagtttgggctgacctggtctttttcttgtggctattttcaaaggtgtccagtgtgagatgctagttattggagtcgtgggggtgccgttggtccgaccggggggtctctgacgactctctgtgactattctgtacttccacctcccacctacctactcccatcgacgcgtcgggtacccgccgacgggcccgggacgggggaacgggccgggaagtgggggtccgacgagtactaataacgttgggtagtagtggtacggtaacgtttcccttaccgtaccggctagtacccgtccggtaagggtaccggggtcccggttacaacccgtatcccgtaccgaaggaacggtaaacctaagtttaccggaaaggtaagttagtttaggtttaacgtaacttaacgtaaacgtaaagttaccggaaaacgtaccggtaaggtaaacggtcggggtaaacggaccgtaacccggtcgttaacttagtttaccgtggtaccggtacgttaaacccgttccccgtaaccgttagtaacggtggttaccttacttagttaccgtcgtttaccgtttctttttaaggttctttggtaagttcggacgttcgggtaaccgggccgttaacgggg

SEQ ID NO: 327039 - DNA, 732 bp, Homo sapiens
  misc_feature: GZ8MTXP01BKOBP.45.83.H06.1.454.CMB.2.raw
  modified_base (503)..(503): a, c, t, g, unknown or other
  misc_feature (503)..(503): n is a, c, g, or t
tcagacgcgatcgacacgaccggtgctcgatttagatcacgtgcgtcgcgggggagagaggagcccagccctgggattttcaggttgttttcatttggtgatcaggactgaacagagagaactcaccatggagtttgggctgacctggtctttttcttgtggtcttattttcaaaggtgtccagtgtgagatgctagttagttggagttcgtgggggtcgtccgttcgggtcccggacccgggggggtctcgtgacgtacctctcctgtcgactaatttctggtacttccacctccacctactactcccatcgacgccggtcggtcccgcgacggcccgggaccgggggtaacgggccgggaagtcgggtcgacgagactaagtacgtggtgtagttcgggtaggtacgttccttacgtacgcacgtccgtcggacgggacgggtccgtacacctactccacgacgagaactacgtagaagtgtagttgttataactctaaanaactacggaaactaccggtaaagtaaccggtcggggaacggtaaccgtccggtaccgttctttacgttccgtaggtacgtaaccggtaaacccgtttccccgaaccttaggtaacgggttcggttctttaacgtttcgtacgttaccgtttcgttttactttttaaacgttcggtttaggtaacggttaccgggtcgttaccgggtccgggggttaacgtaaccccggg

SEQ ID NO: 327040 - DNA, 787 bp, Homo sapiens
  misc_feature: GZ8MTXP01CT8P1.45.83.H06.1.454.CMB.2.raw
tcagacgcgatcgacacgaccggtgctcgatttagatcacgtgcgtcgcgggggagagaggagcccagccctgggattttcaggtgttttcatttggtgatcaggactgaacagagagaactcaccatggagtttgggctgacctggtctttttcttgtggtcttattttacaaaggtgtccagtgtgagatgctagttatgggaggtcggtgggggtcgtccgttcgggtccggtacccgggggggtctcgtgagctctctgtgtctaattctgtactccacctccaccacctactcccatgacgtcgtcgggtccgccgacggccgggaccggggggaacggggccggtaagtcgggggtcgacgacgacgaaagtaacgtgggtagtagttacgggtaggtacgtttccgttaccgtaccggtacgacggtacccgtccgggtaacggggacggggttcccgttacaacccgtactccgtaccgaagacgtaaactagttaacgaaagtagttagttacggttaataacgttaaactaaactaaagtaacgaaaaccgtaacggtaaagtaaaaccgggtccggggaaacggtaaccggtacccgggttccgtttaacgttacgtttacggtacggttaaccgaaaccggttaaaccccgtccccgtaaaccgtttagtaacgggtcgttacctttacttagtaccgttcgttttacgtttcctttttaagtttaaccggttgtaagttcgggtacgttcgggtccggggaacgttaacccggg

SEQ ID NO: 327041 - DNA, 773 bp, Homo sapiens
  misc_feature: GZ8MTXP01DSV1X.45.83.H06.1.454.CMB.2.raw
  modified_base (263)..(263): a, c, t, g, unknown or other
  misc_feature (263)..(263): n is a, c, g, or t
  modified_base (302)..(302): a, c, t, g, unknown or other
  misc_feature (302)..(302): n is a, c, g, or t
tcagacgcgatcgacacgaccggtgctcgatttagatcacgtgcgtcgcgggggagagaggagcccagccctgggattttcaggtgttttcatttggtgatcaggactgaacagagagaactcaccatggagtttgggctgacctggtctttttcttgtggcttattttcaaaggtgtccagtgtgagatgctagttattggagtcgtgggggtgtccgttcggtccggaccgggggtctcgtgagactctctgtgctattcngtattcacctccaccactactcccatgagcgtcgggccnccgacggcccgggaccgggggaaaggggcccggaaagtcgggggtaccgacgaaggaccgtaaaagttaacggttgggtagtaaggttggggttaacgggtaaacgtttcccttaccgtaccggtacgtaacggtacccgttcccgggtaacggggaaccgggggtcccggtttaccaacccgtacgttacccgtaccgaagacggtaaacctaaagttcgaaaagtacgttagttgttagttaacacttaaacgaaagtacgaaacctcggtaaggaaacgtcggggaaaggaccgtaccggtccttagtttaacttcgtaggttaccgaaccggttaaaaccgttcccccgaaacgttaagtaacgggttcggaccctttcttagtacccggtacgtttctttacccgttttttaaatcggtttaggtgttccgggaacggttccgtaacgggggaacccgtaaccggg

SEQ ID NO: 327042 - DNA, 604 bp, Homo sapiens
  misc_feature: GZ8MTXP02JN1KO.45.83.H06.1.454.CMB.2.raw
  modified_base (410)..(410): a, c, t, g, unknown or other
  misc_feature (410)..(410): n is a, c, g, or t
tcagacgcgatcgacacgaccggtgctcgatttagatcacgtgcgtcgcgggggagagaggagcccagccctgggattttcaggtgttttcatttggtgatcaggactgaacagagagaactcaccatggagtttgggctgacctggcttttcttgtggctattttcaaaggtgtccagtgtgagatgcagttattggagtctgggggtgccttggtccgacccggggggtctcgtgagactctcctgtgctaatttctggattcacctccaccacctatcccatgagctgggtcccgccgagccccggccgggggaaggggccgggaagtggggtcgcgagacaataacgtggtagagtgggtggaagttcctcctacgcagactcgtggacgggccggttcaccatcnccagagacaattcgaagagtatgttagtatcaacaaatgaacaccgtagaaagtcgaggacacggcgtactattctgtcgacgtaaagttccccgaacctagtacggtcgggctacttactctacgttcgttaccctttttataacgttttggtattacggggacgttcggttacgggggacctaaaccggggg

SEQ ID NO: 327043 - DNA, 748 bp, Homo sapiens
  misc_feature: GZ8MTXP02I8X80.45.83.H06.1.454.CMB.2.raw
  modified_base (260)..(260): a, c, t, g, unknown or other
  misc_feature (260)..(260): n is a, c, g, or t
tcagacgcgatcgacacgaccggtgctcgatttagatcacgtgcgtcgcgggggagagaggagcccagccctgggattttcaggtgttttcatttggtgatcaggactgaacagagagaactcaccatggagtttgggctgacctggctttttcttgtggctattttcaaaggtgtccagtgtgagatgcagttattggagtcgtggggtgccttggtccgacccggggggtctcgtgagactctcctgtgctaatttcnggattcaccctccaccacctactcccatgagctcgggtcccgccgacggcccggaccggggaaggggcccggaagtcgggtcgcgagacaaataacgtggtgagtgggtaggtaacgtttccttaccgtaccgcacggtaccgtcccggtagggaccgggggtcccggttaccaacccgtacgttcccacccgaagaacgaaccctaaagttaccggaaagtagttaattggttagtaaacttacctaaactaaaagttcggaaaacctaaccggtaaaggaaaacggttaccggaaacggggtaaccaacccggggtcccgttaccgtttaatttcccgtaggttacggaaccgtaaaaccggtttcccccgaaaccctagttaacggtcggtaccttacgttatccgtacgttacgttcccttttttaataaccgttttaggtaacgtcgggtaaccgttcggtacgggggtacctaaaccggggg

SEQ ID NO: 327044 - DNA, 625 bp, Homo sapiens
  misc_feature: GZ8MTXP02JDJJL.45.83.H06.1.454.CMB.2.raw
  modified_base (256)..(256): a, c, t, g, unknown or other
  misc_feature (256)..(256): n is a, c, g, or t
  modified_base (294)..(294): a, c, t, g, unknown or other
  misc_feature (294)..(294): n is a, c, g, or t
  modified_base (496)..(496): a, c, t, g, unknown or other
  misc_feature (496)..(496): n is a, c, g, or t
tcagacgcgatcgacacgaccggtgctcgatttagatcacgtgcgtcgcgggggagagaggagcccagccctgggattttcaggtgttttcatttggtgatcaggactgaacagagagaactcaccatggagtttgggctgacctggcttttctgtggctattttcaaaggtgtccagtgtgagatgcagttattggagtctgggggtgccttggtccacccggggggtctcgtgagactctcctgtgcaatttcnggattcacctccaccacctatcccatgagctgggtccnccaggcccggccggggaaggggcccggaagtcggggtcgcagcaaataacgtggtgagtgggtggaaagtttcctacgtacgcagactccgtggacggggccggttcaccatcctccagacgacaaattcgaaagagtaatgttagtatctaaacaaatcgaaacaccgtagaaagtcgaggacacggtccgtactattcgngtgacgtaaagttccccgacttagacggtcgggtctcgttaactcgtaacgttcgttaccctttttaagttaaccgttttgggtaacgtttcggggaccgttcggttacgggggaccctaaaacggggg

SEQ ID NO: 327045 - DNA, 589 bp, Homo sapiens
  misc_feature: GZ8MTXP02GM2QH.45.83.H06.1.454.CMB.2.raw
  modified_base (431)..(431): a, c, t, g, unknown or other
  misc_feature (431)..(431): n is a, c, g, or t
tcagacgcgatcgacacgaccggtgctcgatttagatcacgtgcgtcgcgggggagagaggagcccagccctgggattttcaggtgttttcatttggtgatcaggactgaacagagagaactcaccatggagtttgggctgacctggcttttcttgtggctattttcaaaggtgtccagtgtgagatgcagttattggagtctgggggtgccttgggtccacccgggggggtctcgtgagactctcctgtgctaattctggattcaccctccaccacctatcccatgagctggtccgccagccgccggggaagggccggaatgggcgcagcaaataacgtggtgatggtgaagttcctctacgcagactccgtgacggggccgtcacatcctccagagacaaattcgaaagagtatgttgtatcctaaaanaaatacgaaacacgtaagaaagtcggaacgacgacggtccgtacttacttcgtagtacgacgtaaccgtccccgactagtacggtcggcttactactcgacgttcttaccttttataacgtttggtacgtcggtacgtcgtacggggaccgtaacggg

SEQ ID NO: 327046 - DNA, 729 bp, Homo sapiens
  misc_feature: GZ8MTXP02H21UZ.45.83.H06.1.454.CMB.2.raw
  modified_base (312)..(312): a, c, t, g, unknown or other
  misc_feature (312)..(312): n is a, c, g, or t
tcagacgcgatcgacacgaccggtgctcgatttagatcacgtgcgtcgcgggggagagaggagcccagccctgggatttcaggtgttttcatttggtgatcaggactgaacagagagaactcaccatggagtttgggctgacctggtcttttcttgtggcttattttcaaaggtgtccagtgtgagatgcagttattggagtcgtgggggtgtccgttcgggtccgacccggggggtctcgtgagactctcctgtgctaatttctggattccaccctcccacccacctactccccatgacgcgtcgggtccnccgacggccccgggaccgggggaacggggccgggtaagtcggggtccgacgacgacaaagttaaacgtgggtagagtgggtaggtaaacgtttccttaccgtacgcaacgaccgttccggtagggacggggtcccgtttacaaccgtactcctaccgaagacgaaacctaaagttacgaaagtagttagtaggttattaactacctaaaactaaaatacgaaacctaccggtaaagaaacgtaccggaaaggtacccaacgggtcccttatttaacgtttacgtggtacgaaccggtaaaaccgtttccccgaaacccgtaagtaggtacggtcttacttacgtctacgttacgtttacctttttaattaacgtttggtaagttcggaaccgttcggtaccggggtacgtaaccggg

SEQ ID NO: 327047 - DNA, 790 bp, Homo sapiens
  misc_feature: GZ8MTXP02GFDHB.45.83.H06.1.454.CMB.2.raw
tcagacgcgatcgacacgaccggtgctcgatttagatcacgtgcgtcgcgggggagagaggagcccagccctgggattttcaggtgttttcatttggtgatcaggactgaacagagagaactcaccatggagtttgggctgacctggtctttttcttgtggctattttcaaaggtgtccagtgtgagatgctagttatggagtcgtgggggtgccgttgggtccgaccggggggtctcgtgagactctcctgtgctaatttctggtattccaccctccaccctacctactcccatgagcgtcgggtcccgccgacggcccgggaccgggggaacggggccgggaagtcggggtcgacgagcaaaagtaacgtgggtagtagtgggtaggtaaacggtttccttaccgtacgccacgaccgttccggtgggacggggtcccggttcaacctacgtccctaccgaaggaacgaactaaagttacggaaaggtagtaatttggttagttaaatcctaaaacaaaagttcgaaaccgaaccggttaaaggaaaacggttcgggaaaggtaaccaacgttcgggtaccccttacgtttaacgtttcgttacggggttaacggaaccggtttaaaacccggtttaccccccggtaaacctttaaggttaacgggggttccggggtacctttacctttaagtacccgttacgtttaccggttttaccttttttaagtttaaccggttttgggtaaacggtttcggggtaacgtttccgggacgggggtaaaccccgg

SEQ ID NO: 327048 - DNA, 675 bp, Homo sapiens
  misc_feature: GZ8MTXP02GJY31.45.83.H06.1.454.CMB.2.raw
  modified_base (509)..(509): a, c, t, g, unknown or other
  misc_feature (509)..(509): n is a, c, g, or t
tcagacgcgatcgacacgaccggtgctcgatttagatcacgtgcgtcgcgggggagagaggagcccagccctgggattttcaggtgttttcatttggtgatcaggactgaacagagagaactcaccatggagtttgggctgacctggctttttcttgtggctattttcaaaggtgtccagtgtgagatgcagttattggagtcgtgggggtgccgttggtcccgacccggggggtctcgtgagactctcctgtgctattctggattccaccctccaccacctactcccatcgagctcgggtcccgccgacggccccggccgggggaaggggcccgggaagtcggggtccgacgagcgaaagtaacgtggtggagtgggtaggtaaacgtttcccttaccgtaccgcgaacgtaccgttcccggtagggacgggggtcccggtttcaacccgtagttcccgtccgaagacgaactaaagttacgaaagtagtagttgttagtatactaanaaatgaaccacgtaagaaagtcggagtacgacggtccgtacttattcgtgtgacgtaaacgttcccgaccgtatacggtggtcttacgttactcctacgttcgttacctttttagttaacgtttaggttacgttcggtaccgtcggtcggggtaccgtaaccgggg

SEQ ID NO: 327049 - DNA, 585 bp, Homo sapiens
  misc_feature: GZ8MTXP02IB5NR.45.83.H06.1.454.CMB.2.raw
  modified_base (448)..(448): a, c, t, g, unknown or other
  misc_feature (448)..(448): n is a, c, g, or t
  modified_base (478)..(478): a, c, t, g, unknown or other
  misc_feature (478)..(478): n is a, c, g, or t
tcagacgcgatcgacacgaccggtgctcgatttagatcacgtgcgtcgcgggggagagaggagcccagcccctgggattttcaggtgttttcatttggtgatcaggactgaacagagagaactcaccatggagtttgggctgacctggctttttcttgtggctattttcaaaggtgtccagtgtgagatgcagttattggagtcgtgggggtgccgttggtccgacccggggggtctctgagactctcctgtgcaatttctggattcacctccaccacctatcccatgagctgggtcccgccagcccggccggggaaggggccggaagtcggggtcgcagcaataactggtgatggtgaagttccttcacgcagactccgtgacggggccggttcaccatcctaccagagacaattcgaaagagtatgtgtatctaacaaatgaaacncgtagaaagtcgaggacacggcgtctattngtgacgtaaacgtcccgacctatacgtggacttcgttatcgtacgtcgttccctttttaagtaacgttttgggtatcgggtacgtcgtcgggggaccctaaacgggg

SEQ ID NO: 327050 - DNA, 787 bp, Homo sapiens
  misc_feature: GZ8MTXP02GGYAI.45.83.H06.1.454.CMB.2.raw
  modified_base (513)..(513): a, c, t, g, unknown or other
  misc_feature (513)..(513): n is a, c, g, or t
tcagacgcgatcgacacgaccggtgctcgatttagatcacgtgcgtcgcgggggagagaggagcccagccctgggattttcaggtgttttcatttggtgatcaggactgaacagagagaactcaccatggagtttgggctgacctggtctttttcttgtggctattttcaaaggtgtccagtgtgagatgcagttatggagtcgtgggggtgccgttggtccgacccggggggtctcgtgagactctcctgtgctaattctggtattccacctccaccactactcccatgagcgtcggtcccgccgacggcccgggaccgggggaaggggccgggaaagtcggggtcgacgagacaaagtaacgtgggtaggagtggggtaggtaaacgtttccttaccgtaccgcaacggtaccgtccggtacggacggggtcccggttaccaacctagtccctaccaaggaacgtaaactaaagttacgaaagtagtaagttgttagtaactaccgtaaanaaaacgttacgaaaaccgtaccggttaaaggaaaacggtacgggaaacgggtaaccgtaccggggtacctttacgttaacgttttccgtaggttacggtaaaccggttaaaaccggtttccccccgtaaacccgttaagttaacgggttcgggttacctttaccgtttaacgtaccgttacgttaccgttttacccttttttaagttaaccgtttttacgggtagttacgggggtaccgtttcgggttaccgggggacccgttaaacccggggg

SEQ ID NO: 327051 - DNA, 698 bp, Homo sapiens
  misc_feature: GZ8MTXP02GYI9L.45.83.H06.1.454.CMB.2.raw
  modified_base (466)..(466): a, c, t, g, unknown or other
  misc_feature (466)..(466): n is a, c, g, or t
tcagacgcgatcgacacgaccggtgctcgatttagatcacgtgcgtcgcgggggagagaggagcccagccctgggattttcaggtgttttcatttggtgatcaggactgaacagagagaactcaccatggagtttgggctgacctggcttttctgtggctattttcaaaggtgtccagtgtgagatgcagttattggagtcgtggggtgccgttggtccgacccggggggtctcgtgagactctcctgtgctaattctgattcacctccaccactactcccatgagctggtccgccacgccggacggggaggccggaagtggcgcagacaagttaacgtggtagagtgggtagaacggtttcctccgtacgcctagacctcccggtggaacggggccgggtttccaccgtaatcccgtacacgagaccctaaattccgaaagtagtagtggttacgtaatcctaanaaatgaaaccgacgttaggaaaacgtcggaaacggtacgacccggtaccggttacttaacgtttcgtacggtacgtaacgtaaaaccggttccccgacccgttaagttacgggtcgggtaccttacttacgtaccgttaacggtttccgttaccttttttttaaagtcccggttttaggttaaaccgtgggttaaccggtccggtttaccgggggacctttaaacccggggg

SEQ ID NO: 327052 - DNA, 785 bp, Homo sapiens
  misc_feature: GZ8MTXP02F16KS.45.83.H06.1.454.CMB.2.raw
  modified_base (255)..(255): a, c, t, g, unknown or other
  misc_feature (255)..(255): n is a, c, g, or t
tcagacgcgatcgacacgaccggtgctcgatttagatcacgtgcgtcgcgggggagagaggagcccagccctgggattttcaggtgttttcatttggtgatcaggactgaacagagagaactcaccatggagtttgggctgacctggcttttcttgtggctattttcaaaggtgtccagtgtgagatgcagttatggagtcgtggggtgccttggtccgacccggggggtctctgagactctcctgtgctattcnggacttcacctccaccacctactcccatgacgcgtcggtcccgccgacggcccggccgggggaacgggcccggaaggtcggggtacgccgagacaaagtaaccgtgggtagagtggggtaggtaaagtttcccttaccgtaccgcgtaacggtaccgtccggtagggacgggggtcccggttaccaacccgtacgttcccgtacccgaagaaccgtaacctaaagttaccggaaagtagtagttgtttagtactactaaacgaaattacgaaaccgaccgtaaaggtaaacggtacggaacggaccgtaccgggtacccgttacttaacgtttcgtacggttacggtaaccggtaaaaccgtttacccccggtaaccccgtttaaaggtaccgggttcggggtaccctttcgtttaaacttccgttaaccggtttacgtttaccctttttttaaagttaacccgttttagggttaacgttacggggtaccggtttacgggttaccgggggtaaccgttaaaacccggggg

SEQ ID NO: 327053 - DNA, 691 bp, Homo sapiens
  misc_feature: GZ8MTXP02JLZ5O.45.83.H06.1.454.CMB.2.raw
tcagacgcgatcgacacgaccggtgctcgatttagatcacgtgcgtcgcgggggagagaggagcccagccctgggattttcaggtgttttcatttggtgatcaggactgaacagagagaactcaccatggagtttgggctgacctggcttttcttgtggctattttcaaaggtgtccagtgtgagatgcagttattggagtcgtgggggtgccgttggtccgacccggggggtctcgtgagactctcctgtgctaatttctggattcacctccaccacctactcccatgagcgtgggtcccgccgaggccccggaccgggggaagggccgggaaagtcggggtccgacgagacaaataacgtggtagagtgggtaggaacgtttccttactacgcacgacctcggtaggacggggcccggttcacctatcctccaagacgactaaagttcgaaagagttatgttagtaatcgtaaacaaaagtcgaaaacctaccgttaaggaaaacgttcggaaacggtacgaaccgggtcccgtacttaagtttccgagggtacggaacgtaaaacccgtttcccccgaaaaccgttaagttagggtcgggaccttactttacgacctacgttcgtttaccctttttaaagtaacgttttggaaattcgggacgttcggtacgggggactaaaccgggg

SEQ ID NO: 327054 - DNA, 752 bp, Homo sapiens
  misc_feature: GZ8MTXP02HER0J.45.83.H06.1.454.CMB.2.raw
  modified_base (266)..(266): a, c, t, g, unknown or other
  misc_feature (266)..(266): n is a, c, g, or t
tcagacgcgatcgacacgaccggtgctcgatttagatcacgtgcgtcgcgggggagagaggagcccagccctgggattttcaggtgttttcatttggtgatcaggactgaacagagagaactcaccatggagtttgggctgacctggtctttttcttgtggcttattttcaaaggtgtccagtgtgagatgcagttattggagtcgtgggggtgtccgttgggtccgacccgggggtctcgtgagactctcctgtgctattctgtntccacctccaccacctactcccatgacgtcgtcgggtcccgccgacggccccgggaccgggggaacggggccgggaaagtcggggtccgcgaggaccaaagttaacgtgggtagtagtgggtaggtaacgtttcctaccgtacgcagtaccgtccggtaggacggggtcccgttcacctactcctaccgaagacgaacctaagttacgaaaagtgttaactggtttagtaattacgtaaactaaagtacgaaaccgtaccggtaaaggaaaacggttccggaacgggaaccgtacgggtacccttatttacgtttcgtaggtacggtaaccggttaaaaccgtttcccccggaaacctttaagttacggggtacgggtccttttacgttaacgtccgttaacggtttctttaacccttttttaaagtccgttttaggtaacgttcggggtaacctttcggggtcgggggaacccttaaaccggggg

SEQ ID NO: 327055 - DNA, 632 bp, Homo sapiens
  misc_feature: GZ8MTXP02FQYD6.45.83.H06.1.454.CMB.2.raw
  modified_base (296)..(296): a, c, t, g, unknown or other
  misc_feature (296)..(296): n is a, c, g, or t
  modified_base (410)..(410): a, c, t, g, unknown or other
  misc_feature (410)..(410): n is a, c, g, or t
  modified_base (513)..(513): a, c, t, g, unknown or other
  misc_feature (513)..(513): n is a, c, g, or t
tcagacgcgatcgacacgaccggtgctcgatttagatcacgtgcgtcgcgggggagagaggagcccagccctgggattttcaggtgttttcatttggtgatcaggactgaacagagagaactcaccatggagtttgggctgacctggctttttctgtggctattttcaaaggtgtccagtgtgagatgcagttattggagtcgtgggggtgccttggtccgacccggggggtctcgtgagactctcctgtgctaattctggattcaccctccaccacctatcccatgagctggccnccagcccggccggggaagggccggaagtcggggcgcagcaataacgtggtgatggtaggtaagtttccttacgtaccgcagtacctccggtaggaacggggtcccgttaaaccncgttcctacccgaagacgaaactaaagttcgaaagtagtatgttagtatacaactaaatacgaaacaccgtagaaagtcgaaggaccacggcctactattcgngtacgacgtaaacgtccccgaacctagtacggtcggacttcgttactccgtaacgttcgttaccttttaatttacgttggtagttcggtacgtcgtcggggaccgtaacggggtacccg

SEQ ID NO: 327056 - DNA, 861 bp, Homo sapiens
  misc_feature: GZ8MTXP02G0716.45.83.H06.1.454.CMB.2.raw
  modified_base (236)..(236): a, c, t, g, unknown or other
  misc_feature (236)..(236): n is a, c, g, or t
  modified_base (303)..(303): a, c, t, g, unknown or other
  misc_feature (303)..(303): n is a, c, g, or t
tcagacgcgatcgacacgaccggtgctcgatttagatcacgtgcgtcgcgggggagagaggagcccagccctgggattttcaggtgttttcatttggtgatcaggactgaacagagagaactcaccatggagtttgggctgacctggtctttttcttgtggcttattttcaaaggtgtccagtgtgagatgctagttattggagtcgtggggtgccgttggtgcgacccgggggtntcgtgagactctcctgtgctattctggacttcaccctccaccacctactcccatgacgcgtcggccnccgacggccgggaccggggaacggggccgaaggtcggggtccgacgagacaaagtaacgtgggtagtagtggggtaggtaacgtttccccgttacgtacgactacgtaccgtccgggtagggacgggggtccccgttaccgaacccgtacgttcccgtacccgaaaggtaacgaaacgtaaacgttaaccggaaagtaggttaagttggtttaacgtaacttaccgtaaaactaaaacgtacgaaaaccgtaacccggtaaggtaaaaacgggtaccgggaaacggtaacccggaacccggggtccctttaacgttaacgtttttccggacggttaaaccggttaaacccggttaaaaacccgggtttacccccccggtaacccgttttaaaagggttccgggggtttacgggtaccctttttaccgttaaaacgtttcccgtaaaccgggttttacctttttaaccccgttttttttaaaggttaccggtttttaggggttaacgttacgggggtttacccctttaccgggggtttacccgggggtaaaacccccgg

SEQ ID NO: 327057 - DNA, 690 bp, Homo sapiens
  misc_feature: GZ8MTXP02JGUSX.45.83.H06.1.454.CMB.2.raw
  modified_base (281)..(281): a, c, t, g, unknown or other
  misc_feature (281)..(281): n is a, c, g, or t
  modified_base (547)..(547): a, c, t, g, unknown or other
  misc_feature (547)..(547): n is a, c, g, or t
tcagacgcgatcgacacgaccggtgctcgatttagatcacgtgcgtcgcgggggagagaggagcccagccctgggattttcaggtgttttcatttggtgatcaggactgaacagagagaactcaccatggagtttgggctgacctggcttttcttgtggctattttcaaaggtgtccagtgtgagatgcagttattggagtcgtgggggtgccgttggtccgacccggggggtctcgtgagactctcctgtgctatttctggattcacctccaccacctancccatgagctggtccgccagcccggaccggggaagggccggaagtggggcgcgagccaaagtaacgtggtagagtgggtaggtaaacgtttcccttaccgtaccgcaacgtaccgttcccggtaggaacgggggtcccggttacaacccgtattccctccgaagacgaacctaaagttcgaaagtagttaatgtttagtatcgtaaactaaatacgaaacacgttagaaagtcggaaacggaccgacggtccgttatagtttccgngtacgacggtaaacgttcccgaacctagtacggtcggtacctttcgttaaactccgtacgtttacgtttacccttttttaagttaaccgttttagggtaacgttacgggtaccgtttcggttcgggggaccctaaaccggggg

SEQ ID NO: 327058 - DNA, 618 bp, Homo sapiens
  misc_feature: GZ8MTXP02G6X1R.45.83.H06.1.454.CMB.2.raw
  modified_base (262)..(262): a, c, t, g, unknown or other
  misc_feature (262)..(262): n is a, c, g, or t
  modified_base (560)..(560): a, c, t, g, unknown or other
  misc_feature (560)..(560): n is a, c, g, or t
tcagacgcgatcgacacgaccggtgctcgatttagatcacgtgcgtcgcgggggagagaggagcccagccctgggattttcaggtgttttcatttggtgatcaggactgaacagagagaactcaccatggagtttgggctgacctggctttttcttgtggctattttcaaaggtgtccagtgtgagatgcagttattggagtcgtgggggtgccttggtccgacccgggggggtctcgtgagactctcctgtgctaatttcnggattcacctccaccacctatcccatgagcgtggtcccgccagcccggccggggaaggggccggaagtgggtcgcgagcaataactggtgagtggtagaagttcctccgtacgcagaccgtccgtggacggggtcccggttcaccacgtcctaccaaggacgactaaagttcgaaagtagtaatggttagtatcgtaaacaaagtacgaaacaccggtagaaacgtcgaacgtacgcgtaccgtattagtttcagttcgacggtaaacgttccccgactagtacggtgggctcgttanctacgtcgttacctttttaatcgtttgtacgttggacgtcgtacggggactaaccggg

SEQ ID NO: 327059 - DNA, 620 bp, Homo sapiens
  misc_feature: GZ8MTXP02FZXGH.45.83.H06.1.454.CMB.2.raw
tcagacgcgatcgacacgaccggtgctcgatttagatcacgtgcgtcgcgggggagagaggagcccagccctgggattttcaggtgttttcatttggtgatcaggactgaacagagagaactcaccatggagtttgggctgacctggcttttcttgtggctattttcaaaggtgtccagtgtgagatgcagttattggagtcgtggggtgccttgggtccgacccggggggtctcgtgagactctcctgtgctaattctggattcacctccaccacctatcccatgagctggtccgcacgcccggccggggaagggccggaagtggggtcgcagcaaagtaacgtggtgagtggtagtaagttcctccgtacgcagactccggtaggacggggtcccggttcaccgtatccgtccaggacgacaaattacgaaagtagtatgttagtatactaacaaatgaaaccacgtagaaagtcgaacgacacggccgtactatttcgtagtcgacgtaaacgttccccgaaccttagtacggtcgggtacttctactactacgttacgtccttttttataaccgtttggtacttcgggtacgttcgtcggggtacctaaaccgggg

SEQ ID NO: 327060 - DNA, 720 bp, Homo sapiens
  misc_feature: GZ8MTXP02H4G7L.45.83.H06.1.454.CMB.2.raw
  modified_base (210)..(210): a, c, t, g, unknown or other
  misc_feature (210)..(210): n is a, c, g, or t
  modified_base (280)..(280): a, c, t, g, unknown or other
  misc_feature (280)..(280): n is a, c, g, or t
  modified_base (297)..(297): a, c, t, g, unknown or other
  misc_feature (297)..(297): n is a, c, g, or t
tcagacgcgatcgacacgaccggtgctcgatttagatcacgtgcgtcgcggggagagaggagcccagccctgggattttcaggtgttttcatttggtgatcaggactgaacagagagaactcaccatggagtttgggctgacctggtctttttcttgtggctattttcaaaggtgtccagtgtgagatgcagttatggagtctgggggtnccttgggtccgacccggggggtctcgtgagactctcctgtgcaatttctggattcacctccaccacctancccatgagctgggtccnccaggccccggcggggaagtcgggcccggaagtcggggtcgcgagaccaagtaaacgtgggtagaagtggggtacggtaacgtttcccctacgtaccgcgaacgtaccgttcccgggtggacgggggtcccggtttacaaacccgtacgttacctacccgaagtaacgggaaccctaaagttaccggaaaagtaggtttaagttggttttaggtaaacttactaaaccgtaaaagttacgaaaaccgtaccgggtaaaggtaaaacggttacgggaaacgggtaaccgaaccggggtcccgttacttaacgtttccgttggtacgaccggtaaaacgttccccgaacccttagtacggttggcttacgtactcacgttcgttacttttaatacgttagtacgtgtaccgttacgtcgggaccg

SEQ ID NO: 327061 - DNA, 768 bp, Homo sapiens
  misc_feature: GZ8MTXP02GSWTO.45.83.H06.1.454.CMB.2.raw
tcagacgcgatcgacacgaccggtgctcgatttagatcacgtgcgtcgcgggggagagaggagcccagccctgggattttcaggtgttttcatttggtgatcaggactgaacagagagaactcaccatggagtttgggctgacctggctttttcttgtggctattttcaaaggtgtccagtgtgagatgcagttatggagtcgtggggtgccgttggtccgacccggggggtctcgtgagactctcctgtgctattctggattcacctccacccacctactcccatgacgcgtcggtcccgccaggccccggccgggggaaggggccggaagtcggggtcgcagcaataacgtgggtgagtgggtaggtaacgtttcctaccgtaccgctacgacctccggtggacggggtcccggttaccacctatccctacccgaaggtacgaactaaagttacgaaaggtagttagttggttagtactactaacaaaacgtcgaaacaccgttaaaggaaacgttccggaacgggtaaccgtaccgggtacccggtttacttaacgtttttccgaggttacggaaacccggttaaaaccggtttcccccccgtaaaccgttaagtttacggggtacggggttacctttaccgtttaaacgtccgttaaccggttacgttttaccccgttttttttaaattaacggtttttcgggttaaacgtttcggggtaaccggtttccggttaccggggggtaacccttaaaacccgggggg

SEQ ID NO: 327062 - DNA, 770 bp, Homo sapiens
  misc_feature: GZ8MTXP02IJ1FU.45.83.H06.1.454.CMB.2.raw
tcagacgcgatcgacacgaccggtgctcgatttagatcacgtgcgtcgcgggggagagaggagcccagccctgggattttcaggttgttttcatttggtgatcaggactgaacagagagaactcaccatggagtttgggctgacctggtcttttttcttgtggcttattttcaaaggtgtccagtgtgagatgctagttattgggagttcgtggggggtcgtccgttgggtcccggtacccggggggtctcgtgagactctcctgtgctaatttcgtggtacttccaccctccacccacctactcccaatgacgcgtcggtcccgccgacggccccgggaccgggggaacggggcccgggaaaggtcggggtaccgacgagaaccgtaaagttaaccggtgggtagacgttggggtacgtaaacgtttcccttaccgtaccgcaacggtaccgttcccggtaggggaccggggtcccgggtttacaacccgtacgttcccgtaccgaaggaaacgtaactaaagtttcggaaaggttaagttgttaggtttagtaacttacctaaacgtaaaagtacgaaaacctaccggttaaagaaacgggttcggaaaccggtacgtaacccgggtcgttaacctttacgtttcgaggtcgtaaaccggtaacttcccccgaacttagttacggcggtacttctttaacgctacggttcttttacctttttaggttaacgtttggacttcgggacgttcggtcggggactaaccggg

SEQ ID NO: 327063 - DNA, 755 bp, Homo sapiens
  misc_feature: GZ8MTXP02JQRZ7.45.83.H06.1.454.CMB.2.raw
tcagacgcgatcgacacgaccggtgctcgatttagatcacgtgcgtcgcgggggagagaggagcccagccctgggattttcaggtgttttcatttggtgatcaggactgaacagagagaactcaccatggagtttgggctgacctggtcttttcttgtggcttattttcaaaggtgtccagtgtgagatgctagttattggagtcgtgggggtgtccgttgggtccgacccggggggtctcgtgagactctcctgtgctatttctggattccaccctcccaccacctactcccatgacgcgtcgggtcccgccgacggccccgggaccgggggaacggggccgggaaggtcggggtccgacgaggactaaagtaaccgtgggtagagtgggtaggtaacgtttcctaccgtacgcacgacctccggtggacggggtccgttaccacctacgtcctaccgaagacgaactaaagttacgaaagtagttagttaggttacgttaatacctaaacgtaaaagtacgaaaaccgtaaccggttaaggaaaacggtccggaaacgggaccgaccggggttccccgttaatttagtttccgtaggtacggtaaccgtaaaaccggtttcccccgaaacccttaaggtacgggtcgggtaccttacgttaatccgttaccggtttcgtttaccctttttaagttaaccgttttggggtaacgttcgggtaccgttcggtaccgggggtaaccctaaacgggg

SEQ ID NO: 327064 - DNA, 677 bp, Homo sapiens
  misc_feature: GZ8MTXP02ICM69.45.83.H06.1.454.CMB.2.raw
  modified_base (258)..(258): a, c, t, g, unknown or other
  misc_feature (258)..(258): n is a, c, g, or t
  modified_base (278)..(278): a, c, t, g, unknown or other
  misc_feature (278)..(278): n is a, c, g, or t
  modified_base (330)..(330): a, c, t, g, unknown or other
  misc_feature (330)..(330): n is a, c, g, or t
  modified_base (456)..(456): a, c, t, g, unknown or other
  misc_feature (456)..(456): n is a, c, g, or t
tcagacgcgatcgacacgaccggtgctcgatttagatcacgtgcgtcgcgggggagagaggagcccagccctgggattttcaggtgttttcatttggtgatcaggactgaacagagagaactcaccatggagtttgggctgacctggctttttcttgtggctattttcaaaggtgtccagtgtgagatgcagttattggagtctgggggtgccttggtccgacccggggggtctcgtgagactctctgtgcaatttcngattcacctccaccacctancccatgagctggtccgccagcccggcggggaacgggccggaatggggtccgnagacaaataacgtggttagagtgggtaggaacgtttcctccgtacgcagacctccgtggacggggtccggttcaccatcctaccagacgaccaagttacgaaagtagtatgttagtatcctaaaanaaacgtacgaacgtaacgtaagaaacgtacggaacggtaccgtaccggttccttatttacgttcgtaggtaccggtaaccgttaaaccgttacccccgtaacgttaagttacgggtcggttaccttacgtttacgtaccgttacgtttcgtttttacctttttaacgttcggtttaggtacgttacgggtaccgttcgggtaccggggtaaccgtaccggg

SEQ ID NO: 327065 - DNA, 670 bp, Homo sapiens
  misc_feature: GZ8MTXP02IXLHU.45.83.H06.1.454.CMB.2.raw
  modified_base (260)..(260): a, c, t, g, unknown or other
  misc_feature (260)..(260): n is a, c, g, or t
  modified_base (543)..(543): a, c, t, g, unknown or other
  misc_feature (543)..(543): n is a, c, g, or t
  modified_base (612)..(612): a, c, t, g, unknown or other
  misc_feature (612)..(612): n is a, c, g, or t
tcagacgcgatcgacacgaccggtgctcgatttagatcacgtgcgtcgcgggggagagaggagcccagccctgggattttcaggtgttttcatttggtgatcaggactgaacagagagaactcaccatggagtttgggctgacctggctttttctgtggctattttcaaaggtgtccagtgtgagatgcagttatggagtcgtgggggtgccttgggtccgacccggggggtctcgtgagactctcctgtgctaatttcnggattccacctccaccacctactcccaatgacgcgtcggccgccgacgccccgggacggggaagggccggaagtggggcgacgagaccaaaataaacgtggtagagtggtaggtaaacgttccttacgtacgacgtagaccgtccggtaggacggggtcccgttacaacgtattccaccgaagaacgacaaacgttgaaagtagtatgttagtaactactaaacaaaagtcgaaaacgacgttaagaaacgtgaaacggacacggtccgtacttagtttaccngtacgacgtaaaaccgttacccgaacctaagttaacggtcggtacttacgttaaactccgtaccggttntttaaccctttttaattaacgtttgaagttcggacttcggtacgggacctaaacgggg

SEQ ID NO: 327066 - DNA, 713 bp, Homo sapiens
  misc_feature: GZ8MTXP02HBLI6.45.83.H06.1.454.CMB.2.raw
  modified_base (261)..(261): a, c, t, g, unknown or other
  misc_feature (261)..(261): n is a, c, g, or t
  modified_base (304)..(304): a, c, t, g, unknown or other
  misc_feature (304)..(304): n is a, c, g, or t
tcagacgcgatcgacacgaccggtgctcgatttagatcacgtgcgtcgcgggggagagaggagcccagccctgggattttcaggtgttttcatttggtgatcaggactgaacagagagaactcaccatggagtttgggctgacctggctttttctgtggctattttcaaaggtgtccagtgtgagatgcagttattggagtcgtgggggtgccttgggtccgacccggggggtctcgtgagactctcctgtgctaatttcnggtatcaccctccaccacctactcccatgacgctcgggtcccnccgacgccccgggaccgggggaacggggccggaagtcggggtccgcagacaaataacgtggtagagtgggtaggaacgtttcctaccgtacgctagacctcggtaggacggggtcccggttacaaccgtattcccgtaccgaagaacgtaaactaaagttccggaaagtagtatagttagtactactaaactaaagtacgaaaccgtaccgttaaggaaacgtacggaacggtaaccgaccgggtccgttacttaacgtttccgtaggtacgaacgttaaccgttaccccgtaaccgttaagttacggtcgggtaccttacgttacgacgttacggttctttacctttttaagtaaccgttttggtaacgtcgggtacgttaccggtacggggtacccgtaaaccgggg

SEQ ID NO: 327067 - DNA, 754 bp, Homo sapiens
  misc_feature: GZ8MTXP02I9FUU.45.83.H06.1.454.CMB.2.raw
tcagacgcgatcgacacgaccggtgctcgatttagatcacgtgcgtcgcgggggagagaggagcccagccctgggattttcaggtgttttcatttggtgatcaggactgaacagagagaactcaccatggagtttgggctgacctggtctttttctgtggctattttcaaaggtgtccagtgtgagatgctagttattggagtcgtgggggtcgtccgttcgggtccggacccggggggttctcgtgagactctcctgtgactatttctggtacttccacctccaccctacctactcccaatcgagtccgtcgggtcccgccgacggccccgggaccgggggaacggggcccggaaggtcggggtccgacgagaccaaagttaacggtggtagagtgggttaggtaacgtttcctccgacgctacgaccgtcggtacggacggggtccgtccaacctatcctacgacgacgaactaagtacgaaagtagtcgttagtagtactacctaaaactaagaacaccgtaacgaaagtacggaaggacgaacggccgtacccggtatttacgttacgtcgtacgtaaacggttaacccgttaccccgtaaacttacgttacggggtcggttacctttaacgtacccgttaaacgttccggttacctttttaacctttttaaggttttaaccggtttaaagttttcgggacggttaccgggttccgggggtacggtaaaacccgggggtttaaccccggg

SEQ ID NO: 327068 - DNA, 805 bp, Homo sapiens
  misc_feature: GZ8MTXP02GAA2H.45.83.H06.1.454.CMB.2.raw
tcagacgcgatcgacacgaccggtgctcgatttagatcacgtgcgtcgcgggggagagaggagcccagccctgggattttcaggtgttttcatttggtgatcaggactgaacagagagaactcaccatggagtttgggctgacctggtctttttcttgtggcttattttcaaaggtgtccagtgtgagatgctagttatggagtcgtgggggtgccgttggtccgaccgggggtctcgtgagactctcctgtgctattctggattcaccctccaccacctactcccatgacgcgtcgggtcccgccgacggcccgggaccgggggaaacggggcccgggaaaggtcggggtaccgccgaaggacgaaagttaaccgtgggtaggacgttggggtaggtaaacgtttcccttccgtaaccgctacggaccgttcccggtaggggacggggtcccggttacaaccgtacttccgtacccgaagacgtaacctaaagttccggaaagtagttagttagttagtaattaccgtaaactaaagttcgaaaacccgtacccgggtaaagtaaaacggttacgggaacgggtaaccgtaacccggggtcccggtttactttaacgtttaccgtaggttaccggtaaaccggtaaaaccgttcccccggaacctttaaggtaacgggttcgggtacctttacgtttacgtcccgttaaacggtttccgtttaccttttttaacgttaaccgttttagggttaacggttacggggtacccgtttcgggtacgggggtaacccgtttaaccgggg

SEQ ID NO: 327069 - DNA, 706 bp, Homo sapiens
  misc_feature: GZ8MTXP02FR3J7.45.83.H06.1.454.CMB.2.raw
  modified_base (341)..(341): a, c, t, g, unknown or other
  misc_feature (341)..(341): n is a, c, g, or t
  modified_base (388)..(388): a, c, t, g, unknown or other
  misc_feature (388)..(388): n is a, c, g, or t
  modified_base (521)..(521): a, c, t, g, unknown or other
  misc_feature (521)..(521): n is a, c, g, or t
tcagacgcgatcgacacgaccggtgctcgatttagatcacgtgcgtcgcgggggagagaggagcccagccctgggattttcaggtgttttcatttggtgatcaggactgaacagagagaactcaccatggagtttgggctgacctggctttttctgtggctattttcaaaggtgtccagtgtgagatgcagttatggagtcgtgggggtgccgttggtccgacccggggggtctcgtgagactctcctgtgctaattctggtacttcaccctccaccacctactcccatggacgcgtcggtcccgcacggcccggaccggggaagggccggaagtggggcncatacaaatacgtggtgagtgggtaggtaaacgtttcctactaccgnacgtacgtccgtaggacggggtccgtcacctatcctccaagacgaaactaacgttacgaaaggtgtaattggttagtaactacgtaaacaaatacgaaaaccctacgtaaaggaaacggtcgaacgggaaccnccgggtacgttacttaacgtttctaggtcgtaaaccgtaaccggttacccgaacccgttaagtacggtacggtctttacccttaaagtccgtaaacgtttccgtttaccttttttaaagttaacggttttacggtaaggttcgggtaccggtttaacggtccggggaacccggttaaacccgggg

SEQ ID NO: 327070 - DNA, 713 bp, Homo sapiens
  misc_feature: GZ8MTXP02HB0RF.45.83.H06.1.454.CMB.2.raw
  modified_base (300)..(300): a, c, t, g, unknown or other
  misc_feature (300)..(300): n is a, c, g, or t
  modified_base (564)..(564): a, c, t, g, unknown or other
  misc_feature (564)..(564): n is a, c, g, or t
tcagacgcgatcgacacgaccggtgctcgatttagatcacgtgcgtcgcgggggagagaggagcccagccctgggattttcaggtgttttcatttggtgatcaggactgaacagagagaactcaccatggagtttgggctgacctggctttttctgtggctattttcaaaggtgtccagtgtgagatgcagttattggagtcgtgggggtgccttggtccgacccggggggtctcgtgagactctcctgtgctaatttctggattccaccctccaccacctatcccatgagctggtcccnccacgccccggccggggaagggccggaagtcggggtcgcgagcaaataacgtgggtagagtgggtaggtaaacgtttcctaccgtacgcaagtaccgtccggtggacggggtcccggttcaacccgtatcccgtaccgaaggacgaacctaaagttccggaaaagtagtaagttgttagtaattacctaaacaaaattcgaaaaccaccggttaagaaaagttccggaaaggaccgaccgggtacccgttattaacgtttccgnggtacgaacggttaaaacgttcccccggaacttaagtacggtcgggtacttccttagtaccgtaacggttcgtttaccctttttttaagtaaccgttttagggtaacttcggggaaccgttcggttacgggggaaccctaaaccggggg

SEQ ID NO: 327071 - DNA, 757 bp, Homo sapiens
  misc_feature: GZ8MTXP02GJCDX.45.83.H06.1.454.CMB.2.raw
  modified_base (665)..(665): a, c, t, g, unknown or other
  misc_feature (665)..(665): n is a, c, g, or t
tcagacgcgatcgacacgaccggtgctcgatttagatcacgtgcgtcgcgggggagataggagcccagccctgggattttcaggtgttttcatttggtgatcaggactgaacagagagaactcaccatggagtttgggctgacctggctttttcttgtggctattttcaaaggtgtccagtgtgagatgcagtttattggagttcgtgggggtgtccgttgggtcccggacccgggggggttctcgtggagactctcctgtgctaatttcgtggacttccaccctccaccacctatcccatgacgcgtcgggtcccgccgacggcccgggccgggggaaacggggcccgggaaaggtcggggtccgcgagactaaacgtaacgtgggtaggtacgttggggtaggtaaacgtttcctccgtaccgcacgtaccgttccggtgggaccggggttcccggttacaacccgtagtccctacccgaaggaaacgaaccgtaaaagttccggaaaagtagttaattggtttacgtatacctaaataaagtcgaaacctacggtaagaaaggtcgaacggaccacgggtaccgttacttacgtttcgtaggtacgaccgtaaaccgtttccccgaaaccttagttacgggtccggtacttacgtttaaacnccgttaaccggtttctttaccgtttttttaacgttcggtttttaaggtacgttacggggaccgttcggtacgggggtaccgtaaaccggggg

SEQ ID NO: 327072 - DNA, 695 bp, Homo sapiens
  misc_feature: GZ8MTXP02HMHO9.45.83.H06.1.454.CMB.2.raw
  modified_base (584)..(584): a, c, t, g, unknown or other
  misc_feature (584)..(584): n is a, c, g, or t
tcagacgcgatcgacacgaccggtgctcgatttagatcacgtgcgtcgcgggggagagaggagcccagccctgggattttcaggtgttttcatttggtgatcaggactgaacagagagaactcaccatggagtttgggctgacctggtctttttcttgtggctattttcaaaggtgtccagtgtgagatgcagttattggagtcgtgggggtgtccgttgggtccggacccggggggtctcgtgagactctcctgtgctaatttcgtggtattccaccctccaccctacctactcccatgacgcgtcgggtccgccgacggccccgggaccgggggaacggggccgggtaaggtcggggtaccgacgaggaccgtaaaattaaccggtggtagtagtggggttaggtaaacgtttccttacccgtaccgacgtacgtaccgttccggtagggaccggggtcccgttccacctaattccctaccgagaacgaacctaaagttacgaaagtagtattggtttagactactaaacaaatacgaaactacgtaaagaaagtcggaagaccgcggtccgtattagttcnggtacgacgtaacgttcccgactacgtagtcggtcttacttacgtctacggttcttactttttagttaaccgtttggtacgtacggtacgtcggacgggtaccgtaacggg

SEQ ID NO: 327073 - DNA, 868 bp, Homo sapiens
  misc_feature: GZ8MTXP02JNRQS.45.83.H06.1.454.CMB.2.raw
  modified_base (261)..(261): a, c, t, g, unknown or other
  misc_feature (261)..(261): n is a, c, g, or t
tcagacgcgatcgacacgaccggtgctcgatttagatcacgtgcgtcgcgggggagagaggagcccagccctgggattttcaggtgttttcatttggtgatcaggactgaacagagagaactcaccatggagtttgggctgacctggtctttttctgtggctattttcaaaggtgtccagtgtgagatgcagttattggagtcgtgggggtgccgttgggtccgacccggggggtctcgtgagactctcctgtgctattcnggtactcaccctccacccacctactcccatgacgtcgtcgggtcccgaccgacggccccggggaccggggggaacggggcccgggtaaaggtcggggtccgacgacggaaccaaagttaaaccgtggggtagtaggttaggggtaggtaaaccggtttccctttaccccgtacgccgtaacggtacccgttccggggtacggggtaacgggggtcccccgtttaccaacccgtacgttcccgtacccgaaggaacgtaaacgtaaacgtttaccggaaaaggtagttaagttggtttacgttaacttacctaaaacgtaaaacttacgaaacccgtaaacccggttaaaggtaaaaccggtcgggaaaacgggtaacccgtacccggggtaccccgtttaatttaactttccgggttaacggtaaccggtaccggttaaaacccggtttcccccgaacccgttaagttaacggggttccgggttacccttaccgggtttaactcccggttaaacgttttccggttttaccccttttttaagtttaacccgtttgggttaaacttcgggggtaaccgttcggtacccgggggactttaaacccggggg

SEQ ID NO: 327074 - DNA, 593 bp, Homo sapiens
  misc_feature: GZ8MTXP02HDDUU.45.83.H06.1.454.CMB.2.raw
  modified_base (481)..(481): a, c, t, g, unknown or other
  misc_feature (481)..(481): n is a, c, g, or t
  modified_base (490)..(490): a, c, t, g, unknown or other
  misc_feature (490)..(490): n is a, c, g, or t
  modified_base (526)..(526): a, c, t, g, unknown or other
  misc_feature (526)..(526): n is a, c, g, or t
  modified_base (536)..(536): a, c, t, g, unknown or other
  misc_feature (536)..(536): n is a, c, g, or t
tcagacgcgatcgacacgaccggtgctcgatttagatcacgtgcgtcgcgggggagagaggagcccagccctgggattttcaggtgttttcatttggtgatcaggactgaacagagagaactcaccatggagtttgggctgacctggctttttcttgtggctattttcaaaggtgtccagtgtgagatgcagttattggagtcgtgggggtgccttgggtccgacccggggggtctcgtgagactctcctgtgctaatttctggattccacctcccaccacctatcccatgagctggtccgccagcccggaccggggaacgggccggaagtggggtcgcgagcaagtaacgtggtgagtggtaggaacgttcctcgtacgcagactcggtggacggggtccggttcaccatcctccagacgactaagttcgaaagtgtatgttagtatctaataaatgaaacacgtagaaagtcgaggacncggaccgtntagttcgagtcgacgtaacgttcccgacctgtacgnggtctcttanctacgtacgttccttttaatcgtttggtactcggtacgtcgtcgggaccgtaacggg

SEQ ID NO: 327075 - DNA, 979 bp, Homo sapiens
  misc_feature: GZ8MTXP02GJLSK.45.83.H06.1.454.CMB.2.raw
tcagacgcgatcgacacgaccggtgctcgatttagatcacgtgcgtcgcgggggagagaggagcccagccctgggattttcaggtgttttcatttggtgatcaggactgaacagagagaactcaccatggagtttgggctgacctggtctttttctgtggctattttcaaaggtgtccagtgtgagatgctagttatggagtcgtggggtcgccgttcggtccgaccggggggtctcgtgacgactctcctgtgctattctgtactccacctccacctacctactcccatgacgcgtcggtcccgccgacggcccgggaccgggggaacggggaccgggaagtcggggcgacgagactaacgtaacgtggtagaggtaggggtaggaacgtttccttaccgtaccgacgtacggtaccgttccgggtacggggtaccgggggtcccggtttaccaaaccgtaccttcccgtacccgaaagggtaaaccgtaaacgttaaaacgtttaccggaaaaaggtttacggttaacggtttaaggggttttaacgttaaaacccttaaccccggttaaaaaagtaaaaaacccggtttacgaaaaaaccccggttaacccgggtttaaaaggggaaaaacggttaccgggggaaaacccgggtaaccccggtaaaccccggggtttcccggttttaactttaaacgttttcccggttacgggttaaccggtaaaaccccgggtttaaaacccccggtttcccccggaaaaccccgttttaaggtttaacgggggtttcccgggtttaccttttaaaccggtttttaaaccgttcccggtttaaccgggttttaccgtttttttaaacccctttttttttaaaacggttggggttttttaacgggttaaaccggggtttccggggttaacccggggtttaccgggggtacccggggggttaacccccggtttaaaaacccgggggg

SEQ ID NO: 327076 - DNA, 603 bp, Homo sapiens
  misc_feature: GZ8MTXP02J2OMJ.45.83.H06.1.454.CMB.2.raw
  modified_base (188)..(188): a, c, t, g, unknown or other
  misc_feature (188)..(188): n is a, c, g, or t
  modified_base (268)..(268): a, c, t, g, unknown or other
  misc_feature (268)..(268): n is a, c, g, or t
  modified_base (275)..(275): a, c, t, g, unknown or other
  misc_feature (275)..(275): n is a, c, g, or t
  modified_base (320)..(320): a, c, t, g, unknown or other
  misc_feature (320)..(320): n is a, c, g, or t
  modified_base (545)..(545): a, c, t, g, unknown or other
  misc_feature (545)..(545): n is a, c, g, or t
tcagacgcgatcgacacgaccggtgctcgatttagatcacgtgcgtcgcgggggagagaggagcccagccctgggatttcaggtgttttcatttggtgatcaggactgaacagagagaactcacccatggagtttgggctgacctggcttttcttgtggctattttcaaaggtgtccagtgtgagatncagttattggagtctggggtgcctggtccacccggggggtctctgagactctcctgtgctaatttctggatccacctccncacctancccatgagctggccgcagccgccggggagggccggaatgggcgcngacaataacgtggtgagtggtggaacgttcctacctacgcacgaccgtccggtaggacggggccggtttacacccagtcctccagagaacaaattcgaaagatatgtagtatactaacaaaatgaaaactaccgtagaaaacgttccgagaaccgccgggaccgttctaagtttcagtgaaccgtaaaacgtttcccccgacttaagtacgtggccttacttaancctaacggttctacctttttataacgttgtaactggactcgtagggaccctaacgggg

SEQ ID NO: 327077 - DNA, 772 bp, Homo sapiens
  misc_feature: GZ8MTXP02JC2A4.45.83.H06.1.454.CMB.2.raw
  modified_base (290)..(290): a, c, t, g, unknown or other
  misc_feature (290)..(290): n is a, c, g, or t
tcagacgcgatcgacacgaccggtgctcgatttagatcacgtgcgtcgcgggggagagaggagcccagccctgggattttcaggtgttttcatttggtgatcaggactgaacagagagaactcaccatggagtttgggctgacctggtcttttctgtggcttattttcaaaggtgtccagtgtgagatgctagttatggagtcgtggggtcgccgttcggtccgaccgggggtctcgtgacgtacctctcctgtgacttaattctggtatccaccctccacctacctacncccatgacgcgtcggccgcgacgccggacggggacgggccggagtggcgacgagacgtaaacgtacggtggtagtacggtgggtacgggtaacgtttccctacgtaccgacgtacggtacgttccgggacgggacggggtccccggtttacaaccctacgttaccgaccgaaaggtaaccgaacgttaaaccgttacggggaaaattaacgggttaagtttgtttacggttaaaacttcccggaaaaactaaagttaacggaaaaccctacgggtaaaaggtaaaccgttcgggaaaacgtaccgaacccgggttcctttactaagtttcgtacggtacgtaaacggttaaccccgttccgaaccgttagttaccgggtcggttcctaacgttaaacgttcctacggtttaaccttttcggttttaaacttcgggttagttacgtcggggtaacgttccggtacgggggtaaacctcccggg

SEQ ID NO: 327078 - DNA, 693 bp, Homo sapiens
  misc_feature: GZ8MTXP02FKX06.45.83.H06.1.454.CMB.2.raw
  modified_base (347)..(347): a, c, t, g, unknown or other
  misc_feature (347)..(347): n is a, c, g, or t
tcagacgcgatcgacacgaccggtgctcgatttagatcacgtgcgtcgcgggggagagaggagcccagccctgggattttcaggtgttttcatttggtgatcaggactgaacagagagaactcaccatggagtttgggctgacctggctttttctgtggctattttcaaaggtgtccagtgtgagatgcagttattggagtcgtgggggtgccgttgggtcccgacccgggggggtctcgtggagactctcctgtgctaattctggattcaccctccaccacctactcccatgagcgtcgggtcccgccaggcccggccgggggaaggggcccgggaagtcggggcnccgagcaaataacgtggtgatgggaggtaacgttcctccgtacgcaggacctccggtggacggggtcccggttcaacccatccgtccgaagtacgaactaaacgttacgaaagagttattggttcgtaatcctaaactaaatcgaaaccaccggtaagtaaacgtcgggaacggaccgacgggtaccccgttatacgtttctagtcggacgtaaaaccgttcccgtaaccccgtaagtacggtcgggctttacgttaagtcctacggttacttcccgttttttaaattaaccgtttacggttaattcggggtaaccgtttcggtacgggggaccttaaaccggggg

SEQ ID NO: 327079 - DNA, 815 bp, Homo sapiens
  misc_feature: GZ8MTXP02I76XT.45.83.H06.1.454.CMB.2.raw
  modified_base (268)..(268): a, c, t, g, unknown or other
  misc_feature (268)..(268): n is a, c, g, or t
  modified_base (310)..(310): a, c, t, g, unknown or other
  misc_feature (310)..(310): n is a, c, g, or t
tcagacgcgatcgacacgaccggtgctcgatttagatcacgtgcgtcgcgggggagagaggagcccagccctgggattttcaggtgttttcatttggtgatcaggactgaacagagagaactcaccatggagtttgggctgacctggtctttttctgtggctattttcaaaggtgtccagtgtgagatgctagttattggagtcgtgggggtcgccgttgggtcccggaccggggggttctcgtgagtactctcctgtgctaatttcnggtacttccacctccaccactactcccatgagcgtggtcccncgacggccggaccgggggaagggccggaagtcggggtccgcgaacgactaaaacgtaacgtgggtagaagtggggttagtaaacggtttcccttaccgtaccgcgtaacgtcccgttaccgggtacggaccgggggtcccgttaccaaccccggtaatcccgttacccgaaaggaacgtaaaccctaaacgtttaccggaaaaggtacgttaaagtttgggtttaacgttaaacctttacctaaaacgttaaaaacgttacggtaaaacccgtaacccgggttaaaggtaaaaacggttccgggaaacggttacccgaacccggggtccctttaacgttaccgtttcgtacgtacggtaaaaccgttaaccggttaccccctaacgttacgtacgggtacggtaccttactttaacgcgttaccggttcgtttacccttttttaaagtccggttttggtaacgttcgggtaccgtacggggttacggggaaccgttaaaccgggg

SEQ ID NO: 327080 - DNA, 734 bp, Homo sapiens
  misc_feature: GZ8MTXP02HEF7A.45.83.H06.1.454.CMB.2.raw
  modified_base (293)..(293): a, c, t, g, unknown or other
  misc_feature (293)..(293): n is a, c, g, or t
tcagacgcgatcgacacgaccggtgctcgatttagatcacgtgcgtcgcgggggagagaggagcccagccctgggattttcaggtgttttcatttggtgatcaggactgaacagagagaactcaccatggagtttgggctgacctggtctttttcttgtggcttattttcaaaggtgtccagtgtgagatgctagttattggagtcgtgggggtgtccgttggtcccggacccggggggtctcgtgagactctcctgtgctaatttcgtgtattccaccctccaccacctacncccatgacgcgtcgggtccccgccgacggccccggggaccgggggaacggggacccgggtaaaggtcggggtccgacgacgacaaagttaacgtgggtagagttgggtaggtaacgtttcctaccgtacgctaggtcctcggtaggacggggtcccgttaccacctactccgtaccaagagaactaaagttacgaaagtagttagttagttagtaatacgtaaactaaagtacgaaaacctaccggtaaaggtaaacggtacggaacggtaaccgtaccgggtccttacgttaacgtttcgtaggtacgtaaccggtaaaaccgttccccgaaaccgttagtaacggtcggtcctttacgttactcgtacgtttacgtttcctttttaacgttcgtttaggtacgttcgggtaaccgtcggtacggggtaccgtaaccggg

SEQ ID NO: 327081 - DNA, 701 bp, Homo sapiens
  misc_feature: GZ8MTXP02IW0WU.45.83.H06.1.454.CMB.2.raw
  modified_base (272)..(272): a, c, t, g, unknown or other
  misc_feature (272)..(272): n is a, c, g, or t
  modified_base (444)..(444): a, c, t, g, unknown or other
  misc_feature (444)..(444): n is a, c, g, or t
  modified_base (574)..(574): a, c, t, g, unknown or other
  misc_feature (574)..(574): n is a, c, g, or t
tcagacgcgatcgacacgaccggtgctcgatttagatcacgtgcgtcgcgggggagagaggagcccagccctgggattttcaggtgttttcatttggtgatcaggactgaacagagagaactcaccatggagtttggctgacctggctttttctgtggctattttcaaaggtgtccagtgtgagatgcagttattggagtcgtgggggtgccgttcgggtcccggacccgggggggttctcgtggagtaccgtctcctgtgcctaatttcgnggtacttccaccctcccacccacctactcccatgacgcgtcgggtccccgccgacggccccgggcgggggaacgggccgggaagtcggggtcaccgagacaaataacgtggtagagtggtaggtaacgttcctccgtacgctagccgtcgtgggacgggtccgttcaacctntccctaccgagtaacgaactaaacgttacgaaaagtagtagttggttaagtacttaactaaactaaagtacgaaaacgtaccgttaaaggaaacgtcgaacgggactacccgggcgttactagtttccgnggtacgaacgtaacgttcccacgtagtacggtacggtcttacgttactacgtacgttacgtttcctttttaagttaacgtttcgggtaaattcgggacggtttcggtacggggacccttaaacgggg

SEQ ID NO: 327082 - DNA, 756 bp, Homo sapiens
  misc_feature: GZ8MTXP02ISRP6.45.83.H06.1.454.CMB.2.raw
  modified_base (214)..(214): a, c, t, g, unknown or other
  misc_feature (214)..(214): n is a, c, g, or t
  modified_base (264)..(264): a, c, t, g, unknown or other
  misc_feature (264)..(264): n is a, c, g, or t
tcagacgcgatcgacacgaccggtgctcgatttagatcacgtgcgtcgcgggggagagaggagcccagccctgggattttcaggtgttttcatttggtgatcaggactgaacagagagaactcaccatggagtttgggctgacctggtctttttcttgtggcttattttcaaaggtgtccagtgtgagatgctagttatggagtcgtgggggtnccgttggtcccgacccgggggtctcgtgagactctcctgtgctaatttcngtattccaccctccacccacctactcccatgacgcgtcgggtcccgccgacggccccgggaccgggggaacggggccggtaaggtcggggccgacgacgactaaagtaacgtgggtagtaggtgggtacggtaacgtttcctaccgtacgcgacgtaccgtccggtagggaccggggtcccgttacaacccgtacttaccctacccgaaggaaacgtaaaccgtaaagtttaccggaaaagttaagttagttacgtttaagtaacttacctaaaactaaagtaccgaaaaccgtaccggttaaagaaaacggttccggaaacggtaccgaccgggtccttacttacgttccgtaggtacgtaaacgtaaacccgttccccgtaactaagttacggtcggtaccttcgttaactaccgtcggtttactttacctttttaagtaacgtttggtacttacgggccgtttacggtaccggggtaacgtaaccgggg

SEQ ID NO: 327083 - DNA, 605 bp, Homo sapiens
  misc_feature: GZ8MTXP02GWROD.45.83.H06.1.454.CMB.2.raw
  modified_base (259)..(259): a, c, t, g, unknown or other
  misc_feature (259)..(259): n is a, c, g, or t
  modified_base (285)..(285): a, c, t, g, unknown or other
  misc_feature (285)..(285): n is a, c, g, or t
  modified_base (293)..(293): a, c, t, g, unknown or other
  misc_feature (293)..(293): n is a, c, g, or t
  modified_base (385)..(385): a, c, t, g, unknown or other
  misc_feature (385)..(385): n is a, c, g, or t
  modified_base (400)..(400): a, c, t, g, unknown or other
  misc_feature (400)..(400): n is a, c, g, or t
  modified_base (408)..(408): a, c, t, g, unknown or other
  misc_feature (408)..(408): n is a, c, g, or t
  modified_base (415)..(415): a, c, t, g, unknown or other
  misc_feature (415)..(415): n is a, c, g, or t
  modified_base (422)..(422): a, c, t, g, unknown or other
  misc_feature (422)..(422): n is a, c, g, or t
  modified_base (430)..(430): a, c, t, g, unknown or other
  misc_feature (430)..(430): n is a, c, g, or t
  modified_base (434)..(434): a, c, t, g, unknown or other
  misc_feature (434)..(434): n is a, c, g, or t
  modified_base (445)..(445): a, c, t, g, unknown or other
  misc_feature (445)..(445): n is a, c, g, or t
tcagacgcgatcgacacgaccggtgctcgatttagatcacgtgcgtcgcgggggagagaggagcccagccctgggattttcaggtgttttcatttggtgatcaggactgaacagagagaactcaccatggagtttgggctgacctggctttttcttgtggctattttcaaaggtgtccagtgtgagatgcagttattggagtctgggggtgccttggtccgacccggggggtctcgtgagactctcctgtgcaatttcnggattcactccaccacatcccatganctggtccnccagcccgccggggaaaggggccggaagtggggtcgacaggaccaaataaacctggtgaatggtaggaaagttcctctacgcagactccgtnaggggccgttcacanctccaganacatcanagatgtntatacaanaaanagaacacgtanaaagtagaagaacgacggtactactaattcgtagtacgaacgtaaacgttacccgaaccttaagtacgtcggtacttacgttaactcgtacgttcgttaccttttaactttaacgtttacggttacgttacggtacggtacgtacgggtacggtaaacgg

SEQ ID NO: 327084 - DNA, 756 bp, Homo sapiens
  misc_feature: GZ8MTXP02IIDS1.45.83.H06.1.454.CMB.2.raw
  modified_base (265)..(265): a, c, t, g, unknown or other
  misc_feature (265)..(265): n is a, c, g, or t
  modified_base (566)..(566): a, c, t, g, unknown or other
  misc_feature (566)..(566): n is a, c, g, or t
tcagacgcgatcgacacgaccggtgctcgatttagatcacgtgcgtcgcgggggagagaggagcccagccctgggattttcaggtgttttcatttggtgatcaggactgaacagagagaactcaccatggagtttgggctgacctggtctttttcttgtggcttattttcaaaggtgtccagtgtgagatgctagttattggagtcgtgggggtgccgttggtccgacccggggggtctcgtgagactctcctgtgctaatttcnggtacttccaccctccacctacctactcccatgagtcgtcgggtcccgccgacggccccgggaccgggggtaacggggccggtaaaggtcggggtaccgacgaaggaccaaaacgtaaacgtggggtacgtaagttggggtaggtaaacggtttccttacccgtaacggctaacgaccgttccgggttacgggacggggtcccgggtttaccaaccgtacgttccctaccgaaggacgtaaactaaacgttacgaaagttagtagttagttagttactactaaactaaaagtcgaaaaccncgtaagaaacggtcggaacggtaccgacggtccgttacttacgttacgtggtacgaacggttaaaccgttacccgaaccgttagttaacggtcggtcttacgttaacgtacctacggttactttaccctttttaagttaacgtttacgtacgttcggtaacggttcggttacggggaaccctaaccgggg

SEQ ID NO: 327085 - DNA, 726 bp, Homo sapiens
  misc_feature: GZ8MTXP02J25BB.45.83.H06.1.454.CMB.2.raw
  modified_base (259)..(260): a, c, t, g, unknown or other
  misc_feature (259)..(260): n is a, c, g, or t
  modified_base (265)..(265): a, c, t, g, unknown or other
  misc_feature (265)..(265): n is a, c, g, or t
  modified_base (283)..(283): a, c, t, g, unknown or other
  misc_feature (283)..(283): n is a, c, g, or t
tcagacgcgatcgacacgaccggtgctcgatttagatcacgtgcgtcgcgggggagagaggagcccagccctgggattttcaggtgttttcatttggtgatcaggactgaacagagagaactcaccatggagtttgggctgacctggtctttttctgtggcttattttcaaaggtgtccagtgtgagatgctagttattgggagtcgtggggtcgtccgttgggtcccggtaccgggggtctcgtgacgactctctgtnntattngatcacctccaccactcnccatgagcgtcggtccgccggacggcccgggacggggaacgggccggtaagtcggggtacacggagacgtaacgtacgtggtagaggtggtacggtacttccgttaccgacgcacggtacggtccggagggacgggtccgtacaacttccgacttccgacaaggacaaacttaaacggttaagaaagttacgttagttaggttactactaacctaaacaaagtccgaaactacggtagaaccgtacgacgaacctcccggggttactttacttaggtttacgtcggtaacggttaacggtaaaccccgttcccggaacctttagggtaccgttcggtaccccttatttaccggactttaccgggttttcccttttaacgtttttaacgttaaacggtttggacggttaacggggttccgtaacggggtccgggtaaacccggg

SEQ ID NO: 327086 - DNA, 691 bp, Homo sapiens
  misc_feature: GZ8MTXP02JCSJN.45.83.H06.1.454.CMB.2.raw
  modified_base (261)..(261): a, c, t, g, unknown or other
  misc_feature (261)..(261): n is a, c, g, or t
  modified_base (281)..(281): a, c, t, g, unknown or other
  misc_feature (281)..(281): n is a, c, g, or t
  modified_base (634)..(634): a, c, t, g, unknown or other
  misc_feature (634)..(634): n is a, c, g, or t
tcagacgcgatcgacacgaccggtgctcgatttagatcacgtgcgtcgcgggggagagaggagcccagccctgggattttcaggtgttttcatttggtgatcaggactgaacagagagaactcaccatggagtttgggctgacctggtcttttcttgtggcttattttcaaaggtgtccagtgtgagatgcagttattggagtcgtggggtgccgttcggtccgacccgggggtctcgtgagactctcctgtgctatttcngattcacctccaccactacncccatgagcgtcggaccgccgacggccccggaccgggggaagggcccgggaagttcggggccgaccgaggacaaacgtaacgtgggtagaggtgggtaggtaaacgtttcctaccgtacgacagtaccgttccggtaggaacggggtcccggttaccaaccgacgttccgaccgaaggaacgtaaactaaacgtttcgaaaacgtaagttagttaggtttacgttaataaccgtaaactaaagttaacgaaaccgtaccggttaaagaaacggtacgaacggacaccgggtcccgttattacgttcgagtacgacgtaaaccgttcccaacgtagtaggtcggtctacgttanctacgttcgttccttttaatcgttagtacgtcggtacgtcgtacggggactaacggg

SEQ ID NO: 327087 - DNA, 789 bp, Homo sapiens
  misc_feature: GZ8MTXP02FTLRH.45.83.H06.1.454.CMB.2.raw
tcagacgcgatcgacacgaccggtgctcgatttagatcacgtgcgtcgcgggggagagaggagcccagccctgggattttcaggtgttttcatttggtgatcaggactgaacagagagaactcaccatggagtttgggctgacctggctttttcttgtggctattttcaaaggtgtccagtgtgagatgcagttattggagtcgtgggggtgccgttgggtccgacccggggggtctctgagactctcctgtgctaattctggattcaccctccaccacctatcccatgagcgtcgggtcccgccacggcccggccgggggaaggggcccgggaaagtcggggtcgaccaggacaaagtaacgtgggtgtaagtggggtaggtaaacggtttccttaccgtaccgccgaaggtaccttccggtagggtaacgggggtcccggttacaaacccgtattacccgtaccgaaggaacaacgtaaaacgttcgaaaaggtagttaagtggtttagtaacttactaaactaaaagtcgaaaaccgtaccggttaaaggaaaacggttcggaaacgggaccgtaacccgggtcccggttaacttaacgttttctagggtacggtaaccggtaaaaccgttcccccggtaaaccctagtaacgggttacggggtcctttaaccgtttagtacccgttaacgggttccgtttaccctttttttaaagttaacccggttttaggttaacgtacgggggttacctttcggggtaccgggggtacccgtaaaaccggggg

SEQ ID NO: 327088 - DNA, 636 bp, Homo sapiens
  misc_feature: GZ8MTXP02JEKN3.45.83.H06.1.454.CMB.2.raw
  modified_base (175)..(175): a, c, t, g, unknown or other
  misc_feature (175)..(175): n is a, c, g, or t
  modified_base (191)..(191): a, c, t, g, unknown or other
  misc_feature (191)..(191): n is a, c, g, or t
  modified_base (451)..(451): a, c, t, g, unknown or other
  misc_feature (451)..(451): n is a, c, g, or t
  modified_base (466)..(466): a, c, t, g, unknown or other
  misc_feature (466)..(466): n is a, c, g, or t
  modified_base (566)..(566): a, c, t, g, unknown or other
  misc_feature (566)..(566): n is a, c, g, or t
tcagacgcgatcgacacgaccggtgctcgatttagatcacgtgcgtcgcgggggagctgctcagttaggacccagagggaaccatggaaaccccagcgcagcttctcttcctcctgctactctggctccagaaagtactggagagagtgtgttgacgcagtctccaggcaccctntctttgctcagggaangcaacctctcctgcaggaccaccagagtgttaggagcaatcacttagcctaggtaccagacaacggaaacctggaccaggtacctaccgaaaacgccttacctacgaattaccgtaacggggtcactaacgttacccgaagggttacgggccctcgtgggacctacgtacccgaagtaccgtaggttccaggttcgaccgtaggtcgggtactagggactacgcttcgactccgtacaccagtaccaacgtagttacggntccgtaagtaacgtnttttgaccttgtactttattacgtcgtactagttacttgttacggtttcctactttccgtttcgtcgttcgttaccgccgttagacctagtacggttaanaacgtaacgtaaacgacgttggtacgctacgctaacctaagtcttacgtcttacacgtttcctaccgtac

SEQ ID NO: 327089 - DNA, 721 bp, Homo sapiens
  misc_feature: GZ8MTXP02I0YNY.45.83.H06.1.454.CMB.2.raw
  modified_base (263)..(263): a, c, t, g, unknown or other
  misc_feature (263)..(263): n is a, c, g, or t
  modified_base (315)..(315): a, c, t, g, unknown or other
  misc_feature (315)..(315): n is a, c, g, or t
tcagacgcgatcgacacgaccggtgctcgatttagatcacgtgcgtcgcgggggagagaggagcccagccctgggattttcaggtgttttcatttggtgatcaggactgaacagagagaactcaccatggagtttgggctgacctggtctttttcttgtggctattttcaaaggtgtccagtgtgagatgcagttattggagtcgtgggggtgccgttggtccgacccggggggtctctgacgactctcctgtgctaatttcnggtatccaccctcccaccctacctactaccctagtgacgcgtcgggtacccnccgacggcccgggaccggggaacggggccggtaagtcgggtaccgcacggacaaagtaacgtggtagtagtggtacggtaacgtttcctactaccggactaagtcctcccgggttaggaacgggggtccgttaccaccgtaactcctaccgaaggaaacgaactaaacgttagaaagtagtaacgtttaggttatacgtactaaacaattaacgaaactacgttaagaaacgacggtaagaaccgaccggtacggttacttacgtttccgtggtacgtaacgtaaacgttaccccgtaacgtaacgttaggtcggtacttcgttacttacgtacgttcgtttacctttttacgttaacgtttagggtacttacggggtacttacggcgggggtacctaaaccgggg

SEQ ID NO: 327090 - DNA, 446 bp, Homo sapiens
  misc_feature: GZ8MTXP02G3P3X.8.65.F10.1.454.CMB.2.raw
  modified_base (284)..(284): a, c, t, g, unknown or other
  misc_feature (284)..(284): n is a, c, g, or t
  modified_base (293)..(293): a, c, t, g, unknown or other
  misc_feature (293)..(293): n is a, c, g, or t
  modified_base (298)..(298): a, c, t, g, unknown or other
  misc_feature (298)..(298): n is a, c, g, or t
  modified_base (339)..(339): a, c, t, g, unknown or other
  misc_feature (339)..(339): n is a, c, g, or t
  modified_base (351)..(351): a, c, t, g, unknown or other
  misc_feature (351)..(351): n is a, c, g, or t
  modified_base (359)..(359): a, c, t, g, unknown or other
  misc_feature (359)..(359): n is a, c, g, or t
  modified_base (367)..(367): a, c, t, g, unknown or other
  misc_feature (367)..(367): n is a, c, g, or t
  modified_base (373)..(373): a, c, t, g, unknown or other
  misc_feature (373)..(373): n is a, c, g, or t
  modified_base (375)..(375): a, c, t, g, unknown or other
  misc_feature (375)..(375): n is a, c, g, or t
  modified_base (405)..(405): a, c, t, g, unknown or other
  misc_feature (405)..(405): n is a, c, g, or t
  modified_base (441)..(446): a, c, t, g, unknown or other
  misc_feature (441)..(446): n is a, c, g, or t
tcagctcgcgtgtccacgaccggtgctcgatttagctacgctctaagggggtcggatgacgtggccattctttgcctaaagcattgagtttactgcaaggtcagaaaagcatgcaaagccctcagaatggctgcaaagagctccaacaaaacaatttagaactttattaaggaatagggggaagctaggaagaaactcaaaaacatcaaagattttaaatacgcttcttggtctccttgctataattatctggataagcatgctgttttctgtctgtccctaantcgcctgtnattanccgcaaacaacacaccaaggcaagaactttgtaactaaacnccatcctgtttncttcttcncagactgngctgcncntctgtctcatccttcccgcatctgacgacncgcgagctggacgcgggctgggcaaggcgacatagnnnnnn

SEQ ID NO: 327091 - DNA, 461 bp, Homo sapiens
  misc_feature: GZ8MTXP02GZJUQ.8.65.F10.1.454.CMB.2.raw
  modified_base (186)..(186): a, c, t, g, unknown or other
  misc_feature (186)..(186): n is a, c, g, or t
  modified_base (225)..(225): a, c, t, g, unknown or other
  misc_feature (225)..(225): n is a, c, g, or t
  modified_base (292)..(292): a, c, t, g, unknown or other
  misc_feature (292)..(292): n is a, c, g, or t
  modified_base (363)..(363): a, c, t, g, unknown or other
  misc_feature (363)..(363): n is a, c, g, or t
  modified_base (371)..(371): a, c, t, g, unknown or other
  misc_feature (371)..(371): n is a, c, g, or t
  modified_base (379)..(379): a, c, t, g, unknown or other
  misc_feature (379)..(379): n is a, c, g, or t
  modified_base (385)..(385): a, c, t, g, unknown or other
  misc_feature (385)..(385): n is a, c, g, or t
  modified_base (392)..(392): a, c, t, g, unknown or other
  misc_feature (392)..(392): n is a, c, g, or t
  modified_base (424)..(424): a, c, t, g, unknown or other
  misc_feature (424)..(424): n is a, c, g, or t
  modified_base (448)..(448): a, c, t, g, unknown or other
  misc_feature (448)..(448): n is a, c, g, or t
  modified_base (454)..(461): a, c, t, g, unknown or other
  misc_feature (454)..(461): n is a, c, g, or t
tcagctcgcgtgtccacgaccggtgctcgatttagctacgctctaagggggtcggatgacgtggccattctttgcctaaagcattgagtttactgcaaggtcagaaaagcatgcaaagccctcagaatggctgcaaagagctccaaacaaaacaatttagaactttattaaaggaatagggggaanctaaggaagaaactcaaaaacatacaaagattttaaaanacgcttcttggtctccttgctataattatctgggataagcatgcttgttttctgtctgtccctaacntgccctgtgattatccgacaaaacaacacacccaagggcagtaactttgtaacttaaacaccatcctgttncttcttcncagactgngctgcnccatctntcttcatcttcccgctatctgagacacgcganctgagcgggctgggcaagggcganagtagnnnnnnnn

SEQ ID NO: 327092 - DNA, 534 bp, Homo sapiens
  misc_feature: GZ8MTXP01D5BJU.8.42.D09.1.454.CMB.2.raw
  modified_base (223)..(223): a, c, t, g, unknown or other
  misc_feature (223)..(223): n is a, c, g, or t
tcagctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgganccagcagtgattacaatatatctctggtaccaacaacaccaggcaaacgccccaaactcatgattttgaggtcaataagcgcctcaggggtccctgatcgcttctcaggctcccaagtctggcaacaaccggccctccctgacccgtctctgggctccagactgaggatgaggctagattatactgcagctcattattcaggcagcaacgagggtaacttcgggcggagggaccaaggttcgaccgttcctaggttcacgcccaagggccttacgccccctggtccactcttcgttccccaacccgttccg

SEQ ID NO: 327093 - DNA, 508 bp, Homo sapiens
  misc_feature: GZ8MTXP01B6PF9.8.42.D09.1.454.CMB.2.raw
  modified_base (309)..(309): a, c, t, g, unknown or other
  misc_feature (309)..(309): n is a, c, g, or t
  modified_base (407)..(407): a, c, t, g, unknown or other
  misc_feature (407)..(407): n is a, c, g, or t
  modified_base (453)..(453): a, c, t, g, unknown or other
  misc_feature (453)..(453): n is a, c, g, or t
tcagctcgcgtgtccacgaccggtgctcgatttagacacatacgcagggaaaggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaagccccaaactcatgattttgaggtcaataagcggccctnaggggtccctgatcgcttctcaggctcccaagtctggcaacaacggccctccctgaccgtctctgggctccagactgaggatgaggctgattattacngcagctcagtattcagcagcaacaggtatcggcggaggaccaagtnacgttctaggcagcccaagggcttgccccctggtcactcttcgtcccgcctcccg

SEQ ID NO: 327094 - DNA, 517 bp, Homo sapiens
  misc_feature: GZ8MTXP01DVKUU.8.42.D09.1.454.CMB.2.raw
  modified_base (427)..(427): a, c, t, g, unknown or other
  misc_feature (427)..(427): n is a, c, g, or t
  modified_base (510)..(510): a, c, t, g, unknown or other
  misc_feature (510)..(510): n is a, c, g, or t
tcagctcgcgtgtccacgaccggtgctcgatttagacacatacgcagggaaagggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctctgtacaacaacacccagcaaagccccaaactcatgattttgagtcaataagcgcctcaggggtccctgatcgcttctcaggctcccaagtctggcaacaaccggcctccctgaccgtctcgtgggctccagactgaggatgaggctgattattactgcagctcatattcaggcagcaacgngggtaattcgggacggagggaccaaggttcgacgttctaggttcagcccaaggcttacgcccctagtcacgtcttcgttcccnccctccg

SEQ ID NO: 327095 - DNA, 550 bp, Homo sapiens
  misc_feature: GZ8MTXP01CIS3Y.8.42.D09.1.454.CMB.2.raw
  modified_base (218)..(218): a, c, t, g, unknown or other
  misc_feature (218)..(218): n is a, c, g, or t
  modified_base (227)..(227): a, c, t, g, unknown or other
  misc_feature (227)..(227): n is a, c, g, or t
tcagctcgcgtgtccacgaccggtgctcgatttagacacatacgcagggaaagggggtctcaggaggcagcgctctcaggacgtcaccaccatggcctgggctctgctcctcctcaccctcctcactcagggcacagggtcctgggcccagtctgccctgactcagcctcctccgcgtccggtctcctggacagtcagtcaccatctctgcactgganccagcagtnattacaactatatctctgtacaacaacaccagacaaacgccccaaactcatgtattttgagtcaataagcgccctacgacgggtccctgatcgcttctcagctaccccaagtctggacaacgaaccggccctccctcgaccgtctcgtgggcctcagactgagatgagctgtattatactgcagctcatattcaggacagcaaacgtagggtaactcggacggaggaccaaaggttcgaaccgttcgtacggttcgaacggcccgaagggttccttccggcccccgtcggtccaccgtcgttccgttcccccgccgttccccg

SEQ ID NO: 327096 - DNA, 559 bp, Homo sapiens
  misc_feature: GZ8MTXP01BLXVX.8.42.D09.1.454.CMB.2.raw
  modified_base (221)..(221): a, c, t, g, unknown or other
  misc_feature (221)..(221): n is a, c, g, or t
tcagctcgcgtgtccacgaccggtgctcgatttagacacatacgcagggaaaggggggtctcaggaggcagcgctctcaggacgtcaccaccatggcctgggctctgctcctcctcaccctcctcactcagagcacagggtcctgggcccagtctgccctgactcagcctccctccgcgtccggtctcctggacagtcagtcaccatctcctgcactgganccagcagtgattacaactatatctcctggtaccaacaacacccaggcaaacgccccaaactcatgattttgaggtcaataagcggcctcgaggggtccctgatcgcttctcaggcctccaagtctggcaaacacggcctccctgaccgtctctgggctccagactgaggatgaggctgattatactgcagctcattattcaggtcagcaacgagggtacgttcgggacgggacgggaccaaaggtttcgaacccggttcccgttagggtaccacggccccgaagggcctccggcccccgtcgggtccaccttccgttccggtttcccccgtaaccccg

SEQ ID NO: 327097 - DNA, 514 bp, Homo sapiens
  misc_feature: GZ8MTXP01CCHZD.8.42.D09.1.454.CMB.2.raw
  modified_base (222)..(222): a, c, t, g, unknown or other
  misc_feature (222)..(222): n is a, c, g, or t
  modified_base (493)..(493): a, c, t, g, unknown or other
  misc_feature (493)..(493): n is a, c, g, or t
tcagctcgcgtgtccacgaccggtgctcgatttagacacatacgcagggaaaggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgganccagcagtgattacaactatatctctggtaccaacaacacccaggcaaacgccccaaactcatgattttgagtcaatagcgcctgacgggtcctgatcgcttctcagctcccagtctggcaacaacgccctcccgtgacccgtctcgtcgggctccagactgaggatgagctagattattactgcagctcagtattcaggcagcaacgaggtatcggcggaggccaagttcgacgttcgtaggttcacgccaaggcttcgcccctcggtcnctcgttcgtcccgccttcccg

SEQ ID NO: 327098 - DNA, 567 bp, Homo sapiens
  misc_feature: GZ8MTXP01BNU93.8.42.D09.1.454.CMB.2.raw
  modified_base (222)..(222): a, c, t, g, unknown or other
  misc_feature (222)..(222): n is a, c, g, or t
tcagctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagcctccctcgcgtccgggtctcctggacagtcagtcaccatctcctgcactgganccagcagtgattacaactatatctctggtaccaacaacacccaggcaaacgcccccaaactcatgtattttgaggtacaataagcggccctcgacggggtccctgactcgcttctcaggctcccaagtctggaccaacaaccgggccctcccgtcgacccgtctcgtcgggctccagactgaggatgaggctagattattactgcagctacatattcaggccaggccaacgtagggtacttcgggacggtacgggaccaaggttcgaccgttcgtaacggttcgacgacccgaaggccttccgcccctacggtcctacgtccgttccgttccccgaaccctcccg

SEQ ID NO: 327099 - DNA, 540 bp, Homo sapiens
  misc_feature: GZ8MTXP01D3E7J.8.42.D09.1.454.CMB.2.raw
  modified_base (224)..(224): a, c, t, g, unknown or other
  misc_feature (224)..(224): n is a, c, g, or t
  modified_base (393)..(393): a, c, t, g, unknown or other
  misc_feature (393)..(393): n is a, c, g, or t
tcagctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactgganccagcagtgattacaatatatctctgtaccaacaacaccagcaaacgccccaaatcatgtatttgagtcaatagcgcctgagggtcctgatcgcttctcaggctcccaagtctcggcaaacaaccggccctcccgtcgacccgtctcgtcgggctccagactgaggtancgaggctagtattatactgcagctcatattcagcagacacgaggtaactcggacggagggacctaaggtcgtacccgttctaggcgaacgacccaagggccttccggtcccctcggtcctacctcgttccgtccccgttccctcccg

SEQ ID NO: 327100 - DNA, 761 bp, Homo sapiens
  misc_feature: GZ8MTXP01DZD91.8.42.D09.1.454.CMB.2.raw
tcagctcgcgtgtccacgaccggtgctcgatttagacacatacgcaggggaaaggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactggagccagcagtgattacaactatatctctgtaccaacaacaccaggacaaacgccccaaactcatgtattttgaggtcaatagcggcctcgacggggtcctgatcgcttctcgacgcctcccgaagtctcggaccaacgaacccgggtccctccccgtcggtacccgttccgttccgtcggggcccttccgaagtaccgtggaagggtaagtcgggaacggtccgttaggttaacttttactttaacgtcggtacaacggtccttacctaagtttaactttacgaacggggtaccaaacggtacccgaaaacgggtaagggggtttaacggtttaccgggggaaccgggggaaacggggtaaaccccgtaaaggggtttaaccgggaaaccccggtttaccggttaaacgggttacccgaaaccgggtacccccggttaaacgggttcccgttaccccgggtccccccgttccggggttaacccctaacccgtttcccggtttaccccggtttcccccccgttaaccccgtttccccg

SEQ ID NO: 327101 - DNA, 494 bp, Homo sapiens
  misc_feature: GZ8MTXP01DCG7J.8.42.D09.1.454.CMB.2.raw
  modified_base (221)..(221): a, c, t, g, unknown or other
  misc_feature (221)..(221): n is a, c, g, or t
  modified_base (429)..(429): a, c, t, g, unknown or other
  misc_feature (429)..(429): n is a, c, g, or t
  modified_base (481)..(481): a, c, t, g, unknown or other
  misc_feature (481)..(481): n is a, c, g, or t
tcagctcgcgtgtccacgaccggtgctcgatttagacacatacgcagggaaagggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgganccagcagtgattacaactatatctctgtacaacaacaccaggcaaagccccaaactcatgattttgagtcaataagcgcctcagggtccctgatcgcttctcagctcccaagtctggcaacaacgcctccctgaccgtctcgtcgggctccagactgaggatgagctgattatactgcagctcatattcagcagcaacaggtatcggngaggaccaagttcgacgttctagttcagcccaagcttgcccctggtcactcncgtcccaactccg

SEQ ID NO: 327102 - DNA, 569 bp, Homo sapiens
  misc_feature: GZ8MTXP01C5IO3.8.42.D09.1.454.CMB.2.raw
tcagctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatcctcctgcactggagccagcagtgattacaatatatctctgtaccaacaacacccaggacaacgccccaaactcatgtattttgaggtcaaataagccggccctcgacgggggtccctgatcgcttctcaggcctcccaagtctggacaacaaccggccctcccgtcgacccgtctcgtcgggctcagctgacggatgaggtctagtatttatactgcagctcagtacttgaggcagactaacgagggtacgttcgggcgggagggtacctaagggttcgaacccggttctacgggttcacggcccgaaggttccttccgcccccgtggtcctactccgttccgttccccaacccttccg

SEQ ID NO: 327103 - DNA, 572 bp, Homo sapiens
  misc_feature: GZ8MTXP01ASFFS.8.42.D09.1.454.CMB.2.raw
  modified_base (223)..(223): a, c, t, g, unknown or other
  misc_feature (223)..(223): n is a, c, g, or t
  modified_base (415)..(415): a, c, t, g, unknown or other
  misc_feature (415)..(415): n is a, c, g, or t
tcagctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgganccagcagtgattacaactatatctcctggtaccaacaacacccagacaaacgccccaaactcatgtattttgaggtcaataagcgcctcacgggtccctgactcgcttctcaggctcccaagtctggcaacaacgccctccctgacccgtctcgtgggcctcagactgacggatgaggctagattattacgngcagtctacagttactcgagcagacgaacggtaggtacgtcgggacgggaacggtaccgtaaggttcgaaccgttcgtacggttcgacgacccgacggccttcccggtcccccgtcggtaaccctcgttccgttcccgttccccgttccccgtcccg

SEQ ID NO: 327104 - DNA, 525 bp, Homo sapiens
  misc_feature: GZ8MTXP01DCEYE.8.42.D09.1.454.CMB.2.raw
  modified_base (222)..(222): a, c, t, g, unknown or other
  misc_feature (222)..(222): n is a, c, g, or t
  modified_base (440)..(440): a, c, t, g, unknown or other
  misc_feature (440)..(440): n is a, c, g, or t
  modified_base (451)..(451): a, c, t, g, unknown or other
  misc_feature (451)..(451): n is a, c, g, or t
  modified_base (519)..(519): a, c, t, g, unknown or other
  misc_feature (519)..(519): n is a, c, g, or t
tcagctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctctgcactgganccagcagtgattacaactatatctctgtaccaacaacaccaggacaaacgccccaaactcatgtattttgagtcaataagcgcctcgaggggtccctgatcgcttctcaggctccccaagtctggacaacgaacggccctccctgacccgtctcgtcgggctccgagactgaggatggagctagatttatactgcagctcattacttcagcagcaagngggtatcgggnggaggaccaagttcgaccgttctaggcacgcccaaggcttcgcccctggcctacgtcttcgttccccnccgtcc

SEQ ID NO: 327105 - DNA, 544 bp, Homo sapiens
  misc_feature: GZ8MTXP01CKBS4.8.42.D09.1.454.CMB.2.raw
  modified_base (222)..(222): a, c, t, g, unknown or other
  misc_feature (222)..(222): n is a, c, g, or t
  modified_base (537)..(537): a, c, t, g, unknown or other
  misc_feature (537)..(537): n is a, c, g, or t
tcagctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactgganccagcagtgaattacaatatatctctgtaccaacaacaccaggacaaacgccccaaactcatgtattttgaggtcaataagcggccctcgacggggtccctgactcgcttctcgaggtcctaccccgaagtctggacaaccgaacccggccctccctgacccgtctcgtcgggcctcagactgacggatggaggtctagtattatactgcagtctcatattcgagcagcaacgagggtactcggacggtaggactaagtcgaccgttcgtagcgacgccaaggccttcgccccgtgtcctactcttaccgtcccncctcccg

SEQ ID NO: 327106 - DNA, 542 bp, Homo sapiens
  misc_feature: GZ8MTXP01D2PG6.8.42.D09.1.454.CMB.2.raw
  modified_base (224)..(224): a, c, t, g, unknown or other
  misc_feature (224)..(224): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgganccagcagtgattacaactatatctcctaggtaccaacaacacccaggacaaagcccccaaaatcatgattttgaggtcaataagcgcctcaggggtccctgatcgcttctcaggctcccaagtctggcaacaaccggccctcctgacccgtctcgtgggtctcgagactgaggatggagctagatttatactgcagctcattacttgaggcagcaaacgtagggtattcgggacggtagggacctaagtcgaaccgttcgtaggttcgacgcccgaaggcttcgaacccctcggtcactcttcgtccccgccttcccg

SEQ ID NO: 327107 - DNA, 527 bp, Homo sapiens
  misc_feature: GZ8MTXP01ANL5J.8.42.D09.1.454.CMB.2.raw
  modified_base (223)..(223): a, c, t, g, unknown or other
  misc_feature (223)..(223): n is a, c, g, or t
  modified_base (242)..(242): a, c, t, g, unknown or other
  misc_feature (242)..(242): n is a, c, g, or t
  modified_base (326)..(326): a, c, t, g, unknown or other
  misc_feature (326)..(326): n is a, c, g, or t
  modified_base (407)..(407): a, c, t, g, unknown or other
  misc_feature (407)..(407): n is a, c, g, or t
  modified_base (411)..(411): a, c, t, g, unknown or other
  misc_feature (411)..(411): n is a, c, g, or t
tcagctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgganccagcagtgattacaactntatctcctggtaccaacaacacccaggcaaagccccaaatcatgattttgagtcaataagcggcctcaggggtcccctgatcgnttctcaggctccccaagtctggcaacaacggcctcctgaccgtctctgggctccagactgaggatgaggctgattattacngcanctacatatcagacagcgacgaggtagtcggtcggacggacgacgtcgtacgttacgtacgcgacgaccgacgcgccgtcccgtccgtccgtcctccttccgtcccgttcccgtccg

SEQ ID NO: 327108 - DNA, 570 bp, Homo sapiens
  misc_feature: GZ8MTXP01APYWO.8.42.D09.1.454.CMB.2.raw
  modified_base (225)..(225): a, c, t, g, unknown or other
  misc_feature (225)..(225): n is a, c, g, or t
  modified_base (234)..(234): a, c, t, g, unknown or other
  misc_feature (234)..(234): n is a, c, g, or t
  modified_base (244)..(244): a, c, t, g, unknown or other
  misc_feature (244)..(244): n is a, c, g, or t
  modified_base (286)..(286): a, c, t, g, unknown or other
  misc_feature (286)..(286): n is a, c, g, or t
  modified_base (431)..(431): a, c, t, g, unknown or other
  misc_feature (431)..(431): n is a, c, g, or t
tcagctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatcctcctgcactgganccagcagtnattacaactntatctcctggtaccaacaacacccaggacaaacgccccaaancatgtattttgagtcaatagcgccctgacgggtccctgatcgcttctcacggcctacccaagtctaggaccaacgaaccgggccctccctcgacccgtctcgtcgggcctaccagactgaggatggaaggtctagtattattacngacatctatagttacgtcgacgacagacgaaggtagggttacgtcggacggacgtacgtagtcgaccgttacgtacgcgacgtccgacggttccttcccgtcccgtcgtcctccgtccgttccgtccccgttccgtccg

SEQ ID NO: 327109 - DNA, 565 bp, Homo sapiens
  misc_feature: GZ8MTXP01EGFH8.8.42.D09.1.454.CMB.2.raw
  modified_base (197)..(197): a, c, t, g, unknown or other
  misc_feature (197)..(197): n is a, c, g, or t
  modified_base (223)..(223): a, c, t, g, unknown or other
  misc_feature (223)..(223): n is a, c, g, or t
  modified_base (439)..(439): a, c, t, g, unknown or other
  misc_feature (439)..(439): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctcgcgtccgggtctcctggacngtcagtcaccatctcctgcactgganccagcagtgattacaatatatctctggtaccaacaacacccaggcaaagccctacaaactcatgtatttttgaggtcaataagcgccctcgaggggtccctgactcgcttctcacggccctaccaaagtctaggccaaaacgaccggccctccctcgacccgtctctcggggctcccagactgaggatgaggctagtattatactgcagctcattnttcaggcaagccaagtagggtattcggggacggagggaccaaaggtttcgaccggttcgttaggtcgaacgacccgaaggccttaaccgcccctcgggtcacgttcctccgtttcccctaaccccg

SEQ ID NO: 327110 - DNA, 528 bp, Homo sapiens
  misc_feature: GZ8MTXP01BS40P.8.42.D09.1.454.CMB.2.raw
  modified_base (492)..(492): a, c, t, g, unknown or other
  misc_feature (492)..(492): n is a, c, g, or t
tcagctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaacgccccaaactcatgattttgaggtcaataagcggcctcaggggtccctgatcgcttctcaggctcccaagtctggcaacaaccggccctccctgacccgtctctgggctcagctgaggatgaggctagattattactgcagctcatattcgacggcagcaacgagggtaacttcgggcggaggaccaggtcgaccgttctaggttcacgcccaaggcncgccccctggtcactcttcgtccccgcccgttcccg

SEQ ID NO: 327111 - DNA, 567 bp, Homo sapiens
  misc_feature: GZ8MTXP01EKMVL.8.42.D09.1.454.CMB.2.raw
  modified_base (198)..(198): a, c, t, g, unknown or other
  misc_feature (198)..(198): n is a, c, g, or t
  modified_base (224)..(224): a, c, t, g, unknown or other
  misc_feature (224)..(224): n is a, c, g, or t
  modified_base (233)..(233): a, c, t, g, unknown or other
  misc_feature (233)..(233): n is a, c, g, or t
  modified_base (242)..(242): a, c, t, g, unknown or other
  misc_feature (242)..(242): n is a, c, g, or t
  modified_base (402)..(402): a, c, t, g, unknown or other
  misc_feature (402)..(402): n is a, c, g, or t
  modified_base (423)..(423): a, c, t, g, unknown or other
  misc_feature (423)..(423): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagccctccctcgcgtccgggtctcctggacngtcagtcaccatctcctgcactgganccagcagtnattacaatntatctctgtacaacaacaccagacaaacgccccaaatcatgtattttgagtcaataagcgcctcgacggggtccctgatcgcttctcgagctcccaagtctggacaaccgaaccggccctcccgtgacccgttctcgtcggggcctccgagtactgaggntgaggtctagatttattacgngacagtactatagttatacgagacaagacgtaaggtaggtacggtcggacggtacgtacgtaaggtaacgtaccgttcgtacggcgacgtccgacgccttcccggtcccgtcgtcctccgtcttcccgtccccttaaccgtccg

SEQ ID NO: 327112 - DNA, 533 bp, Homo sapiens
  misc_feature: GZ8MTXP01BPSA3.8.42.D09.1.454.CMB.2.raw
  modified_base (222)..(222): a, c, t, g, unknown or other
  misc_feature (222)..(222): n is a, c, g, or t
tcagctcgcgtgtccacgaccggtgctcgatttagacacatacgcagggaaaggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgganccagcagtgattacaatatatctctggtaccaacaacacccaggacaaacgcccccaaactcatgatttttgagtcaataagcgccctcaggggtccctgatcgcttctcaggctcccaagtctggcaacaacggcctccctgacccgtctctgggctccagactgagatggagctgattatactgcagctcatattcagcagcaacgagggtacttcgggcgggtaggaccaaggttcgaaccgttccgtacgggttcacgcccaagggccttcgccccctggtccactcttcgttccccgcccttcccg

SEQ ID NO: 327113 - DNA, 546 bp, Homo sapiens
  misc_feature: GZ8MTXP01AWWB3.8.42.D09.1.454.CMB.2.raw
  modified_base (418)..(418): a, c, t, g, unknown or other
  misc_feature (418)..(418): n is a, c, g, or t
tcagctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctctggtaccaacaacacccaggacaaacgcccccaaatcatgatttttgaggtcaataagcggccctcgacggggtccctgatcgcttctcaggctcccaagtctggcaacgaacggccctcccgtgacccgtctcgtgggcctcagactgaggatgaggctagattatacngcagctcagttattcaggcagccaagtaggtatcgggacgagggaccaaggttgaaccgttcgtacggttcaacggcccaaggcttacggccccctggtccactccgttcgttccccaacccgtcccg

SEQ ID NO: 327114 - DNA, 577 bp, Homo sapiens
  misc_feature: GZ8MTXP01A7Q6M.8.42.D09.1.454.CMB.2.raw
  modified_base (223)..(223): a, c, t, g, unknown or other
  misc_feature (223)..(223): n is a, c, g, or t
  modified_base (332)..(332): a, c, t, g, unknown or other
  misc_feature (332)..(332): n is a, c, g, or t
  modified_base (421)..(421): a, c, t, g, unknown or other
  misc_feature (421)..(421): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctcgcgtccgggtctcctggacagtcagtcaccatctcctgcactgganccagcagtgattacaactatatctctggtaccaacaacacccagacaaacgccccaaatcatgattttgaggtcaataagcgcctcgacggggtccctgactcgcttcncaggctcccaagtctggaccaacgaacccggccctccctgtacccgtctcgtgggcctcgagactgacggatgagtctagattattacngcagctcataattcgaggactagacctaagtagggtacgtcgggacgggacggtaccgtaaggttcgaccgttcgtacggttaccgacggaccccaaggccttaccgtcccccgtcggtcctaccgtccttaccggttccccttaaccccgtcccg

SEQ ID NO: 327115 - DNA, 638 bp, Homo sapiens
  misc_feature: GZ8MTXP01ETGRX.8.42.D09.1.454.CMB.2.raw
  modified_base (224)..(224): a, c, t, g, unknown or other
  misc_feature (224)..(224): n is a, c, g, or t
  modified_base (331)..(331): a, c, t, g, unknown or other
  misc_feature (331)..(331): n is a, c, g, or t
  modified_base (404)..(404): a, c, t, g, unknown or other
  misc_feature (404)..(404): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgganccagcagtgattacaactatatctctgtacaacaacaccagacaaacgccccaaatcatgtattttgagtcaataacgcgcctcgacggggtccctgactcgcttcncgacgctcccaagtctcggacaaccaaccggccctcccgtcgacccgtctcgtcgggcctcagtacgtgaggntggaggtcgttagtatttagttactgacacgtactactaattacttacgacggcaagcgtaaacggtaggggttaacgttcggggacggggtaacgggtaaccgtaaaggttcggtaacccggttaccggtacgggttaccgaacggtaaccccggaacgggttcccttcccgggtcccccgttcgggtaaccctaccgttccgttacccggttcccccaaccccgttccccgg

SEQ ID NO: 327116 - DNA, 551 bp, Homo sapiens
  misc_feature: GZ8MTXP01EHHA3.8.42.D09.1.454.CMB.2.raw
  modified_base (197)..(197): a, c, t, g, unknown or other
  misc_feature (197)..(197): n is a, c, g, or t
  modified_base (232)..(232): a, c, t, g, unknown or other
  misc_feature (232)..(232): n is a, c, g, or t
  modified_base (281)..(281): a, c, t, g, unknown or other
  misc_feature (281)..(281): n is a, c, g, or t
  modified_base (402)..(402): a, c, t, g, unknown or other
  misc_feature (402)..(402): n is a, c, g, or t
  modified_base (544)..(544): a, c, t, g, unknown or other
  misc_feature (544)..(544): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacngtcagtcaccatctcctgcactggagccagcagtnattacaatatatctctgtacaacaacaccagacaacgccccaaatcatntatttgagtacaatagcgcctcgacgggtcctgatcgtcttctcgacggctacccgaagtctaggaccaacgaaccgccctcccgtcgtacccgtctcgtcgggcctacgagtactgaggngtagagtcttagtatttattacgtgcagtctacattattcgagacagacgaacgtaggtactcggacggtaggacctaggtcacgttcgtacggttcacgaccaggccttccgtccccgtgtcctactcttacccgtccccncccgtcc

SEQ ID NO: 327117 - DNA, 563 bp, Homo sapiens
  misc_feature: GZ8MTXP01BQRXR.8.42.D09.1.454.CMB.2.raw
  modified_base (488)..(488): a, c, t, g, unknown or other
  misc_feature (488)..(488): n is a, c, g, or t
  modified_base (545)..(545): a, c, t, g, unknown or other
  misc_feature (545)..(545): n is a, c, g, or t
  modified_base (557)..(557): a, c, t, g, unknown or other
  misc_feature (557)..(557): n is a, c, g, or t
tcagctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatcctctggtaccaacaacaccaggacaaacgccccaaactcatgtattttgaggtacaagtaacgccggccctcgacggggtccctgactcgtcttctcgacggcctacccagtcgtgaccaacgaaccggccctcctcgacccgtctcgtcgggcctcgacgtactgaggtagtggaacggtcgtagtatttacttacgtgacagtctctattattcgaggtcagacacgtaggtagtcgggnggacggactagtcgtaccgttcgtacgttcgacgccgaggcttccgccccgtgtccnctcttcgtcccntccccg

SEQ ID NO: 327118 - DNA, 603 bp, Homo sapiens
  misc_feature: GZ8MTXP01DVRUV.8.42.D09.1.454.CMB.2.raw
  modified_base (223)..(223): a, c, t, g, unknown or other
  misc_feature (223)..(223): n is a, c, g, or t
  modified_base (405)..(405): a, c, t, g, unknown or other
  misc_feature (405)..(405): n is a, c, g, or t
  modified_base (409)..(409): a, c, t, g, unknown or other
  misc_feature (409)..(409): n is a, c, g, or t
tcagctcgcgtgtccacgaccggtgctcgatttagacacatacgcaggggaaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctctgcactgganccagcagtgattacaactatactctctgtaccaacaacacccagacaaacgccccaaatcatgtattttgaggtacaataggccgcctcgacggggtccctgactcgcttctcaggctcccaagtctacggacaacgaaccggccctcccgtacgacccgtctcgtgggctcagtactgagngtgngctagtattatactgacagtctactagttcttacgaggcaagaccaaaggtaggggttaaactcgggggacgggtaacgggtaacccgtaagggttcggaacccgttcggtaacgggttcaaccggacccgaacggttccgttcccgtccccgtcggtaacctcgttccttccgttcccccttaaccgtttccg

SEQ ID NO: 327119 - DNA, 622 bp, Homo sapiens
  misc_feature: GZ8MTXP01C0T0E.8.42.D09.1.454.CMB.2.raw
  modified_base (222)..(222): a, c, t, g, unknown or other
  misc_feature (222)..(222): n is a, c, g, or t
  modified_base (293)..(293): a, c, t, g, unknown or other
  misc_feature (293)..(293): n is a, c, g, or t
tcagctcgcgtgtccacgaccggtgctcgatttagacacatacgcagggaaaggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgganccagcagtgattacaatatatctctgtacaacaacacccaggcaaacgccccaaatcatgtattttgagtnaataagcggcctcgacgggtcctgatcgcttctcagctcccaagtctggcaacaacggccctccctgacccgtctcgtcgggctccagtactgaggatgaggctagtaatttattactgacagtctacatacttcaggcagacaaacgtagggtaaacgttcggggaccgggaagggtaacccgtaaaggttaacggtaacccggttaccgttacgggaccgtaaacgggccccgttaaaggggttcccacgggtaacccccccgttacgggttccctaacccggttcccctttccgggtttaacccccccgaaccccgttttccccgg

SEQ ID NO: 327120 - DNA, 523 bp, Homo sapiens
  misc_feature: GZ8MTXP01EZUZ2.8.42.D09.1.454.CMB.2.raw
  modified_base (222)..(222): a, c, t, g, unknown or other
  misc_feature (222)..(222): n is a, c, g, or t
  modified_base (413)..(413): a, c, t, g, unknown or other
  misc_feature (413)..(413): n is a, c, g, or t
  modified_base (434)..(434): a, c, t, g, unknown or other
  misc_feature (434)..(434): n is a, c, g, or t
tcagctcgcgtgtccacgaccggtgctcgatttagacacatacgcagggaaaggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgganccagcagtgattacaactatatctctggtaccaacaacaccaggacaaacgccccaaatcatgtattttgagtcaaataagcgcctcgaggggtccctgatcgcttctcaggctcccaagtctggcaacgaacggccctcctgaccgtctctgggctccagactgaggatgaggctagatttatactgcanctacagtattcagcagcaagnggtatcgggaggaggaccaaggtcgaaccgttccgtagttcgacgcccgagcttcgcccctggtcacgtcttcgttccccgaacctccg

SEQ ID NO: 327121 - DNA, 521 bp, Homo sapiens
  misc_feature: GZ8MTXP01BW8M3.8.42.D09.1.454.CMB.2.raw
  modified_base (410)..(411): a, c, t, g, unknown or other
  misc_feature (410)..(411): n is a, c, g, or t
  modified_base (513)..(513): a, c, t, g, unknown or other
  misc_feature (513)..(513): n is a, c, g, or t
tcagctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaatatatctcctggtaccaacaacacccaggacaaacgcccccaaactcatgtatttttgaggtcaataagcggccctcgaggggtccctgatcgcttctcaggctcccagtctggcaacacggcctccctgacccgtctctgggctcagactgagatgagctagattatacnncagctcatattcaggcagcaagaggtatcgggcggaggaccaagtcgaaccgttcgtaggttcacgcccagccttcgcccctcggtcactcttcgttccccnccgtcccg

SEQ ID NO: 327122 - DNA, 692 bp, Homo sapiens
  misc_feature: GZ8MTXP01A92Z8.8.42.D09.1.454.CMB.2.raw
  modified_base (223)..(223): a, c, t, g, unknown or other
  misc_feature (223)..(223): n is a, c, g, or t
  modified_base (333)..(333): a, c, t, g, unknown or other
  misc_feature (333)..(333): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctcgcgtccgggtctcctggacagtcagtcaccatctcctgcactgganccagcagtgattacaactatatctctagtacaacacaccagacaaacgccccaaatcatgtattttgaggtcaataacgcgccctcgacggggtccctgactcgtcttcncgacggcctacccagtcgtcggaccaaccgaacccggtcccctccctcggtaccccgttcgtccgtcggggccttccgaacgtaccgttggaaggtacgttggacgggtcttaacggtaattttaacgttaaccgttgaccgtaagtccttactaagtttacctttacgaagggtacccgtaagaaccgtaaaccggtagggggtttaacgttccggggaacggggtaacgggaaacccgttaacggttaacggtaacccgttccggttaacggccgtaacgacccgaacggttccgttcccggtcccccttcgggtccttaccgttcccgttccgtttcccccgttcccgttccccgg

SEQ ID NO: 327123 - DNA, 694 bp, Homo sapiens
  misc_feature: GZ8MTXP01B6WGC.8.42.D09.1.454.CMB.2.raw
  modified_base (224)..(224): a, c, t, g, unknown or other
  misc_feature (224)..(224): n is a, c, g, or t
  modified_base (272)..(272): a, c, t, g, unknown or other
  misc_feature (272)..(272): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctctgcactgganccagcagtgattacaactatatctctagtaccaacacaccagacaacnccccaaatcatgtattttgagtacaataacgccgccctacgacgggggtcccctgactccgtcttctcgacggtctacccgacggtctggacccaacgaacccggtccctcccgtgtacccgttcgtccgtcggggtcctaccgagtacgtggaggtagtaggacggtcttaggtactttaacgttacgcgactacgtccttacgtaagttacgtttacgacggacgtaacgaccgtaaacggtagggttacggttacggggacgggaaacgggtacctaaacgggtttccggtaacccggttaccgttaacggttccgtaaacccggccccggttaaacgggttccccttacccggtccccccgttcgggtaacccttacccgttccgtttaccccgttcccccgttaaccccgttccccg

SEQ ID NO: 327124 - DNA, 541 bp, Homo sapiens
  misc_feature: GZ8MTXP01EZRKL.8.42.D09.1.454.CMB.2.raw
  modified_base (224)..(224): a, c, t, g, unknown or other
  misc_feature (224)..(224): n is a, c, g, or t
  modified_base (243)..(243): a, c, t, g, unknown or other
  misc_feature (243)..(243): n is a, c, g, or t
tcagctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatcctcctgcactgganccagcagtgattacaactntatctctgtacaacaacaccagcaagcccaaatcatgattttgaggtcaataagcgccctcaggggtccctgatcgcttctcacggctcccaagtctggcaacgaaccggcctccctgaccgtctcgtgggctccagctgaggatgaggctagatttatactgcagctcatattcgaggcagcaacgtagggtattcgggacggtagggaacctaaggttcgacccgttcgtacggttccgacgacccaagggccttacggccccctggtccacctcttccgttccccaaccctcccg

SEQ ID NO: 327125 - DNA, 580 bp, Homo sapiens
  misc_feature: GZ8MTXP01AUNWJ.8.42.D09.1.454.CMB.2.raw
  modified_base (222)..(222): a, c, t, g, unknown or other
  misc_feature (222)..(222): n is a, c, g, or t
  modified_base (241)..(241): a, c, t, g, unknown or other
  misc_feature (241)..(241): n is a, c, g, or t
  modified_base (327)..(327): a, c, t, g, unknown or other
  misc_feature (327)..(327): n is a, c, g, or t
tcagctcgcgtgtccacgaccggtgctcgatttagacacatacgcagggaaaggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgganccagcagtgattacaactntatctcctgtacaacaacaccagacaacgccccaaactcatgtattttgagtcaataagcgcctgacgggtcctgatcgcttctcnggctccagtctgcaacgacggccctccgtcgacccgtctcgtcgggcctcacgactgaggatggagtctgattatactgcagtctcgattattcgaacggtacagtaccgaacgtaggggttaacgttcgggacgggtaacggaaccgtaaggttcggaaccggttccggtaacggttccgaacggacccgttaacggccttaccggtccccctcgggtcctaccgtccgttaccgttccccaaccgttcccg

SEQ ID NO: 327126 - DNA, 576 bp, Homo sapiens
  misc_feature: GZ8MTXP01EL8GX.8.42.D09.1.454.CMB.2.raw
  modified_base (224)..(224): a, c, t, g, unknown or other
  misc_feature (224)..(224): n is a, c, g, or t
  modified_base (328)..(328): a, c, t, g, unknown or other
  misc_feature (328)..(328): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgganccagcagtgattacaactatatctcctgtaccaacaaccaccagacaaacgccccaaatcatgtatttgagtacaatagcgcctgagggtccctgatcgcttcncaggctcccagtctggacaacaaccggtcctcccgtgtacccgtctcgtcgggctccagactgaggatgaggctagtaatttatactgcagtctactattattcaggacagcaaacggtagggttaagtccgggagggacgggtacctaaaggtcgtaaccggttcgtaacgggttcaacggacccgaaggttccttccggtcccccgttggtcctaccgttccgttccgttcccccgccttaacccg

SEQ ID NO: 327127 - DNA, 696 bp, Homo sapiens
  misc_feature: GZ8MTXP01BJWR8.8.42.D09.1.454.CMB.2.raw
  modified_base (222)..(222): a, c, t, g, unknown or other
  misc_feature (222)..(222): n is a, c, g, or t
tcagctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagcctcctccgcgtccgggtctcctggacagtcagtcaccatctcctgcactgganccagcagtgattacaactatatctctggtaccaacaacacccaggcaaacgcccccaaatcatgtattttgagtcaataagcgcctcaggggtccctgactcgcttctcacgctcccaagtctggacaacgaaccggccctcccgtgacccgtctcgtcgggctccgaagtacgtggacggtagtggaacggtcttaggtaatttacgttaaccgtggacctaaggtccttacctaagtttacgtttacgaacggggacaacggacgtaaaccggtaggggtttaaacgttccggggaccgggaacggggtaaccctaaagggtttccgaaacccggttaccggtttaacggggttccgaaaccgggaccccgttaaacggggttcccgtttaccccgggaaccccccccgtttaggggtccccgttaacccttcccgttaccccggtttcccccttaaccccgtttcccccgg

SEQ ID NO: 327128 - DNA, 619 bp, Homo sapiens
  misc_feature: GZ8MTXP01AHING.8.42.D09.1.454.CMB.2.raw
  modified_base (224)..(224): a, c, t, g, unknown or other
  misc_feature (224)..(224): n is a, c, g, or t
  modified_base (339)..(339): a, c, t, g, unknown or other
  misc_feature (339)..(339): n is a, c, g, or t
  modified_base (606)..(606): a, c, t, g, unknown or other
  misc_feature (606)..(606): n is a, c, g, or t
tcagctcgcgtgtccacgaccggtgctcgatttagacacatacgcaggggaaaggggggggtctcaggaggcagcgctctcaggacgtcaccaccatggcctgggctctgctcctcctcaccctcctcactcagggcacagggtcctgggcccagtctgccctgactcagcctccctcgcgtccgggtctcctggacagtcagtcaccatctcctgcactgganccagcagtgattacaactatatctctggtaccaacaacaccagacaaacgccccaaatcatgtattttgagtacaataagccgcctacgacgggggtccctgactccgtctttcncgacggtcctcccgaagtcgtggaccaacgaaccggccctcccgtagacccggttctcggtcgggcctcgaagtacctggacggtatgggacgcttaggatttactacgtgacagtctactataagttcgagcagacgaacgtagggtacgtcggcgggaacggtaccgaaggttcgaacccgttcgtacggttacgaccggacccgaacgggttcccttcccggaacccccgttggtcccctaccgttccttaccggtaacccccncccgttaaccccg

SEQ ID NO: 327129 - DNA, 623 bp, Homo sapiens
  misc_feature: GZ8MTXP01BW34O.8.42.D09.1.454.CMB.2.raw
tcagctcgcgtgtccacgaccggtgctcgatttagacacatacgcaggggaaaggggggggtctcaggaggcagcgctctcaggacgtcaccaccatggcctgggctctgctcctcctcaccctcctcactcagggcacgagggtcctgggcccagtctgccctgactcacgcctccctcgcgtccgggtctcctggacagtcagtccacatcctcctgcacgtggagccagcagtgaattacaatatatctctagaaccaacaacaccagacaaacaccccaaatcatgtatttgagtacaagtaagccgacctcgacgggtcctgactcgtcttcacgacgtcctaccgagtctacggaccaaccgaaccggtccctccgtcgtaccgtcgtacgtcgggactaccgagtacgtagagagtagacggtacgtagtaactttattactagacgctaaaaactctaagttattacgaggacacgacgaacggtaaggttacgtacgggacgggtaacggtaccgtaacggtaacgtaccgttacgtacggttacgaccggaccgaacggccgttacccgtcccgtcggtcctaccgtccgttccgtccccgttaaccctcccg

SEQ ID NO: 327130 - DNA, 611 bp, Homo sapiens
  misc_feature: GZ8MTXP01AWQBD.8.42.D09.1.454.CMB.2.raw
  modified_base (441)..(441): a, c, t, g, unknown or other
  misc_feature (441)..(441): n is a, c, g, or t
tcagctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctctggtaccaacaacaccaggacaaacgccccaaactcatgtattttgaggtcaataagcggcctcgacgggtcctgactcgcttctcacggctaccccaagtcgtggaccaaccgaaccggccctcccgtcgacccgttcctcgtgggcctccgagaccgtggaggagtggagtctagtatttatacgtcgacngtactatattactacgacgacgagacgtaacggtaggttacgtcgggacgggtacggtaaccgtaggttaacgtacccggttacgttacggacgaaccgccgttacgttcccgttacccgtccccgtacggtcctaccgttccgttcccgttccccttcccgttaacccg

SEQ ID NO: 327131 - DNA, 557 bp, Homo sapiens
  misc_feature: GZ8MTXP01BQ98Q.8.42.D09.1.454.CMB.2.raw
  modified_base (459)..(459): a, c, t, g, unknown or other
  misc_feature (459)..(459): n is a, c, g, or t
tcagctcgcgtgtccacgaccggtgctcgatttagacacatacgcagggaaagggggggagaggagcccagcactgggattccgaggtgtgtccattcggtgatcagcactgaacacagaggactcaccatggagttctggctgggctgggttttccttgttgcaatttcaaaggtgtccagtgtgaggtgcagctggtggagaatgggagggggcttgatccgaggccgggggggtccctgagactctcctgtgcagcctctggcttcaccatcagtagagactacatgagctgggcccgcaggctccgagggaggggctgggagtgggtctcagttattatccgcgtatgggtgccaacacaactcgcagacctcggtggaagggcagattccaccgtctccagacgacaattccaaagaacagtggtagtatcgttacaaatcgaaacagactaanagccgaaggacacggccgtaatattacgtgttcgcgaagacttgacgtaacgtacgggtgaaccggtcccggttaggggcccaacgggggtaaccccg

SEQ ID NO: 327132 - DNA, 616 bp, Homo sapiens
  misc_feature: GZ8MTXP01BJ0KT.8.42.D09.1.454.CMB.2.raw
  modified_base (224)..(224): a, c, t, g, unknown or other
  misc_feature (224)..(224): n is a, c, g, or t
  modified_base (233)..(233): a, c, t, g, unknown or other
  misc_feature (233)..(233): n is a, c, g, or t
  modified_base (441)..(441): a, c, t, g, unknown or other
  misc_feature (441)..(441): n is a, c, g, or t
  modified_base (454)..(454): a, c, t, g, unknown or other
  misc_feature (454)..(454): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgganccagcagtnattacaactatactctctcgtaccaacaacaccagacaaacgccccaaatcatgtattttgagtcaatagcgcctcgacggggtcctagactcgtcttctcgacggctcccgagtcgtcggaccaaccgaaccggtccctcccgtcgacccgtcgtccgtgggtcctacgagactggaggagtggaggtcttaggtaatttactacgngtctacgtcttanattacttcgacggtacgacgacgaacggtacgggttacgtcggggacgggaacggtaccgtaaggttccgaacccggttcgtacggttaccgacggtacccgacgccgttcccggtaaccccgttcggtcctaccgttcgttcccggtcccttcccgtcccg

SEQ ID NO: 327133 - DNA, 639 bp, Homo sapiens
  misc_feature: GZ8MTXP01EJP1P.8.42.D09.1.454.CMB.2.raw
  modified_base (225)..(225): a, c, t, g, unknown or other
  misc_feature (225)..(225): n is a, c, g, or t
tcagctcgcgtgtccacgaccggtgctcgatttagacacatacgcaggggaaaggggggggtctcaggaggcagcgctctcaggacgtcaccaccatggcctgggctctgctcctcctcaccctcctcactcagggcacagggtcctgggcccagtctgccctgactcagcctccctcgcgtccgggtctcctggacagtcagtcaccatctcctgcacgtgganccagcagtgattacaactatatctctgtaccaacaacaccagacaaacgccccaaatcatgtattttgagtacaataagcgcctgacgggtcctgatcgcttctcacggtctacccgaagtcgtacggaccaaccgtaacccggtccctcccgtcgacccgttctcgtggggcctccgaagtactggaggagtgaggtctagtatttatacgtgccagtctactagttacttcgaggacagtacgaacggtaggggttaacgttccggggacgggaaacgggtaaccgtaaagggttccggtaaaccggttccgtaacgggttaccgaacggtaccccggaaggttcccgttacccggtcccccgttcggtaacctaccgttccgttaccggtttccccttaacccgttccccg

SEQ ID NO: 327134 - DNA, 565 bp, Homo sapiens
  misc_feature: GZ8MTXP01DH25W.8.42.D09.1.454.CMB.2.raw
  modified_base (415)..(415): a, c, t, g, unknown or other
  misc_feature (415)..(415): n is a, c, g, or t
  modified_base (440)..(440): a, c, t, g, unknown or other
  misc_feature (440)..(440): n is a, c, g, or t
  modified_base (558)..(558): a, c, t, g, unknown or other
  misc_feature (558)..(558): n is a, c, g, or t
tcagctcgcgtgtccacgaccggtgctcgatttagacacatacgcaggggaaagggggggtctcaggaggcagcgctctcaggacgtcaccaccatggcctgggctctgctcctcctcaccctcctcactcagggcacgagggtcctgggcccagtctgccctgactcagcctcctcgcgtccggtctctggacagtcagtcaccatctcctgcactggagccagcagtgattacaacttatactctctgtacaacaacaccaggcaaacgccccaaatcatgattttgaggtacaataagcgccctcgacgggtccctgactcgtcttctcgaggctcccaagtcgtggaccaaacgaaccggtccctcccgtcgacccgttctcgtcggggcctccgaagacgtgaaggtagnggaaggctagtaatttacgttacgngctagtctactagttatcgaggacacgaacgaacgtaggtacgtcgggacggacggtacgtaggtcgccgttcgtacgcgacgccgagccttccgccctcgtctctcttccgtccccnccgtccg

SEQ ID NO: 327135 - DNA, 719 bp, Homo sapiens
  misc_feature: GZ8MTXP01BYK4N.8.42.D09.1.454.CMB.2.raw
tcagctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagcctccctcgcgtccgggtctcctggacagtcagtcaccatctcctgcactggagccagcagtgattacaactatatctcctgtaccaacaacaccaggacaaacgccccaaactcatgtattttgaggtcaataagcggccctcgacgggggtccctgtactcgtacttctcgacggtcctaccccgaagtcgtcggaccaaccgaaccggtcccttcccctcgtaacccgtctcgtcggggtcctccgaagtacctggaggtacgtggacggtcgtaggtaatttaacgttaacgtggactaacggtccttctaacgttaactttccggaacgggtaccctaaggacctaaaccggtagggggtttaaacgttcccgggggtacgggaaacgggggtaaccccgtaaaggggtttcccggtaaacccgggttcccgtaaacggggttacccgaccggtaccccgaaacgggttcccgttccccgtcccccccggttcgggttccctacccgttccgtttacccggttccccccttaaccccgtttccccg

SEQ ID NO: 327136 - DNA, 615 bp, Homo sapiens
  misc_feature: GZ8MTXP01DHOVV.8.42.D09.1.454.CMB.2.raw
  modified_base (225)..(225): a, c, t, g, unknown or other
  misc_feature (225)..(225): n is a, c, g, or t
  modified_base (348)..(348): a, c, t, g, unknown or other
  misc_feature (348)..(348): n is a, c, g, or t
  modified_base (608)..(608): a, c, t, g, unknown or other
  misc_feature (608)..(608): n is a, c, g, or t
tcagctcgcgtgtccacgaccggtgctcgatttagacacatacgcaggggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgganccagcagtgaattacaactatatctcctaggtaccaacaacacccaggacaaacgcccccaaactcatgtattttagaggtcaataagccggccctcgacgggggtccctgactcgcttctcnggctacccaagtctggccaacgaaccggccctccctgacccgtctcgtacgggctcgaacgacttgaaggtacgtagacggtctaggtatttaattaaccgtgacctaggtaccttaccgaattaacgtttcaacgggtacagacctaaacggaggggttaaacgttcggacgggtaagggaaccctaaggttcgacccgttcgtacggcgacggccaacggcttaccggcccctacggtcctactcgttccggtccccnccgtccg

SEQ ID NO: 327137 - DNA, 676 bp, Homo sapiens
  misc_feature: GZ8MTXP01B7E32.8.42.D09.1.454.CMB.2.raw
  modified_base (228)..(228): a, c, t, g, unknown or other
  misc_feature (228)..(228): n is a, c, g, or t
  modified_base (237)..(237): a, c, t, g, unknown or other
  misc_feature (237)..(237): n is a, c, g, or t
  modified_base (349)..(349): a, c, t, g, unknown or other
  misc_feature (349)..(349): n is a, c, g, or t
  modified_base (453)..(453): a, c, t, g, unknown or other
  misc_feature (453)..(453): n is a, c, g, or t
tcagctcgcgtgtccacgaccggtgctcgatttagacacatacgcaggggaaaggggggggtctcaggaggcagcgctctcaggacgtcaccaccatggcctgggctctgctcctcctcaccctcctcactcagggcacagggtcctgggcccagtctgccctgactcacgccctccctccgcgtctgggtctcctggacagtcagtcaccatctcctgcactggacnccagcagtnattaacaattatactctctgtaaccaacaaacacccaggacaaacgaccccaaactcatgtattttgaggtacaataacgccggcctcgacggggtccctgtactcgcttcncgaggtccctaccgagtcgtcggacaaaacgaccggccctcccgtcgacccgttctaccgtcgggcctacgagacgtagaggatggagtctgtaatttatacgngctagtctagtaattacgttcgacggacgtaacgaaccgtaaacggtacggggttacgttccgggggacggtaaacggggtaaccgtaaagggttccggttaaccccgttacggttaaacgggttaccgaacccgggttaccccggttaacgggcccgttaaccccgggcccccgtttaacgggtaccctaccgttcccgttccccggttcccccgtcccccg

SEQ ID NO: 327138 - DNA, 575 bp, Homo sapiens
  misc_feature: GZ8MTXP01EJ546.8.42.D09.1.454.CMB.2.raw
  modified_base (223)..(223): a, c, t, g, unknown or other
  misc_feature (223)..(223): n is a, c, g, or t
  modified_base (322)..(322): a, c, t, g, unknown or other
  misc_feature (322)..(322): n is a, c, g, or t
  modified_base (333)..(333): a, c, t, g, unknown or other
  misc_feature (333)..(333): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcacatctcctgcactgganccagcagtgattacaactatactctctgtaccaacaacacccagacaaacgccccaaactcatgtattttgagtacaataacgcgcctcgacgggtccngatcgcttctnacgctcccaagtctaggacaacgaaccggcctccctcgacccgtctcgtcgggctcagtactggtaggatcgaggtctagtatttatactgcagctactagtattcgaggcagacaacgtagggtagtcgggacgggtacggactaaggtcgtacgttcgtaagggttcaacggcccgaacggttccttaccggtccccgtcgtaaccgtctcccgttccggttccccgttcccgttccccg

SEQ ID NO: 327139 - DNA, 682 bp, Homo sapiens
  misc_feature: GZ8MTXP01CQ1LX.8.42.D09.1.454.CMB.2.raw
  modified_base (234)..(234): a, c, t, g, unknown or other
  misc_feature (234)..(234): n is a, c, g, or t
  modified_base (243)..(243): a, c, t, g, unknown or other
  misc_feature (243)..(243): n is a, c, g, or t
  modified_base (476)..(476): a, c, t, g, unknown or other
  misc_feature (476)..(476): n is a, c, g, or t
tcagctcgcgtgtccacgaccggtgctcgatttagacacatacgcaggggaaaggggggggtctcaggaggcagcgctctcaggacgtcaccaccatggcctgggctctgctcctcctccaccctcctcactcgagggcacgagggtcctggggcccagtctgccctgactcacgcctccctccgcggtccgggtctccgtggacagtcagtcaccatctcctgcacgtggacnccagcagtnaattaacaactatactctccgtacgtaaccaacaaccaccagacaaaccgaccccaaatcatgtattttagagtacaagtaacgccggtcctacggacggggtccctagactcgtcttcgcgacggtcctacccgaagtcgacggacaaccgaccggtccctcccgtcgacccgttctcgtcgggcctaccgagactaggaggagtcggacgtcgttagttaacttagttacngacgtatacctatattacgttacgaggaccaaggaccaaagggtacggttaacggtccggggaacgggtaaccgggtaactaacgggttccggaacccggttacggttacggaccgaaaccggtacccggaacggttcccgttaccccgtccccggttacgtcctaccgttcccgttaccgtttaaccccccgccgttaaccccgg

SEQ ID NO: 327140 - DNA, 744 bp, Homo sapiens
  misc_feature: GZ8MTXP01ANF6E.8.42.D09.1.454.CMB.2.raw
  modified_base (232)..(232): a, c, t, g, unknown or other
  misc_feature (232)..(232): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggagccagcagtnattacaactatatctctgtaccaacaacacccagacaacgaccccaaactcatgtattttgaggtacaataagcgcctcgacgggtcctgactcgcttctcagctcccaagtcgtcgacaaccgaaccgccctcccgtcgacccgtctcgtcgggtctaccgtagacctaggacggtagttaggagggtaccttaggtaattttaacttaacgttcgaccgtaggtaccctttacgtaatttaacgtttacggaacggggacctaaacggtaccgaaaccggttagggggttaaacgttcccgggggtacggggaaaccggggtaaacccgttaaagggttaacccggtaaccccggtttacccggttaaacgggttacccggtaaaccgggaccccccggttaaaacggggttccccgttaccccgggtcccccccggtttaccgggttcccctaacccgtttccccgttaacccggttttaacccccccccgttaaccccgttaaccccg

SEQ ID NO: 327141 - DNA, 580 bp, Homo sapiens
  misc_feature: GZ8MTXP01EX2ED.8.42.D09.1.454.CMB.2.raw
  modified_base (223)..(223): a, c, t, g, unknown or other
  misc_feature (223)..(223): n is a, c, g, or t
tcagctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgganccagcagtgattacaactatatctctgtaccaacaacaccagacaaacgccccaaactcatgtattttgaggtacaataacgcgcctcgacgggtccctgatcgcttctcaggctacccaagtctggacaaccgaaccgccctcccgtgacccgtctcgtcgggctcagactgacggatgagctagatttatactgcagtctacagttacttcgaggcagacaaacgtagggttaacgtcgggacgggacgggacctaagggttcgaccgttcgtaaggttccgaacgacccgaagggttccttaccggcccccgttacggtcctaccgttcttaccgttccccttaacccgtcccg

SEQ ID NO: 327142 - DNA, 588 bp, Homo sapiens
  misc_feature: GZ8MTXP01B04HH.8.42.D09.1.454.CMB.2.raw
  modified_base (198)..(198): a, c, t, g, unknown or other
  misc_feature (198)..(198): n is a, c, g, or t
  modified_base (224)..(224): a, c, t, g, unknown or other
  misc_feature (224)..(224): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacngtcagtcaccatctcctgcactgganccagcagtgattacaactatatctctgtaccaacaacaccaggacaaacgccccaaactcatgtattttgaggtcaataagcgccctcgacggggtccctgactcgcttctcacggctcccaagtctggaccaacaaccggtccctcccgtcgtacccgtctccgtcggggtcctaccgacgtacgtggaggtagtggaggtctaggtaactttacttacgtgacagtcttacattacttcgaggacagacgaacgtagggtacgtcggacgggacggacgtaagttcgaccgttcgtacggttcacggtccacggccttccggcccctcggtcctactccgttccgtccccttaaccgtcccg

SEQ ID NO: 327143 - DNA, 571 bp, Homo sapiens
  misc_feature: GZ8MTXP01CCM10.8.42.D09.1.454.CMB.2.raw
  modified_base (412)..(412): a, c, t, g, unknown or other
  misc_feature (412)..(412): n is a, c, g, or t
  modified_base (561)..(561): a, c, t, g, unknown or other
  misc_feature (561)..(561): n is a, c, g, or t
tcagctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggacaaacgccccaaactcatgtattttgagtcaatagcgccctcgacgggtccctgactcgcttctcaggctcccagtctgcaacgaccgccctcctgacccgtctcgtgggctcagactgaggatgaggctagtattattacngcagctcgattacgttcgacgtcgagaccgaacgtagggttacgttcggggacgggacgggtacctaagggttcggaccgttcgtacggttcgacgcccgaaggttccttaccggccccgtacggtcctaccgttccttccgttccccnccccgttccg

SEQ ID NO: 327144 - DNA, 607 bp, Homo sapiens
  misc_feature: GZ8MTXP01A35TU.8.42.D09.1.454.CMB.2.raw
  modified_base (224)..(224): a, c, t, g, unknown or other
  misc_feature (224)..(224): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgganccagcagtgattacaactatatctctgtaccaacaacaccagacaacgaccccaaactcatgtattttgagtacaataagcgcctcgacgggtccctgactcgcttctcgacggctacccaagtctcggacaaccgaaccggccctcccgtcgtacccgttctccgtcggggtcctccgagactggaacggtatggacggtcttaggtatttattacgtagctaacgtctactagttacttacgagtacaagactaacgtagggttaacgtcgggacgggtacggacgtaaggttcgacccgttcgtacggttcacggtacccgaggttccttccggtcccccgtcggtcctaccgttccgttccgttccccgaaccttcccg

SEQ ID NO: 327145 - DNA, 719 bp, Homo sapiens
  misc_feature: GZ8MTXP01DY342.8.42.D09.1.454.CMB.2.raw
  modified_base (219)..(219): a, c, t, g, unknown or other
  misc_feature (219)..(219): n is a, c, g, or t
  modified_base (227)..(227): a, c, t, g, unknown or other
  misc_feature (227)..(227): n is a, c, g, or t
  modified_base (291)..(291): a, c, t, g, unknown or other
  misc_feature (291)..(291): n is a, c, g, or t
  modified_base (339)..(339): a, c, t, g, unknown or other
  misc_feature (339)..(339): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcncgtggacnccagcagtgattacaatatatctcctgtaccaacaaccaccagacaaacgaccccaaactcatntattttagagtacaatacgcgcctacgacgggtcctgactcgtcttcncgacggtcctacccgtaagtcgtacggaccaaccgaacccggtcccttcccgtcgtaacccgttccgtaccgtcgggtacctaccgacgtacgtagaggtagtggaacggtcttaggtatttaacttacgagacgtacgtactactaacgttacgttacgaacggtaccgaacggtaaccgtaaacgggtaacgggttaacggtaccgggaacggggtaaaccggtaaaccgtaaacgggttaacccggtaacccggttaccggtaacggttaacccgtaaccggtaaccccggttaacggcccgttacccggtaaccccgtaccggttcccggtaccctacccgttcccgtttaacccccgttaacccccgtaaccccg

SEQ ID NO: 327146 - DNA, 530 bp, Homo sapiens
  misc_feature: GZ8MTXP01CZ2T8.8.42.D09.1.454.CMB.2.raw
  modified_base (238)..(238): a, c, t, g, unknown or other
  misc_feature (238)..(238): n is a, c, g, or t
  modified_base (317)..(317): a, c, t, g, unknown or other
  misc_feature (317)..(317): n is a, c, g, or t
  modified_base (324)..(324): a, c, t, g, unknown or other
  misc_feature (324)..(324): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctcgcgtccggtctcctggacagtcagtcaccatctctgcatggagccagcagtgattacaatntatctctgtaccaacaacaccaggacaacgccccaaactcatgtattttgagtcaataagcgcctgacgggtcctgacncgcttcncagctccagtctggaccaacgaccgcctcccgtgacccgttctcgtcgggctccagtactggaggacgtgacggctagtattatacgtgcagctacatattcgaggcagcagaggtactcggaggacggactaagtcgaccgttcgtacggcgacggccgaggccttccgtccccgtcggctacgtccttacgtcccaaccctccg

SEQ ID NO: 327147 - DNA, 622 bp, Homo sapiens
  misc_feature: GZ8MTXP01EO55J.8.42.D09.1.454.CMB.2.raw
  modified_base (225)..(225): a, c, t, g, unknown or other
  misc_feature (225)..(225): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggacnccagcagtgaattaacaactatactctctacgtaaccaacaacaccaggacaaacgaccccaaactcatgtattttgaggtacaataacggccgcctacgacggggtccctgactcgtcttctcgacgtctacccaagtcgtacgacaaccgaacccggccctcccgtacgtacccgtctcgtcgggtcctacagactgacggtagtggagcttagtatttactactgctagtctactatacttgagtcaacgacgaaacgtagggtacgtcgggacgggaaggtaccgtaagtaacggtaccggttacgtacggttaccgacggacccgaacggttcccgttaccgtccccgtaccggtcctaccgttccgttccgttccccgttcccgtaacccg

SEQ ID NO: 327148 - DNA, 611 bp, Homo sapiens
  misc_feature: GZ8MTXP01DVF8R.8.42.D09.1.454.CMB.2.raw
  modified_base (224)..(224): a, c, t, g, unknown or other
  misc_feature (224)..(224): n is a, c, g, or t
  modified_base (570)..(570): a, c, t, g, unknown or other
  misc_feature (570)..(570): n is a, c, g, or t
  modified_base (602)..(602): a, c, t, g, unknown or other
  misc_feature (602)..(602): n is a, c, g, or t
tcagctcgcgtgtccacgaccggtgctcgatttagacacatacgcaggggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctctgcactgganccagcagtgattacaactatatctctgtaccaacaacaccagacaaacgaccccaaactcatgtattttagaggtacaataacgccggccctacgacggggtccctgactcgtccttctcgacggtcctaccccaagttcgtacggaccaaaccgaacccggtcccttccccgtacgtacccgttccgtccgtcgggcccttaccgaacgtacgtaggagggtagtaggacggtcttaggttaatttattacgtgcaagtctactagttacttcgaggacagacaacgagggttacgtcgggacggaggacaaggtcgtacgttcgtacgttcgacgtccaggccnccgtccccgtcgtccactccttaccgtccccncccgtcccg

SEQ ID NO: 327149 - DNA, 621 bp, Homo sapiens
  misc_feature: GZ8MTXP01BPF4R.8.42.D09.1.454.CMB.2.raw
  modified_base (336)..(336): a, c, t, g, unknown or other
  misc_feature (336)..(336): n is a, c, g, or t
  modified_base (441)..(441): a, c, t, g, unknown or other
  misc_feature (441)..(441): n is a, c, g, or t
  modified_base (448)..(448): a, c, t, g, unknown or other
  misc_feature (448)..(448): n is a, c, g, or t
tcagctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcacatctcctgcactggagccagcagtgaattacaatatactctcctgtaccaacaacaccaggacaacgaccccaaatcatgtattttgagtacaataagccgcctacgacgggggtcctgactcgtcttcncgaggtcctacccgtaagtcgtacggaccaaccgaaccggtccctcccgtgacccgttctcgtgggcctcgagacgtgacggtatcggagtctagtatttatacngcacgtntacattactcgaggccaagccgaaacgtagggttacgttacgggcgggtaacgggaaccttaaggtccgtaaccggttccgtaaagggttacctaacggtaccccgaacggttccgacccggtcccccgtcggtccctacgtcccttcccgggttccccaaccccggttcccg

SEQ ID NO: 327150 - DNA, 659 bp, Homo sapiens
  misc_feature: GZ8MTXP01B5KQL.8.42.D09.1.454.CMB.2.raw
  modified_base (225)..(225): a, c, t, g, unknown or other
  misc_feature (225)..(225): n is a, c, g, or t
  modified_base (234)..(234): a, c, t, g, unknown or other
  misc_feature (234)..(234): n is a, c, g, or t
  modified_base (285)..(285): a, c, t, g, unknown or other
  misc_feature (285)..(285): n is a, c, g, or t
tcagctcgcgtgtccacgaccggtgctcgatttagacacatacgcaggggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgganccagcagtnattacaatatatctctgtaccaacaacaccagacaaacgccccaaatcatntatttgagtcaatagcgcctcgacgggtcctgactcgtcttctcaggcctacccaagtctggaccaacgaaccggccctccctgtaccgtctcgtcgggctacgagactgacggtatggagtctagtaactttattacgtgacctagtaccttactaattacgttacgacgggacaacgtacgaaacggtacggggttaacgttccggggacggggtaacggggtaacccgtaagggtttaaccggaaacccggtttccggtaacgggttaccgaaaccgggtaccccgaaacgggttcccgttcccggtcccccccggttagggtccctaacccgttcccggttacccgttccccccggttccccttccccgg

SEQ ID NO: 327151 - DNA, 637 bp, Homo sapiens
  misc_feature: GZ8MTXP01BLKPE.8.42.D09.1.454.CMB.2.raw
  modified_base (225)..(225): a, c, t, g, unknown or other
  misc_feature (225)..(225): n is a, c, g, or t
  modified_base (345)..(345): a, c, t, g, unknown or other
  misc_feature (345)..(345): n is a, c, g, or t
tcagctcgcgtgtccacgaccggtgctcgatttagacacatacgcaggggaaaggggggggtctcaggaggcagcgctctcaggacgtcaccaccatggcctgggctctgctcctcctcaccctcctcacccagggcacagggtcctgggcccagtctgccctgactcagcctccctccgcgtccgggtctcctggacagtcagtcaccatctcctgcactgganccagcagtgattacaactatatcctctgtaccaacaacaccaggacaaacgaccccaaatcatgtatttttgaggtacaaataacgccggaccctcgacggggtccctgactcgtcttcncaggctccaagtctggacaacgccgccctccctgaccctcgtcgtcgggctcagactgagagtgaggctagtactttattactgcagtcctatattagtcgtagggaccaacggtaccgaaacggtaggggttacgttacggggacgggtaacggggtaaccgtaagggttccgaacccggttacgttacggggtaccaccgggtacccgtaacgggttcccgttcccggttcccccgttccgggttactaacccgttcgttcccgttacccctaacttccccgttaacccg

SEQ ID NO: 327152 - DNA, 673 bp, Homo sapiens
  misc_feature: GZ8MTXP01CU110.8.42.D09.1.454.CMB.2.raw
  modified_base (224)..(224): a, c, t, g, unknown or other
  misc_feature (224)..(224): n is a, c, g, or t
  modified_base (233)..(233): a, c, t, g, unknown or other
  misc_feature (233)..(233): n is a, c, g, or t
  modified_base (333)..(333): a, c, t, g, unknown or other
  misc_feature (333)..(333): n is a, c, g, or t
tcagctcgcgtgtccacgaccggtgctcgatttagacacatacgcaggggaaaggggggggtctcaggaggcagcgctctcaggacgtcaccaccatggcctgggctctgctcctcctcaccctcctcactcagggcacagggtcctgggcccagtctgccctgactcagcctcctcgcgtccggtctcctggacagtcagtcaccatctcctgcacgtggacnccagcagtnaattaacaactatactctctgtaccaacaacaccagacaaacaccccaaatcatgtatttagagtacaatagccgcctgacgggtcctgtactcgcttcncgacggtctaccccgagtcgtaggaccaaaccgaacccggtccctcccgtacgtacccgttccgtcgtacggggcctaccgaacgtacgtaggacggagtaggacggtcgttagttaactttagttactgtacgtactactactaagttacgttacggtaacgacgaaacgacgtaaaccggtagggttacgttccggggacgggtacggtaaccgtaacggttaacggtacccggttaccggtacggttaccgtaacccggccgaaaccggttcccgttacccggtcccccgttcggtcccttaccgtcccgttccgttccccgttccccgtaaccccg

SEQ ID NO: 327153 - DNA, 630 bp, Homo sapiens
  misc_feature: GZ8MTXP01B8EZP.8.42.D09.1.454.CMB.2.raw
  modified_base (225)..(225): a, c, t, g, unknown or other
  misc_feature (225)..(225): n is a, c, g, or t
  modified_base (234)..(234): a, c, t, g, unknown or other
  misc_feature (234)..(234): n is a, c, g, or t
  modified_base (278)..(278): a, c, t, g, unknown or other
  misc_feature (278)..(278): n is a, c, g, or t
tcagctcgcgtgtccacgaccggtgctcgatttagacacatacgcaggggaaaggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctctgcactgganccagcagtnattacaatatatctctagaccaacacaccagacaacaccccaancatgtatttgagtacaatagccgccctgcgggtcctgactcgtcttctcgacggtcctacccgtaagtcgtacggaccaaccgacccggtccctcccgtcgtacccgtctcgtcgggcctacgacgtacgtggagtacgtggagtctagtatttacttacgcgactacgtcttaacctattacgttacggacgacgtaacgaccgtaaacggagggttacgtcgggaacggacgggtaacctaggttaaccgccgttacgttacggaccgacggcccgttaacggttcccgttcccggtcccccgtggtccctaccgttcccgttaccccgtccccttaacccgttccccgg

SEQ ID NO: 327154 - DNA, 753 bp, Homo sapiens
  misc_feature: GZ8MTXP01EZR7V.8.42.D09.1.454.CMB.2.raw
  modified_base (226)..(226): a, c, t, g, unknown or other
  misc_feature (226)..(226): n is a, c, g, or t
tcagctcgcgtgtccacgaccggtgctcgatttagacacatacgcaggggaaaggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactgganccagcagtgaattaacaacttatatctcctggtaccaacaacacccaggacaaacgcccccaaactcatgtactttttagagtacaataagcgccctcgacggggtccctgatcgtcttctcgacggctaccccaagtctcggacaaccgaaccggccctcccgtacgtacccgtccgtccgtccggggtcctcccgaaggtaccgttagggaacggtacgtacgggacggtaccgtttaggtaacttttaacgttaacccgttggacctaacggacctttaaccctaaggtttaactttaccggtaacgggcctaacggaaaccgtaaaccggttaagggggttaccgttaccgggggacggggtaacgggtaaaccgttaaggttaaccggtacccggttaaccggtacggttaccgaccggtaaccccggttaaacgggttcccgttcccggtcccccccggttcgtcccgtaacccggttcccttaccccggttaacccccttaacccccgtttaaccccggg

SEQ ID NO: 327155 - DNA, 731 bp, Homo sapiens
  misc_feature: GZ8MTXP01BSYP5.8.42.D09.1.454.CMB.2.raw
  modified_base (222)..(222): a, c, t, g, unknown or other
  misc_feature (222)..(222): n is a, c, g, or t
  modified_base (337)..(337): a, c, t, g, unknown or other
  misc_feature (337)..(337): n is a, c, g, or t
tcagctcgcgtgtccacgaccggtgctcgatttagacacatacgcagggaaagggggggtctcaggaggcagcgctctcaggacgtcaccaccatggcctgggctctgctcctcctcaccctcctcactcagggcacgagggtcctgggcccagtctgccctgactcagcctccctcgcgtccggtctcctggacagtcagtcaccatctcctgcactgganccagcagtgaattaacaactatactctctacgtaaccaacaaccacccagacaaacgccccaaatcatgtatttgagtacaatacgcgcctcgacgggtcctagactcgtcttcncgacgtcctacccgacgtcgtaggaccaaaccgaacccgggtcccttcccgtacggtaccccgttcttccggtcggggacccttaccgaacgacgttagggaacggtatcgggaacgtcgttaagttaactttaacttaccgtggacctaggacttaccgtagtttacgttacggaacgtaccgaaaggtaaccgtaaacgggtacggggttacggtaccgggggtaccgggggtaaaggtaacccggttaaggttaacccgggtacccgttcccggtaaacgggttaccgaacggttaccccgaacgggttcccgttaccccgggtcccccggttcgggtaaccccttccggttcccgtttacccccggtcccccgttcccccgtaaccccgg

SEQ ID NO: 327156 - DNA, 641 bp, Homo sapiens
  misc_feature: GZ8MTXP01DRP6I.8.42.D09.1.454.CMB.2.raw
  modified_base (195)..(195): a, c, t, g, unknown or other
  misc_feature (195)..(195): n is a, c, g, or t
  modified_base (219)..(219): a, c, t, g, unknown or other
  misc_feature (219)..(219): n is a, c, g, or t
  modified_base (239)..(239): a, c, t, g, unknown or other
  misc_feature (239)..(239): n is a, c, g, or t
  modified_base (244)..(244): a, c, t, g, unknown or other
  misc_feature (244)..(244): n is a, c, g, or t
  modified_base (450)..(450): a, c, t, g, unknown or other
  misc_feature (450)..(450): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctcctcgcgtccggtctcctggacngtcagtcacatctctgcactgganccagctagtgaattacaatntatcnctgtacaacaacaccagacaacgccccaaactcatcgtatttgagtacaataacgccgcctcgacgggtcctgactcgtcttctcgacgctacccaagtctggaccaaccgtaaccggccctcccgtcgtacccgttctccgtacgggcctacgacgtacctaggaggtacgtggaacggtcgttaaggtactttaacgttaccgngtacgtacgtacttacgtaagttacgtacgaacgacgtaacgacgtaacggtacgggtacggtacggggaacgggtacggtaacgtaacgggttaaccgtacggttaccggtacggttaccgtaccgtccggttaacgttccgttcccggtcccgtcgtcctaccgtccgttcccgtcccgttccgtcccg

SEQ ID NO: 327157 - DNA, 613 bp, Homo sapiens
  misc_feature: GZ8MTXP01AQHOQ.8.42.D09.1.454.CMB.2.raw
  modified_base (222)..(222): a, c, t, g, unknown or other
  misc_feature (222)..(222): n is a, c, g, or t
  modified_base (231)..(231): a, c, t, g, unknown or other
  misc_feature (231)..(231): n is a, c, g, or t
  modified_base (241)..(241): a, c, t, g, unknown or other
  misc_feature (241)..(241): n is a, c, g, or t
  modified_base (329)..(329): a, c, t, g, unknown or other
  misc_feature (329)..(329): n is a, c, g, or t
  modified_base (446)..(446): a, c, t, g, unknown or other
  misc_feature (446)..(446): n is a, c, g, or t
  modified_base (451)..(451): a, c, t, g, unknown or other
  misc_feature (451)..(451): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctctcactcagggcacagggtcctgggcccagtctgccctgactcagccctccctcgcgtccggtctcctggacagtcagtcaccatctcctgcactgganccagcagtnattacaactntatctctgtaccaacaacaccaggacaacgcccaactcatgtattttgagtcaataacgcgcctcgacggggtccctgactcgcttcncgacgcctaccagtctcggaccaaccgaaccgggtccctcccgtacgacccgttctccgtcgggtcctccgacgtacgtggaggtagtggaggtctaggtaatttactatcggacancctanacttaattccgagtcgagacgacgtacgggtagttaccggggacggtacggaaccgtaaggtccggtaaccgttcgttaaacggccgacggacccgttaacggccgttcccggtccccgtacgggtaacctctcccggttaccttaaccccgcccgttcccg

SEQ ID NO: 327158 - DNA, 668 bp, Homo sapiens
  misc_feature: GZ8MTXP01BK7VM.8.42.D09.1.454.CMB.2.raw
  modified_base (208)..(208): a, c, t, g, unknown or other
  misc_feature (208)..(208): n is a, c, g, or t
  modified_base (222)..(222): a, c, t, g, unknown or other
  misc_feature (222)..(222): n is a, c, g, or t
  modified_base (332)..(332): a, c, t, g, unknown or other
  misc_feature (332)..(332): n is a, c, g, or t
  modified_base (438)..(438): a, c, t, g, unknown or other
  misc_feature (438)..(438): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcacntctctgcactgganccagcagtgaattacaactatactctcctgtaccaacacaccagacaacgccccaaactcatgtattttgagtacaatacgcgcctacgacgggtcctgactcgtcttcncagtctaccccagtctaggccaacaaccgggtccctcccgtgtacccgttctcgtcgggcctaccgagtacgtgacggtatggacgtcgtagttatttacttacgngactagtacctagtaattacttacgaacgggaccaagtaccgtaaaccggtaaggggttaccgttacgggggaccgggtaacgggtaacctaagggttaaccgtacccgttcggtaccggttacgaacccgggtacccgaaacgggttccccgttacccgggtaaccccccgtttgggccccttaacccgttccgttaccccggttcccccgttccccgtttaacccccg

SEQ ID NO: 327159 - DNA, 666 bp, Homo sapiens
  misc_feature: GZ8MTXP01BH5T8.8.42.D09.1.454.CMB.2.raw
  modified_base (223)..(223): a, c, t, g, unknown or other
  misc_feature (223)..(223): n is a, c, g, or t
  modified_base (243)..(243): a, c, t, g, unknown or other
  misc_feature (243)..(243): n is a, c, g, or t
  modified_base (334)..(334): a, c, t, g, unknown or other
  misc_feature (334)..(334): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctcctcgcgtccgggtctcctggacagtcagtcaccatctcctgcactggacnccagcagtgaattacaactntactctctgtaccaacaacaccaggacaaacgccccaaatcatagtattttgagtcaatacgcgcctcgacggggtcctgactcgtcttcncgacggtctcccaagtctaggccaacgaacccggtccctcccgtacgtcccgttctacgtcggggaccttccgagtaccgtgtaacggtagtggaacggtcgttagtaactttaggttaactcgactacgtctactaacttcttacgacggacaacgaccgtaaacggtagggttaacggttcgggtaccggggtaacgggtacgtaaacggttcgggtaaacccgttggtacgggttaccgacgacccggaaccggttccgttacccggcccccgttacgggtcctaacccgttccgttaccccggttaacccccttaacccgttccccgg

SEQ ID NO: 327160 - DNA, 751 bp, Homo sapiens
  misc_feature: GZ8MTXP01E34I0.8.42.D09.1.454.CMB.2.raw
  modified_base (227)..(227): a, c, t, g, unknown or other
  misc_feature (227)..(227): n is a, c, g, or t
  modified_base (246)..(246): a, c, t, g, unknown or other
  misc_feature (246)..(246): n is a, c, g, or t
  modified_base (301)..(301): a, c, t, g, unknown or other
  misc_feature (301)..(301): n is a, c, g, or t
  modified_base (334)..(334): a, c, t, g, unknown or other
  misc_feature (334)..(334): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagccctccctccgcgtccgggtctccgtggacagtcagtccaccatctcctgcagtgganccagcagtgaattacaatntactctctgtacaacaacaccaggacaaacgccccaaatcatgtattttgagtanaataacgcgcctcgcgggtcctgatcgtcttcncgacggctacccaagtcgtacgacaaccgaaccggtcccttcccgtcgtacccgttctccgtgggtccctaccgtacgtaccgtagggaacggtagttacgggaggttaccgtaggttaaacttttaacgttaccgtcggttaacctaacggtaccgttaacgtaactttaagtttaccggtacggaacgaacggtaaccgaaacgggtttaaggggtaaccgttcccgggggaaaccggggtaaaccggggtaaacccgttaaagggttaacccggttaaacccggttacccggtaacggttaaacccgggaccggtaaccccgaacgggttccccttccccggaacccccggtttcgggttaaccctaacccgttccccggttcccttaaccccccgttaaccccgtttccccgg

SEQ ID NO: 327161 - DNA, 582 bp, Homo sapiens
  misc_feature: GZ8MTXP01DSCFQ.8.42.D09.1.454.CMB.2.raw
  modified_base (206)..(206): a, c, t, g, unknown or other
  misc_feature (206)..(206): n is a, c, g, or t
  modified_base (229)..(229): a, c, t, g, unknown or other
  misc_feature (229)..(229): n is a, c, g, or t
  modified_base (245)..(245): a, c, t, g, unknown or other
  misc_feature (245)..(245): n is a, c, g, or t
  modified_base (279)..(279): a, c, t, g, unknown or other
  misc_feature (279)..(279): n is a, c, g, or t
  modified_base (575)..(575): a, c, t, g, unknown or other
  misc_feature (575)..(575): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcaggcacagggtcctgggcccagtctgccctgactcagcctccctcgcgtccggtctcctggacagtcagtcaccntctctgcagtgagccagctagtntattacaatatactcnctgacaacaacaccaggacaacgcccaaatcatntatttgagtacaatagccgtccgtgtacgggtcctgatcgtcgttctcgacgtcctaccagtctacggacctaaccgacccggtaccctcccgtcgtaacccgttcgtccgtcgggctacgaacgtcaggtaggtactggtacgtatagtacgtttaatacgtgacgatctactaggtacttcgaggacacgtacgaacgtacggtacgtcggaccggtagaccgtagtcgtaccgttcgtacgttacgcgacggacgttccgttaccgcccgtcgtcctactcgttcctaacccncgtcccg

SEQ ID NO: 327162 - DNA, 578 bp, Homo sapiens
  misc_feature: GZ8MTXP01CGDMJ.8.42.D09.1.454.CMB.2.raw
  modified_base (198)..(198): a, c, t, g, unknown or other
  misc_feature (198)..(198): n is a, c, g, or t
  modified_base (222)..(222): a, c, t, g, unknown or other
  misc_feature (222)..(222): n is a, c, g, or t
  modified_base (231)..(231): a, c, t, g, unknown or other
  misc_feature (231)..(231): n is a, c, g, or t
  modified_base (274)..(274): a, c, t, g, unknown or other
  misc_feature (274)..(274): n is a, c, g, or t
  modified_base (290)..(290): a, c, t, g, unknown or other
  misc_feature (290)..(290): n is a, c, g, or t
  modified_base (343)..(343): a, c, t, g, unknown or other
  misc_feature (343)..(343): n is a, c, g, or t
  modified_base (405)..(405): a, c, t, g, unknown or other
  misc_feature (405)..(405): n is a, c, g, or t
  modified_base (412)..(412): a, c, t, g, unknown or other
  misc_feature (412)..(412): n is a, c, g, or t
  modified_base (539)..(539): a, c, t, g, unknown or other
  misc_feature (539)..(539): n is a, c, g, or t
  modified_base (571)..(571): a, c, t, g, unknown or other
  misc_feature (571)..(571): n is a, c, g, or t
tcagctcgcgtgtccacgaccggtgctcgatttagacacatacgcaggggaaagggggggggtctcaggaggcagcgctctcaggacgtcaccaccatggcctgggctctgctcctcctcaccctcctcactcagggcacagggtcctgggcccagtctgccctgactcagcctccctcgcgtccggtctccgtgacngtcagtcacatctctgcactgganccagcagtnattacatatatctctgtacaacacaccagacaacgcccaaacncatgtattttgacgtnaacgtagccgcctcgacgggtccctgctcgtcttctcacggtctacccagtcncggacaaacgccggtccctccgtcgacccgttcctcgtcgggcctacagtaccgtagagganggacgtntaggttattcgtaccgtgactacgtctaccgtaatacgttaccgagacaaggcaacgggtaggtacgttcgggacggtaacggtacaacgggttcgaaccgttcgtaacggttcgacgccgagttcncccgtcccgtagtcgacctcgttacgtccccnccgtccc

SEQ ID NO: 327163 - DNA, 719 bp, Homo sapiens
  misc_feature: GZ8MTXP01B03TA.8.42.D09.1.454.CMB.2.raw
  modified_base (209)..(209): a, c, t, g, unknown or other
  misc_feature (209)..(209): n is a, c, g, or t
  modified_base (214)..(215): a, c, t, g, unknown or other
  misc_feature (214)..(215): n is a, c, g, or t
  modified_base (222)..(222): a, c, t, g, unknown or other
  misc_feature (222)..(222): n is a, c, g, or t
  modified_base (226)..(226): a, c, t, g, unknown or other
  misc_feature (226)..(226): n is a, c, g, or t
  modified_base (231)..(231): a, c, t, g, unknown or other
  misc_feature (231)..(231): n is a, c, g, or t
  modified_base (240)..(240): a, c, t, g, unknown or other
  misc_feature (240)..(240): n is a, c, g, or t
  modified_base (244)..(244): a, c, t, g, unknown or other
  misc_feature (244)..(244): n is a, c, g, or t
  modified_base (251)..(251): a, c, t, g, unknown or other
  misc_feature (251)..(251): n is a, c, g, or t
  modified_base (263)..(263): a, c, t, g, unknown or other
  misc_feature (263)..(263): n is a, c, g, or t
  modified_base (269)..(269): a, c, t, g, unknown or other
  misc_feature (269)..(269): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtcctgccctgactcacgcctccctcgccgtccggtctcctggacagtcagtcacntctcnncactganccancagtnatacaactnatcnctgacanacacagacaacncccaancatgtatttagagtacaataacgccgtccctgacggggtccctgactcgtcttcgacgtacgcctaccacggtctacgggaccaaccgtacccggacccttcccgtacggtaacccgtccgttcgtcggggtaccttaccgaaggtaccgttagggacggttaacggcgggtaacgtcgttaaggttaacgttttaaacttccgtaaggccaacggttccgttaacgtacttttagttaaccggacggaccgtaacgttaaccggaaaccgggtaggggtttaaacgttacccggggaccgggggtaaacggttaaccggtaacggttaaccggtaaacccggtttacggaaacgggttcccgaaaccggaccggttaccggcccggttacccgtccccgtttcggccgtttacccggtccttacccgttcccccgggttcccttcccgg

SEQ ID NO: 327164 - DNA, 504 bp, Homo sapiens
  misc_feature: GZ8MTXP02G2RAT.8.42.D09.1.454.CMB.2.raw
  modified_base (220)..(220): a, c, t, g, unknown or other
  misc_feature (220)..(220): n is a, c, g, or t
  modified_base (305)..(305): a, c, t, g, unknown or other
  misc_feature (305)..(305): n is a, c, g, or t
  modified_base (314)..(314): a, c, t, g, unknown or other
  misc_feature (314)..(314): n is a, c, g, or t
tcagctcgcgtgtccacgaccggtgctcgatttagacacatacgcagggaaaggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgganccagcagtgattacaactatatctctggtaccaacaacacccaggcaaagcccccaaatcatgattttgagtcaataagcgcctnagggtcccngatcgcttctcaggctcccaagtctggcaacacggcctccctgaccgtctctgggctccagactgaggatgagctgattattactgcagctcatattcaggcagcaacagggtattcgggcggagggaccaagttcgacgtcctaggtcagcccaaggctacgccccgtggtcactctcgtcccacctcc

SEQ ID NO: 327165 - DNA, 536 bp, Homo sapiens
  misc_feature: GZ8MTXP02F5XX9.8.42.D09.1.454.CMB.2.raw
  modified_base (222)..(222): a, c, t, g, unknown or other
  misc_feature (222)..(222): n is a, c, g, or t
  modified_base (334)..(334): a, c, t, g, unknown or other
  misc_feature (334)..(334): n is a, c, g, or t
tcagctcgcgtgtccacgaccggtgctcgatttagacacatacgcagggaaaggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgganccagcagtgattacaactatatctcctggtaccaacaacacccagcaaacgcccccaaactcatgtattttgaggtcaataagcggccctcaggggtcccctgatcgcttcncaggctcccagtctggcaacaccggcctccctgacccgtctccgtgggctccagactgaggatgaggctagatttatactgcagctcatattcaggtcagcaaacgagggtattcgggcggaagggaccaagttcgaccgtcgtacggtcacggcccgaaggctcgcccccgtcggtaccactctcgttcccgcccttcccg

SEQ ID NO: 327166 - DNA, 551 bp, Homo sapiens
  misc_feature: GZ8MTXP02G9A5F.8.42.D09.1.454.CMB.2.raw
  modified_base (222)..(222): a, c, t, g, unknown or other
  misc_feature (222)..(222): n is a, c, g, or t
  modified_base (398)..(398): a, c, t, g, unknown or other
  misc_feature (398)..(398): n is a, c, g, or t
  modified_base (403)..(403): a, c, t, g, unknown or other
  misc_feature (403)..(403): n is a, c, g, or t
  modified_base (415)..(415): a, c, t, g, unknown or other
  misc_feature (415)..(415): n is a, c, g, or t
  modified_base (420)..(420): a, c, t, g, unknown or other
  misc_feature (420)..(420): n is a, c, g, or t
tcagctcgcgtgtccacgaccggtgctcgatttagacacatacgcagggaaaggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgganccagcagtgattacaactatatcctctgtaccaacaacacccagacaaacgaccccaaatcatgtattttgagtacaaataagccggcctgacgggtccctagatcgcttctcaggctacccaagtctgacaacacggcctcccgtgaccgtctcgtgggcctccagactgaggangagtntagtattatacngacanactactatatacgagacagacgaacgtaggtaggtacggacggacggaacgtaacgtacgtacgtacgtacgtacgacgaccgacgaccgtaccgtcccgtccgtaccgtactacgtccgtacctactccg

SEQ ID NO: 327167 - DNA, 520 bp, Homo sapiens
  misc_feature: GZ8MTXP02G6UA3.8.42.D09.1.454.CMB.2.raw
  modified_base (440)..(440): a, c, t, g, unknown or other
  misc_feature (440)..(440): n is a, c, g, or t
tcagctcgcgtgtccacgaccggtgctcgatttagacacatacgcagggaaaggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctctgtaccaacaacaccagcaaagccccaaactcatgattttgagtcaataagcgcctcaggggtccctgatcgcttctcaggctcccaagtctggcaacacggcctccctgaccgtctcgtcgggctccagacctgaggatgaggctgattattactgcagctcatattcaggcagcaaacagggtattcgggnggtaaggaccaaaggttcgaccgtcgtaggtcacgcccgaaaggctacggcccctcggtcacgtctcgtccccgcctccg

SEQ ID NO: 327168 - DNA, 551 bp, Homo sapiens
  misc_feature: GZ8MTXP02IGLS4.8.42.D09.1.454.CMB.2.raw
  modified_base (219)..(219): a, c, t, g, unknown or other
  misc_feature (219)..(219): n is a, c, g, or t
  modified_base (299)..(299): a, c, t, g, unknown or other
  misc_feature (299)..(299): n is a, c, g, or t
tcagctcgcgtgtccacgaccggtgctcgatttagacacatacgcagggaaaggggggtctcaggaggcagcgctctcaggacgtcaccaccatggcctgggctctgctcctcctcaccctcctcactcagggcacagggtcctgggcccagtctgccctgactcagcctcctcgcgtccggtctcctggacagtcagtcaccatctcctgcactgganccagcagtgattacaactatatctctgtacaacaacaccagcaacgccccaaatcatgattttgagtcaatagcgccctnagggtccctgatcgcttctcaggctcccaagtctggacaacacggccctccgtcgaccgtctcgtcgggctccagactgagatgaggctagattatactgacagctcatattcagtcagccaagtagggtagttcggcggaacgggacctaaaggttcgaaccggttccgtaggtaccgaacgacccgtaaacggtcctaccggtcccccgtcgggtccaccgttccttccggttacccctacccttccccg

SEQ ID NO: 327169 - DNA, 520 bp, Homo sapiens
  misc_feature: GZ8MTXP02F1BQD.8.42.D09.1.454.CMB.2.raw
tcagctcgcgtgtccacgaccggtgctcgatttagacacatacgcagggaaagggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaagcccccaaactcatgattttgagtcaataagcgccctcagggtcccctgatcgcttctcaggctcccaagtctggcaacacggcctccctgaccgtctctgggctccagactgaggatgagctgattattactgcagctcatattcaggcagcaacgagggtattcggcggaagggaccaaaggttcgaccgtacgtaggtcagtcccaaggctcgcccccgtggtcacgtctcgttccccgcctcccg

SEQ ID NO: 327170 - DNA, 517 bp, Homo sapiens
  misc_feature: GZ8MTXP02JJSKO.8.42.D09.1.454.CMB.2.raw
tcagctcgcgtgtccacgaccggtgctcgatttagacacatacgcagggaaaggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctctggtaccaacaacacccaggcaaacgccccaaactcatgattttgagtcaataagcggccctcaggggtccctgactcgcttctcacggctccccaagtctggcaacacggcctccctgaccgtctcgtgggctccagactgaggatgaggctgattatactgcagctcatattcgaggcaagcaaacgagggtatcggacggaggaccaagttcgacgtcaggtcacgccaaggcctcgccccgtcggtcacgtctcgtcccacctccg

SEQ ID NO: 327171 - DNA, 586 bp, Homo sapiens
  misc_feature: GZ8MTXP02G6OWM.8.42.D09.1.454.CMB.2.raw
tcagctcgcgtgtccacgaccggtgctcgatttagacacatacgcagggaaaggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctctgtaccaacaacacccaggacaaacgcccccaaatcatgattttgaggtcaaataagcggccctcgacggggtccctgatcgcttctcagctccccaagtctggacaacaccggcctcccgtgacccgtctcgtgggctccagacctgacggatgaggctgtattattactgacagctacattacttcgaggcagacaaacggtagggttagttcgggacgggtacggggacctaaagggttcggtaacccggttccgtaacgggtccaacggaccccgaaggccctaccggcccccgtcggtacctaccgtcccgttccccacccgtcccgtacccgg

SEQ ID NO: 327172 - DNA, 523 bp, Homo sapiens
  misc_feature: GZ8MTXP02I3RMW.8.42.D09.1.454.CMB.2.raw
  modified_base (223)..(223): a, c, t, g, unknown or other
  misc_feature (223)..(223): n is a, c, g, or t
tcagctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgganccagcagtgattacaactatatctctgtaccaacaacaccagcaaacgcccccaaactcatgattttgagtcaatagcgcctcagggtccctgatcgcttctcaggctcccaagtctggcaacacggcctccctgacccgtctcgtcgggctccgagactgagatgagctgattatactgcagctcatattcaggcagaccaaagagggtattcgggcggaaggaccaaggttacgaccgtcgtacggtcaacgccgaaacgctacgccccgtcggtccactcctcgttcccgcctcccg

SEQ ID NO: 327173 - DNA, 536 bp, Homo sapiens
  misc_feature: GZ8MTXP02HTYQI.8.42.D09.1.454.CMB.2.raw
  modified_base (222)..(222): a, c, t, g, unknown or other
  misc_feature (222)..(222): n is a, c, g, or t
  modified_base (231)..(231): a, c, t, g, unknown or other
  misc_feature (231)..(231): n is a, c, g, or t
  modified_base (286)..(286): a, c, t, g, unknown or other
  misc_feature (286)..(286): n is a, c, g, or t
  modified_base (418)..(418): a, c, t, g, unknown or other
  misc_feature (418)..(418): n is a, c, g, or t
tcagctcgcgtgtccacgaccggtgctcgatttagacacatacgcagggaaaggggggtctcaggaggcagcgctctcaggacgtcaccaccatggcctgggctctgctcctcctcaccctcctcactcagggcacagggtcctgggcccagtctgccctgactcagccctccctccgcgtccggtctcctggacagtcagtcaccatctcctgcactgganccagcagtnattacaactatatctctgtaccaacaacacccaggacaaacgccccaaactcatnattttgaggtcaataagcggccctgacgggtccctgatcgcttctcagctcccaagtctgacaacaccggcctcccgtgacccgtctccgtgggcctccagactgaggatggaggctgatttatactgcagntcatattcagcagacaacgaggtatcggcggaggactagtcgaccgtcgtacgtcgacgccgaacggcctcgtcccccgtcggtcctacctccgttaccgtccccctacccgtccccg

SEQ ID NO: 327174 - DNA, 564 bp, Homo sapiens
  misc_feature: GZ8MTXP02II8TJ.8.42.D09.1.454.CMB.2.raw
  modified_base (209)..(209): a, c, t, g, unknown or other
  misc_feature (209)..(209): n is a, c, g, or t
  modified_base (221)..(221): a, c, t, g, unknown or other
  misc_feature (221)..(221): n is a, c, g, or t
  modified_base (230)..(230): a, c, t, g, unknown or other
  misc_feature (230)..(230): n is a, c, g, or t
  modified_base (431)..(431): a, c, t, g, unknown or other
  misc_feature (431)..(431): n is a, c, g, or t
tcagctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagcctcctccgcgtccggtctcctggacagtcagtcaccatcncctgcactgganccagcagtnattacaactatatctctgtaccaacaacaccaggacaaacgaccccaaactcatagtattttgaggtacaataagccggccctgacggggtccctgactcgcttctcaggctcccaagtctggacaacaccggccctccgtgaccgtctaccgtcgggctaccagactgaggatggaggctagtatttatactgcagctanatattcgaggcagcaaacgtagggtacttcgggcggaacggacctaggttacgaccgtacgtacggtacacggtcccgaacggtcctaccggccccgtcggtacctaccgttctccgtttcccacccgtcccg

SEQ ID NO: 327175 - DNA, 502 bp, Homo sapiens
  misc_feature: GZ8MTXP02F6JQ0.8.42.D09.1.454.CMB.2.raw
  modified_base (222)..(222): a, c, t, g, unknown or other
  misc_feature (222)..(222): n is a, c, g, or t
  modified_base (426)..(426): a, c, t, g, unknown or other
  misc_feature (426)..(426): n is a, c, g, or t
tcagctcgcgtgtccacgaccggtgctcgatttagacacatacgcagggaaaggggggtctcaggaggcagcgctctcaggacgtcaccaccatggcctgggctctgctcctcctcaccctcctcactcagagcacagggtcctgggcccagtctgccctgactcagcctccctccgcgtccgggtctcctggacagtcagtcaccatctcctgcactgganccagcagtgattacaactatatctcctggtaccaacaacaccaggcaaacgcccccaaactcatgattttgagtcaataagcggccctcaggggtccctgatcgcttctcaggcctccaagtctggcaacacggcctccctgaccgtctctgggctccagctgagatgagctgattatactgcagctcatatcaggcagcaacngggtatcggcggaggaccaagttcgacgtccgtagtcacgcccaaggcctgcccccgtgtccactctcgtccaccc

SEQ ID NO: 327176 - DNA, 710 bp, Homo sapiens
  misc_feature: GZ8MTXP02GHW40.8.42.D09.1.454.CMB.2.raw
  modified_base (223)..(223): a, c, t, g, unknown or other
  misc_feature (223)..(223): n is a, c, g, or t
tcagctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgganccagcagtgattacaatatatctctgtaccaacaacacccaggacaaacgcccccaaactcatgtattttgaggtacaataagcggccctcgacgggtccctgatcgcttctcaggtcctacccaagtctcggacaacaccggccctcccgtcgtacccgtctcgtcgggacctccgagtaccgtggacggagtggaacggtcttagtactttaattacgtgacgtacgtacttacctaattacgtttacgacggtaccgaacgaaccgtaaacggtacggggttacgttaccgggggacggggaaacgggggtaaacccgttaaacgggtttaccggtaacccccggttaccggttaaacggggttacccgtaaacgggtacccccggaaaacgggtccccgttacccggtaacccccccgttcgggttacccctaacccgttcccgtttaacccggtttccccccgtaaccccctttacccccgg

SEQ ID NO: 327177 - DNA, 552 bp, Homo sapiens
  misc_feature: GZ8MTXP02GFAI5.8.42.D09.1.454.CMB.2.raw
  modified_base (224)..(224): a, c, t, g, unknown or other
  misc_feature (224)..(224): n is a, c, g, or t
  modified_base (243)..(243): a, c, t, g, unknown or other
  misc_feature (243)..(243): n is a, c, g, or t
tcagctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatcctcctgcactgganccagcagtgattacaactntatctctgtaccaacaacaccagcaaacgacccccaaactcatgtattttgagtacaataacgcggccctcgacgggtccctgatcgtcttctcaggctcccaagtctcggacaacaccggcctccctcgaccgtctcgtcgggctccgagactcgaggatgagctagattatactgcagctcattatcaggacagacaacgagggttacgtcggacggacggactaaaggttcggaccgtcgtaacggtcacggacccgaacggcctcgaaccccgtcgtccacttccgtacgttccccaccctcccg

SEQ ID NO: 327178 - DNA, 730 bp, Homo sapiens
  misc_feature: GZ8MTXP02F1O9Y.8.42.D09.1.454.CMB.2.raw
  modified_base (224)..(224): a, c, t, g, unknown or other
  misc_feature (224)..(224): n is a, c, g, or t
  modified_base (286)..(286): a, c, t, g, unknown or other
  misc_feature (286)..(286): n is a, c, g, or t
tcagctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggacnccagcagtgattacaactatatctctggtaccaacaacaccagcaaacgccccaaactcatntattttgagtcaatagcgcctcgacggggtccctgactcgtcttcgtcgacggctaccccaagtctacggaccaacgaccggccctcccgtcgacccgtctccgtcgggacctccgaagtactggaacggagttacgggaacgggtccttaggtaacttttaagtttaaccgttggtacccgagtaccttacctaaagtttactttaccggaacgggtaccgtaacgtaaaccgaaaaccggttaagggggttaaccgtttaccgggggaccggggaaaaccgggggtaacccgtaaaacgggttttccgggaaaaccccggtttccggtaacggggttaacccgaccgaacccgggttaaacggcccgttaacccggccccccgttaacgggtccctaacccggtttcccgttaccctttcccccggtaacccctttccccgg

SEQ ID NO: 327179 - DNA, 620 bp, Homo sapiens
  misc_feature: GZ8MTXP02HMW0H.8.42.D09.1.454.CMB.2.raw
  modified_base (223)..(223): a, c, t, g, unknown or other
  misc_feature (223)..(223): n is a, c, g, or t
  modified_base (232)..(232): a, c, t, g, unknown or other
  misc_feature (232)..(232): n is a, c, g, or t
tcagctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgganccagcagtnattacaactatatctctgtaccaacaacaccaggacaaacgccccaaactcatgtattttgagtcaatagcggccctcgacgggtcctgactcgcttctcaggctacccagtctgacaacaccggcctcccgtcgacccgtctccgtcgggcctccgacgacgtgaggatggaggctagtatttatactgcagtcttacattacttacgacgtcgacgaccgaaacggtagggttacgttaccggggacgggtaacgggtaaccgtaagggttacgacccggttaccgtaacggtaccgaaccggtaccccgaaacggtcccgttacccgcccccggttcggtacctacccgttccgttcccggtttccccccgtacccttcccccgg

SEQ ID NO: 327180 - DNA, 560 bp, Homo sapiens
  misc_feature: GZ8MTXP02G2MX0.8.42.D09.1.454.CMB.2.raw
  modified_base (197)..(197): a, c, t, g, unknown or other
  misc_feature (197)..(197): n is a, c, g, or t
  modified_base (223)..(223): a, c, t, g, unknown or other
  misc_feature (223)..(223): n is a, c, g, or t
  modified_base (311)..(311): a, c, t, g, unknown or other
  misc_feature (311)..(311): n is a, c, g, or t
tcagctcgcgtgtccacgaccggtgctcgatttagacacatacgcagggaaaggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacngtcagtcaccatctcctgcactgganccagcagtgattacaactatatctctggtaccaacaacacccaggacaaacgcccccaaactcatgtattttgagtcaataagcgccncgagggtccctgactcgcttctcaggtctcccaagtctggacaacaccggcctcccgtgaccgtctcgtcgggcctccgagtacctgacggatggaggtctagtattattactgacagctctatattcgaggcaagacaacgtaggggttaactcgggacggaggggaactaaggttcgacccgtcgtacgggtcaacgacccgaacgtctccgccccgtcggacactcgtaccgtcccctacctcccg

SEQ ID NO: 327181 - DNA, 512 bp, Homo sapiens
  misc_feature: GZ8MTXP02FSIZK.8.42.D09.1.454.CMB.2.raw
  modified_base (223)..(223): a, c, t, g, unknown or other
  misc_feature (223)..(223): n is a, c, g, or t
  modified_base (282)..(282): a, c, t, g, unknown or other
  misc_feature (282)..(282): n is a, c, g, or t
  modified_base (405)..(405): a, c, t, g, unknown or other
  misc_feature (405)..(405): n is a, c, g, or t
  modified_base (437)..(437): a, c, t, g, unknown or other
  misc_feature (437)..(437): n is a, c, g, or t
  modified_base (504)..(504): a, c, t, g, unknown or other
  misc_feature (504)..(504): n is a, c, g, or t
tcagctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgganccagcagtgattacaatatatctctgtaccaacaacaccagcaaagccccaaactcatnattttgaggtcaataagcgcctcaggggtccctgatcgcttctcaggctcccaagtctgcaacacggcctcctcgaccgtctctgggctcagactgagatgaggctgattatactgcagctanatattcgaggcagacaacgtaggtagttcggnggaaggaccaagttcgaccgttcgtaggtcacgtacccaagctcgccccgtcgtcactctcgtcccnccgtaccc

SEQ ID NO: 327182 - DNA, 584 bp, Homo sapiens
  misc_feature: GZ8MTXP02I75U5.8.42.D09.1.454.CMB.2.raw
  modified_base (222)..(222): a, c, t, g, unknown or other
  misc_feature (222)..(222): n is a, c, g, or t
  modified_base (426)..(426): a, c, t, g, unknown or other
  misc_feature (426)..(426): n is a, c, g, or t
tcagctcgcgtgtccacgaccggtgctcgatttagacacatacgcagggaaaggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgganccagcagtgattacaactatatctcctggtaccaacaacaccaggacaaacgcccccaaatcatgtattttgaggtcaataagcggccctcgaggggtccctggactcgcttctcaggtcctccccaagtctggacaacgaccggcctcccgtgaccgtctcgtcgggctccagactgaggatgaggctagacttatactgacngctctatagttcaggtcaagcaaacgtagggttacgttcgggacggggtagggaacccgtaaggtttacggacccggttcgtacgggtaccaacggacccgaaacggcctaccgcccccgttcggtcctacgtccgtccgtttccccgcccttccccg

SEQ ID NO: 327183 - DNA, 550 bp, Homo sapiens
  misc_feature: GZ8MTXP02GPN8T.8.42.D09.1.454.CMB.2.raw
tcagctcgcgtgtccacgaccggtgctcgatttagacacatacgcagggaaaggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctctgtaccaacaacaccagcaaacgcccccaaatcatgtattttgagtcaataagcgccctcgacggggtccctgactcgtcttctcaggctacccaagtctggacaacgaccggccctcccgtcgacccgtctcgtcgggctccgagactgacggatgaggctagtattattactgcagctcatacttcgaggtcagacaacgagggtatacgggcggagggtaccaaggttcgaccgttcgtacggtcacgaccgaacggcctaccgccccgtcggtccactccgtcgtaccccaccctcccg

SEQ ID NO: 327184 - DNA, 530 bp, Homo sapiens
  misc_feature: GZ8MTXP02JRH2R.8.42.D09.1.454.CMB.2.raw
  modified_base (222)..(222): a, c, t, g, unknown or other
  misc_feature (222)..(222): n is a, c, g, or t
  modified_base (413)..(413): a, c, t, g, unknown or other
  misc_feature (413)..(413): n is a, c, g, or t
  modified_base (446)..(446): a, c, t, g, unknown or other
  misc_feature (446)..(446): n is a, c, g, or t
  modified_base (458)..(458): a, c, t, g, unknown or other
  misc_feature (458)..(458): n is a, c, g, or t
  modified_base (505)..(505): a, c, t, g, unknown or other
  misc_feature (505)..(505): n is a, c, g, or t
  modified_base (525)..(525): a, c, t, g, unknown or other
  misc_feature (525)..(525): n is a, c, g, or t
tcagctcgcgtgtccacgaccggtgctcgatttagacacatacgcagggaaaggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgganccagcagtgattacaactatatctcctggtaccaacaacacccaggcaaacgcccccaaatcatgattttgagtcaataagcggccctcaggggtcccctgactcgcttctcacggctcccaagtctaggccaacgaccggcctccgtcgaccgtctccgtgggcctcagactgacggatcgagctgattntactgacagtctctatacttgaggcagcaacgngggtaactcggnggacgggacaagttcgaccgtcacggtcacgaccgagcacgccccgnggtccactctcgttaccccnctccg

SEQ ID NO: 327185 - DNA, 514 bp, Homo sapiens
  misc_feature: GZ8MTXP02JVADG.8.42.D09.1.454.CMB.2.raw
tcagctcgcgtgtccacgaccggtgctcgatttagacacatacgcagggaaagggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctctggtaccaacaacaccagcaaagccccaaactcatgattttgagtcaataagcggcctcaggggtccctgatcgcttctcaggctcccaagtctggcaacacggctccctgaccgtctctgggctccagacctgaggatgaggctgattattactgcagctcatattcaggcagcaaacgagggtatcggcggagggaaccaagttcgaccgtctaacggtcacgcccaaggctcgccccgtcggtacactcgtcgtcccgcctcccg

SEQ ID NO: 327186 - DNA, 506 bp, Homo sapiens
  misc_feature: GZ8MTXP02G7VQI.8.42.D09.1.454.CMB.2.raw
  modified_base (222)..(222): a, c, t, g, unknown or other
  misc_feature (222)..(222): n is a, c, g, or t
tcagctcgcgtgtccacgaccggtgctcgatttagacacatacgcagggaaaggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgganccagcagtgattacaactatatctctgtaccaacaacacccaggcaaacgccccaaatcatgattttgagtcaataagcgcctcgagggtccctgatcgcttctcaggctcccaagtctggcaacgacggcctccctgaccgtctcgtgggctccagactgaggatgaggctgattatactgcagctcatattcaggcagcaaacgagggtatcggcggagggaccaagttcgaccgtctagtcacgcccaaggctcgcccctgtcactctcgtcccacctccc

SEQ ID NO: 327187 - DNA, 522 bp, Homo sapiens
  misc_feature: GZ8MTXP02FH6YM.8.42.D09.1.454.CMB.2.raw
  modified_base (222)..(222): a, c, t, g, unknown or other
  misc_feature (222)..(222): n is a, c, g, or t
  modified_base (331)..(331): a, c, t, g, unknown or other
  misc_feature (331)..(331): n is a, c, g, or t
  modified_base (412)..(412): a, c, t, g, unknown or other
  misc_feature (412)..(412): n is a, c, g, or t
tcagctcgcgtgtccacgaccggtgctcgatttagacacatacgcagggaaaggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgganccagcagtgattacaactatatctcctggtaccaacaacacccaggcaaagcccccaaactcatgattttgagtcaataagcggccctcaggggtccctgatcgcttcncaggctcccaagtctgcaacacggcctccctgaccgtctctgggctccagactgaggatgagctgattattactgcagctnatattcaggtcagcaacaggggtaattcgggcggagggaccgaagttcggaccgtcctaggtcacgcccaaggctacgccccctcggtcactctacgtccccacctcccg

SEQ ID NO: 327188 - DNA, 667 bp, Homo sapiens
  misc_feature: GZ8MTXP02GZTYQ.8.42.D09.1.454.CMB.2.raw
  modified_base (221)..(221): a, c, t, g, unknown or other
  misc_feature (221)..(221): n is a, c, g, or t
  modified_base (230)..(230): a, c, t, g, unknown or other
  misc_feature (230)..(230): n is a, c, g, or t
tcagctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagcctccctcgcgtccggtctcctggacagtcagtcaccatctcctgcactgganccagcagtnattacaactatatctctgtaccaacaacaccaggcaaacgcccccaaatcatgtattttgaggtacaaataagccgccctcgacggggtcccctgactcgcttctcaggctaccccaagtctggacaacaccggccctcccgtgacccgtctccgtcgggtctcgtaagactgaacggtatcggagctagtagttattacgtgtacagtcctactaattacttcgagggacaaggacccaaaggtacgggttagtacggggacgggtaacggggtacccgtaaaaggttccggaaacccggttaccgttaacgggtacccgaaaccgggaccccgaaaacggggtcccttacccgggtaacccccccggtttccggggtaaccctacccgtttcccgtttaccccggtttacccccctaacccccgttttacccccg

SEQ ID NO: 327189 - DNA, 640 bp, Homo sapiens
  misc_feature: GZ8MTXP02H5TLY.8.42.D09.1.454.CMB.2.raw
  modified_base (242)..(242): a, c, t, g, unknown or other
  misc_feature (242)..(242): n is a, c, g, or t
  modified_base (282)..(282): a, c, t, g, unknown or other
  misc_feature (282)..(282): n is a, c, g, or t
tcagctcgcgtgtccacgaccggtgctcgatttagacacatacgcagggaaagggggggtctcaggaggcagcgctctcaggacgtcaccaccatggcctgggctctgctcctcctcacccctcctcactcagggcacagggtcctgggcccagtctgccctgactcagcctcctccgccgtccggtctcctggacagtcagtcaccatctcctgcactggagccagcagtgattacaactntatcctctgtaccaacaacaccagacaaacgcccccaaancatgtattttgagtcaataagccggcctcgaggggtccctgactcgcttctcaggtctacccaagtctggacctaacgaccggccctcccgtcgacccgtcctcgtcgggtcctccagtactgaggatggaggcttagtaatttacttactgctagcttactattacttcgacggacaaggacaaaccggtaggggttacgtaccggggacgggaacggggtaaacctaacgggtttacggaccccggttaccgtaacgggttacccgaacggtacccgaaacggggtcctacccggtccccccgttcggttacccacccgttccgttccccggtttaccccctaccccgttaccccg

SEQ ID NO: 327190 - DNA, 533 bp, Homo sapiens
  misc_feature: GZ8MTXP02GQ5H6.8.42.D09.1.454.CMB.2.raw
  modified_base (223)..(223): a, c, t, g, unknown or other
  misc_feature (223)..(223): n is a, c, g, or t
  modified_base (232)..(232): a, c, t, g, unknown or other
  misc_feature (232)..(232): n is a, c, g, or t
tcagctcgcgtgtccacgaccggtgctcgatttagacacatacgcagggaaaggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatcctcctgcactgganccagcagtnattacaatatatctctggtaccaacaacacccaggcaaagcccccaaactcatgattttgaggtcaataagcgccctcaggggtccctgatcgcttctcaggctcccaagtctggcaacaccggcctccctcgaccgtctctgggctccgagactgaggatgaggctgattatactgcagctcaatattcagcagacaacgtagggtattcgggcggagggacaaggttcgaccgtctacggtcgacgacccgaacggccacgcccccgtcggtacctactctcgttccccacccttcccg

SEQ ID NO: 327191 - DNA, 640 bp, Homo sapiens
  misc_feature: GZ8MTXP02GOG85.8.42.D09.1.454.CMB.2.raw
  modified_base (223)..(223): a, c, t, g, unknown or other
  misc_feature (223)..(223): n is a, c, g, or t
  modified_base (284)..(284): a, c, t, g, unknown or other
  misc_feature (284)..(284): n is a, c, g, or t
  modified_base (410)..(410): a, c, t, g, unknown or other
  misc_feature (410)..(410): n is a, c, g, or t
tcagctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgganccagcagtgattacaactatatctctgtaccaacaacaccagcaaacgccccaaactcatntattttgagtcaataagcgccctcgagggtccctgactcgtcttcgtcaggtcctcccgtaaagtctggacaacgaccggccctcccgtcgacccgtctccgtcgggctaccagacctgaggtagngaggctagattattacgtgactagtacctctattaactttaccagggcaaggaccaaacgtaagggttaacgttcgggacgggaacggggtaaccctaaagggttcgaaacccgtccgttaacggggtaccctacgggaccccgtaaaaggttcccgaacccgtccccccgttcggggtaccctaaccgttccccgttccggttaccccccggtcccctttaacccccgg

SEQ ID NO: 327192 - DNA, 590 bp, Homo sapiens
  misc_feature: GZ8MTXP02F4N0X.8.42.D09.1.454.CMB.2.raw
  modified_base (409)..(409): a, c, t, g, unknown or other
  misc_feature (409)..(409): n is a, c, g, or t
tcagctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctgtaccaacaacacccaggacaaacgacccccaaactcatgtattttgagtcaataagccggccctcgacggggtccctgactcgcttctcaggctccccaagtctggccaacgaccggccctcccgtcgacccgtctcgtcgggctccgagactgaggntgaggctagattatactgcagctacattacttcgaggcaagaccaaagagggttagttcgggacgggaagggtaccgtaaggttcggacccgttaccgtacgggtaccacggacccgaacggtccgtaccggcccccgtacggtcctaccgttccgtccgttacccccacccgtttccccg

SEQ ID NO: 327193 - DNA, 563 bp, Homo sapiens
  misc_feature: GZ8MTXP02HN7Z4.8.42.D09.1.454.CMB.2.raw
  modified_base (196)..(196): a, c, t, g, unknown or other
  misc_feature (196)..(196): n is a, c, g, or t
  modified_base (222)..(222): a, c, t, g, unknown or other
  misc_feature (222)..(222): n is a, c, g, or t
  modified_base (231)..(231): a, c, t, g, unknown or other
  misc_feature (231)..(231): n is a, c, g, or t
  modified_base (241)..(241): a, c, t, g, unknown or other
  misc_feature (241)..(241): n is a, c, g, or t
  modified_base (441)..(441): a, c, t, g, unknown or other
  misc_feature (441)..(441): n is a, c, g, or t
tcagctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacngtcagtcaccatctcctgcactgganccagcagtnattacaactntatctctgtaccaacaacaccagcaaacgccccaaatcatgtattttgagtcaataacgcggccctcgacggggtccctgactcgtcttctcacggctacccaagtctggacaacgaccggcctcccgtcgacccgtctccgtacgggctaccacgactcgaggatggagtctgtattatacgtgcagcttacattactnagacagacgaacgtaggtacttcgggacggaacggaccgaagttcggaccgttcgtacgtccgacgacccgaacggcctaccgccccgttcgcctaccgtccttccgtccccgtacctcccg

SEQ ID NO: 327194 - DNA, 589 bp, Homo sapiens
  misc_feature: GZ8MTXP02IU2K4.8.42.D09.1.454.CMB.2.raw
  modified_base (223)..(223): a, c, t, g, unknown or other
  misc_feature (223)..(223): n is a, c, g, or t
  modified_base (232)..(232): a, c, t, g, unknown or other
  misc_feature (232)..(232): n is a, c, g, or t
  modified_base (242)..(242): a, c, t, g, unknown or other
  misc_feature (242)..(242): n is a, c, g, or t
tcagctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgganccagcagtnattacaactntatctctgtacaacacaccagacaacgccccaaactcatgtattttgagtacaatacgcgccctcgacgggtccctgactcgcttctcacggctaccaagtctcggacaacaccggcctcccgtgaccgtctcgtcgggctccgagactgaggatgaggctgtattagttactgctagctactatattcgaggacagaacgaacgtagggtacgtcgggacgggtaacgggaacctaaggttcgaccggttccgtacggtaccgacgtacccgaaacggtccgtacccggtcccccgttcggtaccctaccgttacccgttcccgttaccccctacccgttaccccg

SEQ ID NO: 327195 - DNA, 523 bp, Homo sapiens
  misc_feature: GZ8MTXP02IT27J.8.42.D09.1.454.CMB.2.raw
  modified_base (222)..(222): a, c, t, g, unknown or other
  misc_feature (222)..(222): n is a, c, g, or t
  modified_base (279)..(279): a, c, t, g, unknown or other
  misc_feature (279)..(279): n is a, c, g, or t
  modified_base (414)..(414): a, c, t, g, unknown or other
  misc_feature (414)..(414): n is a, c, g, or t
tcagctcgcgtgtccacgaccggtgctcgatttagacacatacgcagggaaaggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgganccagcagtgattacaactatatctctgtaccaacaacaccagcaaacgccccaaacncatgtattttgagtcaataagcgccctcgacgggtccctgatcgcttctcaggctcccaagtctggacaacgaccggccctcccgtcgaccgtctcgtcggctccagactgagatgagctagtattatactgacngactacatacttgagcagacaacgaggtacgtcggacggaggaacctagtcgacgtcgtacgtcacgccgaacgctccgccccgtcggtcacgtctcgtcccgcctccg

SEQ ID NO: 327196 - DNA, 624 bp, Homo sapiens
  misc_feature: GZ8MTXP02IS8C3.8.42.D09.1.454.CMB.2.raw
  modified_base (223)..(223): a, c, t, g, unknown or other
  misc_feature (223)..(223): n is a, c, g, or t
  modified_base (232)..(232): a, c, t, g, unknown or other
  misc_feature (232)..(232): n is a, c, g, or t
  modified_base (242)..(242): a, c, t, g, unknown or other
  misc_feature (242)..(242): n is a, c, g, or t
tcagctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgganccagcagtnaattacaatntatctctgtaccaacaacaccagcaacgccccaaactcatgattttgagtcaataacgcggccctcgacgggtccctgatcgcttctcaggtctacccgaagtctcggacaaacgaccggccctcccgtgtacccgtctccgttggggcctccgacgactggaggtatggaggctagtatttagtttaactgcacgtctactaattacgttacgaggtacaacgtacgaacggtaagggttacgttcggggacgggtaacggtacgtaacggttaccggtaaccggttcggtaacggtaccgaaccggtacccgaacggtcctacccggccccgttcggtaccctaccgttccgttaccccgttaccccctacccgttcccg

SEQ ID NO: 327197 - DNA, 567 bp, Homo sapiens
  misc_feature: GZ8MTXP02HVK4F.8.42.D09.1.454.CMB.2.raw
  modified_base (215)..(215): a, c, t, g, unknown or other
  misc_feature (215)..(215): n is a, c, g, or t
  modified_base (222)..(222): a, c, t, g, unknown or other
  misc_feature (222)..(222): n is a, c, g, or t
  modified_base (294)..(294): a, c, t, g, unknown or other
  misc_feature (294)..(294): n is a, c, g, or t
  modified_base (303)..(303): a, c, t, g, unknown or other
  misc_feature (303)..(303): n is a, c, g, or t
tcagctcgcgtgtccacgaccggtgctcgatttagacacatacgcagggaagggggtctcaggaggcagcgctctcaggacgtcaccaccatggcctgggctctgctcctcctcaccctcctcactcagggcacagggtcctgggcccagtctgccctgactcagcctcctccgcgtccgggtctcctggacagtcagtcaccatctcctgcacngagcagnagtgtatacaactatatctctacgacaacaacaccacgacaaccacccaacacatatatttagtagtacaanacgacgccncgacggtcgtgactcgtctctcgacgctaccgtacgtacgtacgacacgaccgcctcctcgtacgtcgtcgtcgtcgacgacgtacgtagagagtagagtcgtagtattagttacgtacgtacgtacgtactactactatacgtacgacgacgacgaacgtaggtacggtacggacggacggaacgtaacgtacgtacgtacgtacgtacgacgaccgacgacgccgtcccgtccgtaccgtactcctaccgtacctacctccg

SEQ ID NO: 327198 - DNA, 553 bp, Homo sapiens
  misc_feature: GZ8MTXP02F4TEO.8.42.D09.1.454.CMB.2.raw
  modified_base (223)..(223): a, c, t, g, unknown or other
  misc_feature (223)..(223): n is a, c, g, or t
  modified_base (324)..(324): a, c, t, g, unknown or other
  misc_feature (324)..(324): n is a, c, g, or t
  modified_base (407)..(407): a, c, t, g, unknown or other
  misc_feature (407)..(407): n is a, c, g, or t
  modified_base (411)..(411): a, c, t, g, unknown or other
  misc_feature (411)..(411): n is a, c, g, or t
  modified_base (423)..(423): a, c, t, g, unknown or other
  misc_feature (423)..(423): n is a, c, g, or t
tcagctcgcgtgtccacgaccggtgctcgatttagacacatacgcagggaaagggggggtctcaggaggcagcgctctctggacgtcaccaccatggcctgggctctgctcctcctcaccctcctcactcagggcacagggtcctgggcccagtctgccctgactcagcctccctccgcgtccgggtctcctggacagtcagtcaccatctcctgcactgganccagcagtgattacaactatatctctgtaccaacaacaccagcaaagccccaaactcatgattttgagtcaataagcgcctcacgggtcctgatcgcttcncaggctcccaagtcgtagccaaacgacggccctccctgaccgtctcctgggctccagactgacgatgaggctagattattacngacngctcattacttnaggcagacaacgaggttagttacgggcggaacgggaacctaaggttcggacccgttacgtacggtaccaacggccgaaacggccttcggcccccgtcggtaccacgtccgtcgtttccccgcccttcccg

SEQ ID NO: 327199 - DNA, 552 bp, Homo sapiens
  misc_feature: GZ8MTXP02JZYRC.8.42.D09.1.454.CMB.2.raw
  modified_base (224)..(224): a, c, t, g, unknown or other
  misc_feature (224)..(224): n is a, c, g, or t
  modified_base (317)..(317): a, c, t, g, unknown or other
  misc_feature (317)..(317): n is a, c, g, or t
  modified_base (377)..(377): a, c, t, g, unknown or other
  misc_feature (377)..(377): n is a, c, g, or t
tcagctcgcgtgtccacgaccggtgctcgatttagacacatacgcagggaaagggggtcgtcaggaggcagcgctctcaggacgtcaccaccatggcctgggctctgctcctcctcaccctcctcactcagggcacgagggtcctgggcccagtctgccctgactcagccctccctccgcgtccgggtctcctggacagtcagtcaccatctcctgcactgganccagcagtgattacaactatatctcctggtaccaacaacaccaggcaaagccccaaactcatgattttgagtcaatagcgcctcagggtcccngatcgcttctcaggctcccagtctggcaacacggcctcctgacccgtctctcgggctccngactgacggatgaggctgattatactgcagcttcatacttcgagcagacaacgacggggtattcggacggtagggacctaaggttcggaccgtaccgtaggtaccgacggacccgaaagggcccttacgccccccgttcggttcaccgttcgtccgttcccccgtcccttacccg

SEQ ID NO: 327200 - DNA, 597 bp, Homo sapiens
  misc_feature: GZ8MTXP02JVNAX.8.42.D09.1.454.CMB.2.raw
  modified_base (222)..(222): a, c, t, g, unknown or other
  misc_feature (222)..(222): n is a, c, g, or t
  modified_base (279)..(279): a, c, t, g, unknown or other
  misc_feature (279)..(279): n is a, c, g, or t
  modified_base (403)..(403): a, c, t, g, unknown or other
  misc_feature (403)..(403): n is a, c, g, or t
tcagctcgcgtgtccacgaccggtgctcgatttagacacatacgcagggaaaggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgganccagcagtgattacaactatatcctctgtaccaacacaccagacaacgccccaaacncatgtattttagagtacaataagcgcctcgacgggtccctgatcgtcttctcgagtcctacccagtctggacaacgaccggccctcccgtcgacccgtctcgtcgggtcctccgagactgaggntggagctgtatattactgcagtctactatattcgaggcagaccaaacggtaagggttacgttacgggacgggaacggggaaccgtaaggtttacggaccccgttaccgtacggtccgaaccggtaccccgtaaacggccctacccggtcccccgtcggtacccacgttccgtccgttacccctacgttcccccg

SEQ ID NO: 327201 - DNA, 601 bp, Homo sapiens
  misc_feature: GZ8MTXP02I6A0S.8.42.D09.1.454.CMB.2.raw
  modified_base (223)..(223): a, c, t, g, unknown or other
  misc_feature (223)..(223): n is a, c, g, or t
tcagctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgganccagcagtgattacaactatatctctgtaccaacaacaccagcaaacgccccaaatcatgattttgagtcaataagcgccctgacgggtccctgatcgcttctcaggctcccaagtctggacaacaccggcctcccgtgaccgtctcgtcgggctccgagactggacgatggagctagattattactgacagtctcattattcgaggacacgactaacgtaggggttacttacgggacggtaacgggtacctaaggtttacggaacccggttccgttacgggtaccacggtaccccgaaacgggtcccgttaccggaaccccccgttcgggtacccttaccggttccctttccggttaccccctaccccgtttccccg

SEQ ID NO: 327202 - DNA, 562 bp, Homo sapiens
  misc_feature: GZ8MTXP02HDW9Z.8.42.D09.1.454.CMB.2.raw
tcagctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacactatatctctgtacaacaacaccagcaacgccccaaatcatgattttgagtcaataagcgcctcgacgggtcctggactcgcttctcacggtctcccaagtctggacaacgaccggccctcccgtcgacccgtctcgtcgggctccagacctgacggatggaggctgtattattactgcagctcattattccagggccaagccaaagtagggtacgttcgggacggtagggaaccctaaggttacgaccgtcgtacggtacacgaccgaacggcctaccgccccgtcggtacctcgttaccgtccggtttccccgcccttcccg

SEQ ID NO: 327203 - DNA, 603 bp, Homo sapiens
  misc_feature: GZ8MTXP02F518U.8.42.D09.1.454.CMB.2.raw
  modified_base (223)..(223): a, c, t, g, unknown or other
  misc_feature (223)..(223): n is a, c, g, or t
  modified_base (232)..(232): a, c, t, g, unknown or other
  misc_feature (232)..(232): n is a, c, g, or t
  modified_base (284)..(284): a, c, t, g, unknown or other
  misc_feature (284)..(284): n is a, c, g, or t
tcagctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgganccagcagtnattacaactatatctctgtacaacaacaccagacaaacgcccccaaatcatntattttgagtcaataagcgccctgagggtcctgatcgcttctcaggtctacccaagtctggacctaacgaccggcctcccgtgacccgtctcgtggctcagtactgagatgagctagattatactgacagctacattattcgaggaccaaggaccaaaggacggggttacgttcggggacggggaacggtaaccgtaaacggttacggtaacccggttaccgtaacgggtaccaaacgggaccccgtaaacggcccgttccggaaccccccgttacgggtccctaaccgtcctttacggtcccccctaaccttccccgg

SEQ ID NO: 327204 - DNA, 623 bp, Homo sapiens
  misc_feature: GZ8MTXP02JLBA2.8.42.D09.1.454.CMB.2.raw
  modified_base (292)..(292): a, c, t, g, unknown or other
  misc_feature (292)..(292): n is a, c, g, or t
  modified_base (314)..(314): a, c, t, g, unknown or other
  misc_feature (314)..(314): n is a, c, g, or t
tcagctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactggagccagcagtgattacaactatatctctgaccaacaacaccagacaacgaccccaatcatgtatttgagtanaatacgcgcctcgacgggtccngactcgtcttctcacggtcctacccgtagtcgtacggacctaacgaccggcccttcccgtcgtacccgttccgtcgtcgggtccctaccgaagtaccgtagagggatgggacgtcttagtactttaagtacgtgactacgtctactattacgtcgacggacgtacgaccgagtacggggttagtccggggaacggtacgggtaacctagggttaccgtacccgttacggtacggaccgaaccggcccgaacggtccgtacccggccccgttcgtacctaccgtccgttccctacccccgtccctacccg

SEQ ID NO: 327205 - DNA, 680 bp, Homo sapiens
  misc_feature: GZ8MTXP02FWFYB.8.42.D09.1.454.CMB.2.raw
  modified_base (222)..(222): a, c, t, g, unknown or other
  misc_feature (222)..(222): n is a, c, g, or t
  modified_base (330)..(330): a, c, t, g, unknown or other
  misc_feature (330)..(330): n is a, c, g, or t
tcagctcgcgtgtccacgaccggtgctcgatttagacacatacgcagggaaaggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgganccagcagtgattacaactatatctctgtaccaacacaccagcaaacgccccaaactcatgtattttgagtcaatagcggccctcgacggggtccctgactcgtcttcncacggctacccgaagtctaggaccaaacgaccggccctcccgtcgtacccgttcctaccgtcgggtcctaccgagtaccgtggaacggtagtcggaacgggtcttaggtaacttttaagttaccgtaggacctaaggtccttactaattacgttacgagggtacaacgaactaaacggtagggttacgttacggggacgggtaacgggtaaccgtaacggttaccgtaacccggttacgttaacgggtaccgtaacggaccccgtaaacggtcccgttacccggtccccccgttcgggtacccctacccggttcccgtttcccggtttacccccgtcccgtttaaccccg

SEQ ID NO: 327206 - DNA, 563 bp, Homo sapiens
  misc_feature: GZ8MTXP02IE6NP.8.42.D09.1.454.CMB.2.raw
  modified_base (225)..(225): a, c, t, g, unknown or other
  misc_feature (225)..(225): n is a, c, g, or t
  modified_base (234)..(234): a, c, t, g, unknown or other
  misc_feature (234)..(234): n is a, c, g, or t
  modified_base (437)..(437): a, c, t, g, unknown or other
  misc_feature (437)..(437): n is a, c, g, or t
tcagctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgacctcagccctccctccgcgtccgggtctcctggacagtcagtcaccatctcctgcactgganccagcagtnattacaactatatctctgtaccaacaacacccagcaaacgccccaaactcatgtattttgagtacaatagcggccctcgacgggtccctgactcgcttctcgacgctccccaagtctggacaacaccggccctcccgtgaccgtcctccgtcgggcctccgagactggaggagtgagctagtatttattactgacagtcctanattattcgaggtacagacgaaacgtgggttacgttcgggacggacgggactaaggttcgaccgttcgacgtcgacgtcccgaaggcctcgccccgtcggctaccgtcgttccgttcccaccctccg

SEQ ID NO: 327207 - DNA, 648 bp, Homo sapiens
  misc_feature: GZ8MTXP02JLE45.8.42.D09.1.454.CMB.2.raw
  modified_base (223)..(223): a, c, t, g, unknown or other
  misc_feature (223)..(223): n is a, c, g, or t
tcagctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgganccagcagtgattacaactatatctcctgtaccaacaacaccaggacaaacgcccccaaatcatgtattttgagtacaataacgcggccctcgacggggtccctgactcgtcttctcaggcctacccaagtctggactaacgaccggccctcccgtcgaccgtctccgtcgggcctccgagtaccgtgacggatggaggtctagtacttagttactggactagtcctataacttacttacgacggtcgaacgacgaaacggtacggggttacgttaccggggacgggtaacggggaaaccgtaacggttacggaacccggttcgtaacgggtaccgaacggtaccccgaaacggtcccgtcccggtaacccccgttcggtacccgtaccttccgttaccccgtttaccccgacccctttaccccgg

SEQ ID NO: 327208 - DNA, 617 bp, Homo sapiens
  misc_feature: GZ8MTXP02ILL0U.8.42.D09.1.454.CMB.2.raw
  modified_base (219)..(219): a, c, t, g, unknown or other
  misc_feature (219)..(219): n is a, c, g, or t
  modified_base (322)..(322): a, c, t, g, unknown or other
  misc_feature (322)..(322): n is a, c, g, or t
  modified_base (335)..(335): a, c, t, g, unknown or other
  misc_feature (335)..(335): n is a, c, g, or t
  modified_base (390)..(390): a, c, t, g, unknown or other
  misc_feature (390)..(390): n is a, c, g, or t
tcagctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagcctcctcgcgtccggtctcctggacagtcagtcaccatctctgcactgganccagcagtgattacactatatctctgtacaacacaccagacaacgccccaaactcatgtattttgagtacaatagccgcctgacgggtccctgactcgcttcncagctaccagtcngacacgacgcctccgtgaccgtctcgtcggctaccagtactgaggtatggacgtntagtatttacgtacgtgacacgtactactatacgttacgacggtacaacgaccgaaacggtaagggttacgtacggggtacgggaacgggtaacctaagggttcggaacccggttacgtaacgggtaccgaaccggtaccccgaaacggtcccgtacccggtcccccgtacggttacccgtacccgtaccgtttaccccggtttaccccctaacccgtttaccccgg

SEQ ID NO: 327209 - DNA, 532 bp, Homo sapiens
  misc_feature: GZ8MTXP02IYJFG.8.42.D09.1.454.CMB.2.raw
  modified_base (223)..(223): a, c, t, g, unknown or other
  misc_feature (223)..(223): n is a, c, g, or t
  modified_base (232)..(232): a, c, t, g, unknown or other
  misc_feature (232)..(232): n is a, c, g, or t
  modified_base (241)..(241): a, c, t, g, unknown or other
  misc_feature (241)..(241): n is a, c, g, or t
  modified_base (304)..(304): a, c, t, g, unknown or other
  misc_feature (304)..(304): n is a, c, g, or t
  modified_base (400)..(400): a, c, t, g, unknown or other
  misc_feature (400)..(400): n is a, c, g, or t
tcagctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgganccagcagtnattacaatntatctctgtacaacaacaccagcaacgccccaaactcatgattttgagtcaataagcgccctnagggtcctgatcgcttctcagctccaagtctggcaacaccgcctcctgaccgtctctgggctccagactgaggatggaggctgattatactgcagntcatattactacgcagacgaacgaggtagttacggacggacgggacgaacgttacgtaccgtaccgtacggtacgacgaccgaacggacgtacgtcccgtccggtcgtactctccgttccctacccttcccg

SEQ ID NO: 327210 - DNA, 567 bp, Homo sapiens
  misc_feature: GZ8MTXP02FPBXS.8.42.D09.1.454.CMB.2.raw
  modified_base (222)..(222): a, c, t, g, unknown or other
  misc_feature (222)..(222): n is a, c, g, or t
tcagctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactgganccagcagtgattacaactatatctctgtaccaacaacaccagcaaacgcccccaaactcatgtattttgagtacaataacgcgccctcgacgggtccctgactcgtcttctcacggctacccaagtctggacaaccgaccggtccctcccgtcgacccgtctccgtcgggctccgagactgacggatgaggtctgatttagtactgacagctacattactcacggcagccaagtaggtattcgggacggaggaccgtaaggttcgaccgtaccgaggtacgacgaccgaacggccgtccgcccccgtcggtacctacttccgtccgttacccccacccgttcccg

SEQ ID NO: 327211 - DNA, 575 bp, Homo sapiens
  misc_feature: GZ8MTXP02GLOMH.8.42.D09.1.454.CMB.2.raw
  modified_base (222)..(222): a, c, t, g, unknown or other
  misc_feature (222)..(222): n is a, c, g, or t
  modified_base (230)..(230): a, c, t, g, unknown or other
  misc_feature (230)..(230): n is a, c, g, or t
  modified_base (333)..(333): a, c, t, g, unknown or other
  misc_feature (333)..(333): n is a, c, g, or t
  modified_base (401)..(401): a, c, t, g, unknown or other
  misc_feature (401)..(401): n is a, c, g, or t
tcagctcgcgtgtccacgaccggtgctcgatttagacacatacgcaggggaaagggggggtctcaggaggcagcgctctcaggacgtcaccaccatggcctgggctctgctcctcctcaccctcctcactcagggcacagggtcctgggcccagtctgccctgactcagccctcctccgcgtccggtctcctggacagtcagtcaccatctctgcactggancagcagtnattacaatatatctctgtacaacaacaccagacaaacgaccccaaactcactgtattttgaggtcaaataacgcgccctcgacggggtccctgactcgcttcncgaggtctacccaagtcctgacaacacggcctcccgtgaccgtctcgtcgggctccagtactgacganggagctagattatactgcagtctactatacttcgagtcgagaccaaacgtagggtacgtcgggacggaagggtaaccgtaagttaccggaccgttcgtaacgggtcaacggcccgtaaacggcctcccgaaccccgtcggcctaccgttccttacggtaccccctacccttccg

SEQ ID NO: 327212 - DNA, 616 bp, Homo sapiens
  misc_feature: GZ8MTXP02JONOH.8.42.D09.1.454.CMB.2.raw
  modified_base (321)..(321): a, c, t, g, unknown or other
  misc_feature (321)..(321): n is a, c, g, or t
tcagctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaacttatatctctgtaccaacaacaccagacaaacgaccccaaactcatgtattttgagtacaatagcgcctcgacgggtcccngactcgcttctcacggtctacccgagtcgtcggaccaacgaccggaccctcccgtcgacccgttcctccgtcgggtcctccgagtactcggaaggtatggaggctgtattattacgtgacagtctactattacgttcaggacaacgacgaaacgtagggtacgttcgggacggggtaacggacgtaacggttacggaacccggttcgtaaacggttccgaacggaccccgtaacggtcccgtaccgtcccccgtacggtccctaccggttcctcccgttccccaccccgttcccg

SEQ ID NO: 327213 - DNA, 577 bp, Homo sapiens
  misc_feature: GZ8MTXP02HIMEA.8.42.D09.1.454.CMB.2.raw
  modified_base (223)..(223): a, c, t, g, unknown or other
  misc_feature (223)..(223): n is a, c, g, or t
tcagctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagccctcctccgcgtccgggtctcctggacagtcagtcaccatctcctgcactgganccagcagtgattacaactatatctctggtaccaacaacacccaggacaaacgccccaaactcatgtattttgagtacaataagcgccctcgacggggtccctgatcgcttctcagctcccaagtctggcaacaccggcctccctgaccgtctccgtgggcctccagactgaggatcgagctagtattattactgcagctactatacttcgaggacaacgacgaaacgaggggttacttacggggcggaacgggacctaaggttacggaccgttccgttaaggtcaacggacccgaacggtcctccggtcccccgtcggtacctaccgttcgtcccgttcccctacccgttcccg

SEQ ID NO: 327214 - DNA, 605 bp, Homo sapiens
  misc_feature: GZ8MTXP02JEZSI.8.42.D09.1.454.CMB.2.raw
  modified_base (222)..(222): a, c, t, g, unknown or other
  misc_feature (222)..(222): n is a, c, g, or t
tcagctcgcgtgtccacgaccggtgctcgatttagacacatacgcagggaaaggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgganccagcagtgattacaactatatctcctggtaccaacaacacccagcaaacgcccccaaactcatgtattttgagtcaataagcgccctcgaggggtccctgactcgcttctcacggctacccaagtctcggacaacgaccggccctcccgtcgacccgtctccgtcgggtctccgagacctgacggatggaggcttagatttattacgtgacagtctacattacttcgagtcaagacgaacgtagggtacttcggggacggtaacgggaaccgtaaggtttacggaccggttccgtaacggtccaacggtacccgaaacgggtcctaccggcccccgttacggtaccctacgttccgttcccggttccccgtcccgttccccg

SEQ ID NO: 327215 - DNA, 594 bp, Homo sapiens
  misc_feature: GZ8MTXP02G7T3N.8.42.D09.1.454.CMB.2.raw
  modified_base (219)..(219): a, c, t, g, unknown or other
  misc_feature (219)..(219): n is a, c, g, or t
  modified_base (228)..(228): a, c, t, g, unknown or other
  misc_feature (228)..(228): n is a, c, g, or t
  modified_base (237)..(237): a, c, t, g, unknown or other
  misc_feature (237)..(237): n is a, c, g, or t
tcagctcgcgtgtccacgaccggtgctcgatttagacacatacgcagggaaagggggtctcaggaggcagcgctctcaggacgtcaccaccatggcctgggctctgctcctcctcaccctcctcactcagggcacagggtcctgggcccagtctgccctgactcagcctccctcgcgtccggtctcctggacagtcagtcaccatctcctgcactgganccagcagtnattacaatntatctctgtaccaacacacccagcaaacgccccaaactcatgtattttgagtcaataagccgtcctcgacgggtccctgactcgcttctcagctccagtctgcacacggccctcctcgaccgtctccgtcgggctaccgagacctgaaggtagtggaggtctagtatttacttacgtagcctagaccttctaattacgttcgaacgggctaacgacgtaaacgtacggggttacgttaccgggcgggttaacgggaccgtaaaggttccgaccgtaccgtacggtacaccggacccgaacggtcttacccgcccccgttaggtccctaccgtccgttccggtcccctcccgtacccg

SEQ ID NO: 327216 - DNA, 601 bp, Homo sapiens
  misc_feature: GZ8MTXP02GBND9.8.42.D09.1.454.CMB.2.raw
  modified_base (240)..(240): a, c, t, g, unknown or other
  misc_feature (240)..(240): n is a, c, g, or t
  modified_base (307)..(307): a, c, t, g, unknown or other
  misc_feature (307)..(307): n is a, c, g, or t
tcagctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagcctccctcgcgtccgggtctcctggacagtcagtcaccatctcctgcactggagccagcagtgattacaatntatctctgtaccaacaacaccagcaaacgccccaaactcatgtattttgagtcaataagcggccctnaggggtccctgatcgcttctcaggctcccaagtctggcaacaccggcctcccgtgacccgttctccgtgggctcccgagaccttggaggtactggacggtctagtatttaacttacttgacagctacattattcgacggtcagaccgaaacgtagggtacgttcggggacggtaaggggaccctaaggttacggaccgttaccgtacggtacgacggtacccgaaacgggtcccttacggccccccgttacgggtcctaccgttccgtccggtttcccccaacccgtttccccg

SEQ ID NO: 327217 - DNA, 676 bp, Homo sapiens
  misc_feature: GZ8MTXP02I6HNU.8.42.D09.1.454.CMB.2.raw
  modified_base (224)..(224): a, c, t, g, unknown or other
  misc_feature (224)..(224): n is a, c, g, or t
  modified_base (233)..(233): a, c, t, g, unknown or other
  misc_feature (233)..(233): n is a, c, g, or t
tcagctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatcctcctgcactgganccagcagtnattacaactatatctctagtaccaacaacaccagacaacgccccaaatcatgtattttgagtacaataacgcgccctcgacgggtccctagactcgcttctcgaggtcctacccgaagtcctaggaccaacgacccggtccctcccgtacgtacccgttctccgtcggggtccctaccgaagacgtaggaggagtaggacggtcgtagtaactttaattaccgtgactacgtacctacttaacttagtttaccgagggcgaaacgacccgtaaaggtacggggttacgttaccggggacggggtaaccgggtaaccgtaacgggttacggtaacccggttaccggtacggtaccgaccggtacccgaacggtcccgtacccggtcccccgttacggtaccctacccgttccgttaccccgttacccccgtacccttaccccgg

SEQ ID NO: 327218 - DNA, 566 bp, Homo sapiens
  misc_feature: GZ8MTXP02IOLN2.8.42.D09.1.454.CMB.2.raw
  modified_base (223)..(223): a, c, t, g, unknown or other
  misc_feature (223)..(223): n is a, c, g, or t
  modified_base (232)..(232): a, c, t, g, unknown or other
  misc_feature (232)..(232): n is a, c, g, or t
  modified_base (241)..(241): a, c, t, g, unknown or other
  misc_feature (241)..(241): n is a, c, g, or t
tcagctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgganccagcagtnattacaatntatctctgtacaacaacaccagacaacgaccccaaatcatgtattttgagtacaaatagcgcctcgagggtccctgactcgcttctcagctacccaagtctgacaacaccggcctcctgaccgtctcgtcgggctccagactgacggatggaggctagtacttattactgacagtctactatacttacgaggcaagaccgaaagtagggtagttacggacggaacgggacctaaggttacggacccgttacgacggtacaacggacccgaacggtcctaccgtccccgtggtacctaccgttcgtaccttcccctacccgtcccg

SEQ ID NO: 327219 - DNA, 670 bp, Homo sapiens
  misc_feature: GZ8MTXP02HZDTL.8.42.D09.1.454.CMB.2.raw
  modified_base (224)..(224): a, c, t, g, unknown or other
  misc_feature (224)..(224): n is a, c, g, or t
  modified_base (233)..(233): a, c, t, g, unknown or other
  misc_feature (233)..(233): n is a, c, g, or t
tcagctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagccctcctccgcgtccgggtctcctggacagtcagtcaccatctcctgcactggacnccagcagtntaattacaatatactcctctacgtaaccaacaaccaccgagaccaaaccaccccaactcatgtatttgagtactaagtacgccgtaccgtcgtacggtcctgactcgtctctacgacgtacctacccgtacgtcgtacgacaacgaccggtccctccgtacgtaccgtccgtccgtcggtcctacgacgactacggaggtagtacggagtactagtactttaacgtacgtagactacgtactactaattacgttcgaacggtacgaacgtacgtaaacggtaacgggttacgtacgggaacggtaacgggtaacgtaacggttccgtaaccggttccgtaacggtaccgaaccggaaccgtacggtacccgttcccggtaaccccgttacggttaccctaccgttcccgttacccgtttcccccgtacccgtacccg

SEQ ID NO: 327220 - DNA, 569 bp, Homo sapiens
  misc_feature: GZ8MTXP02F6JH5.8.42.D09.1.454.CMB.2.raw
  modified_base (223)..(223): a, c, t, g, unknown or other
  misc_feature (223)..(223): n is a, c, g, or t
tcagctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgganccagcagtgattacaactatatctctgtaccaacaacacccagcaaacgcccccaaactcatgtattttgagtcaatagcgccctgacgggtccctgatcgcttctcaggctcccagtctaggcaacgacggccctcccgtgacccgtctccgtgggcctccgagactgacggatggaggctagattattactgcagtctacattattcgaggcagacgaagagggtagttccggggacggtacgggaccgtaagtacggaccgttaccgtacggtaccacgacccgaacggtcgtaccgcccccgtcggtacctacgttcctaccgttaccccaccctttacccg

SEQ ID NO: 327221 - DNA, 533 bp, Homo sapiens
  misc_feature: GZ8MTXP02F2YLK.8.42.D09.1.454.CMB.2.raw
  modified_base (222)..(222): a, c, t, g, unknown or other
  misc_feature (222)..(222): n is a, c, g, or t
  modified_base (308)..(308): a, c, t, g, unknown or other
  misc_feature (308)..(308): n is a, c, g, or t
  modified_base (410)..(410): a, c, t, g, unknown or other
  misc_feature (410)..(410): n is a, c, g, or t
tcagctcgcgtgtccacgaccggtgctcgatttagacacatacgcagggaaaggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgganccagcagtgattacaactatatctctggtaccaacaacacccaggcaaagcccccaaatcatgattttgagtcaataagcggcctnaggggtccctgatcgcttctcaggctcccaagtctggcaacacggcctccctgaccgtctctgggctccagactgaggatgaggctgattatactgacagcncatattcaggcagcaacaggtagttcgcggagggacgaacgttacgacgtaccgtacggtacgacgacccgaacggacgtcgccccgtccggtccgtactcctcgtcccgtacccgttccccg

SEQ ID NO: 327222 - DNA, 712 bp, Homo sapiens
  misc_feature: GZ8MTXP02HLR1W.8.42.D09.1.454.CMB.2.raw
  modified_base (223)..(223): a, c, t, g, unknown or other
  misc_feature (223)..(223): n is a, c, g, or t
  modified_base (285)..(285): a, c, t, g, unknown or other
  misc_feature (285)..(285): n is a, c, g, or t
tcagctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagcctccctccgccgtccgggtctcctggacagtcagtcacatctctgcactggacnccagcagtgattaacaactatatctctagtaccaacaacaccagacaaacaccccaatcatntattttgagtacaataacgccgcctacgtacgggtcctgtactcgtcttctcgacggtcctacccgaacgttcgtacgaccaaaccgtacccggtcccctacccgttccgtaacccgttccttccggttcggggtcccttaccgaacgtacgttagggaacggtagtacgggaacggtcttaggttaaactttacgtttaacgcggtaccctagtaccttactaactttacgtttacgaggtaccgaaagacccgtaaaggtaacggggttacgttaccggggacgggtaacgggacgttaacggttacggaacccggttcgtaacgggtaccgaaaccggtacccgaaccggtccctaccccggtaaccccgttaccggtaccctaccgttcccgttaccccgtaacccccgttcccgttacccgg

SEQ ID NO: 327223 - DNA, 538 bp, Homo sapiens
  misc_feature: GZ8MTXP02JRNKY.8.42.D09.1.454.CMB.2.raw
  modified_base (222)..(222): a, c, t, g, unknown or other
  misc_feature (222)..(222): n is a, c, g, or t
  modified_base (231)..(231): a, c, t, g, unknown or other
  misc_feature (231)..(231): n is a, c, g, or t
  modified_base (411)..(411): a, c, t, g, unknown or other
  misc_feature (411)..(411): n is a, c, g, or t
  modified_base (498)..(498): a, c, t, g, unknown or other
  misc_feature (498)..(498): n is a, c, g, or t
tcagctcgcgtgtccacgaccggtgctcgatttagacacatacgcagggaaaggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgganccagcagtnattacaactatatctctggtaccaacaacaccaggacaaacgcccccaaatcatgtattttgaggtcaataagcgcctcgagggtccctgactcgcttctcaggctaccaagtctggacaacgaccggcctccctgaccgtctcgtgggcctcgagctgagatgagctagtattatacgngcagctcattactcgagtacagacaacgaggtactcggacggaggactaaggttcgaccggttctaggcacggtaccgaacggtccnccgtccccgtcggtacctctccgtccgtccccgctccccg

SEQ ID NO: 327224 - DNA, 571 bp, Homo sapiens
  misc_feature: GZ8MTXP02HKB7H.8.42.D09.1.454.CMB.2.raw
  modified_base (223)..(223): a, c, t, g, unknown or other
  misc_feature (223)..(223): n is a, c, g, or t
  modified_base (232)..(232): a, c, t, g, unknown or other
  misc_feature (232)..(232): n is a, c, g, or t
  modified_base (280)..(280): a, c, t, g, unknown or other
  misc_feature (280)..(280): n is a, c, g, or t
tcagctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgganccagcagtnattacactatatctctgtaccaacacaccagcaaacgccccaatcatnattttgagtcaatacgcgcctcgagggtccctgactcgcttctcacggctcccaagtctaggaccaacaccggcctcccgtcgtaccgtctcgtcgggtcctccacgacttggaggtactggaggtctaggtaatttattaacgtgcagtactcaattattcagggccagacaacgtagggtaacttcgggacggaagggaacctacggttacgacccgtcgttaacggccacggacccgtaaggcctaccggcccccgtcgtccaccgttctaccgttcccaccctcccg

SEQ ID NO: 327225 - DNA, 609 bp, Homo sapiens
  misc_feature: GZ8MTXP02JV7EB.8.42.D09.1.454.CMB.2.raw
  modified_base (222)..(222): a, c, t, g, unknown or other
  misc_feature (222)..(222): n is a, c, g, or t
  modified_base (285)..(285): a, c, t, g, unknown or other
  misc_feature (285)..(285): n is a, c, g, or t
  modified_base (316)..(316): a, c, t, g, unknown or other
  misc_feature (316)..(316): n is a, c, g, or t
tcagctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagcctccctcgcgtccgggtctcctggacagtcagtcaccatctcctgcactgganccagcagtgattacaactatatctctggtaccaacaacaccagacaaacgccccaaactcatntattttgagtcaatagcgcctgacgggtccngactcgacttctacaggtctcccaagtctacggaccaacgaccggtcctcccgtacgtacccgtcgtccgtcgggccttaccgacgtacgtaggaggacgttggaggtcgtagtaactttacgttacgtcgacagtcctataattacgttcgaggtacaacgtccaaacggtagggtaacgtcgggacggtaacgggacctaaaggttccgaccgtcgtacggtacaccggaccgaacggtcgtacccgtaaccccgtcggtactaccgttctcccgtaccctaccgtacccg

SEQ ID NO: 327226 - DNA, 751 bp, Homo sapiens
  misc_feature: GZ8MTXP02JSLNY.8.42.D09.1.454.CMB.2.raw
  modified_base (226)..(226): a, c, t, g, unknown or other
  misc_feature (226)..(226): n is a, c, g, or t
  modified_base (289)..(289): a, c, t, g, unknown or other
  misc_feature (289)..(289): n is a, c, g, or t
tcagctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatcctcctgcacgtggacnccagcagtgattaacaactatatctctgtaccaacaacaccagacaaacgccccaaactcatntattttgagtacaatacgcgcctcgacgggtcctgactcgtcttctcgacggcctaccccaagtcgtcgaccaacgaccggccctcccgtacgacccgttccgtcgtcggggcctaccgagaccgtaggaggtacgtcggacggtcgttagtactttaacgtttacgtcgactaacggtccttactaacttacgttacgacggtaacgacgaaccgaacggttaacggggttacgttaccgggggaccggggttaaacggggaaacccgttaaaaggggtttcccggtaaacccggtttacccgggtaaacgggttaccccggaaacccgggttaacccccgggaaaccggggttcccccgtacccccgggttccccccccgggttaccggttaccccgttaaccccggtttcccgtttacccccgggtttacccccccggtcccccgtttaaccccccggg

SEQ ID NO: 327227 - DNA, 611 bp, Homo sapiens
  misc_feature: GZ8MTXP02I22CO.8.42.D09.1.454.CMB.2.raw
  modified_base (225)..(225): a, c, t, g, unknown or other
  misc_feature (225)..(225): n is a, c, g, or t
  modified_base (234)..(234): a, c, t, g, unknown or other
  misc_feature (234)..(234): n is a, c, g, or t
  modified_base (244)..(244): a, c, t, g, unknown or other
  misc_feature (244)..(244): n is a, c, g, or t
  modified_base (319)..(319): a, c, t, g, unknown or other
  misc_feature (319)..(319): n is a, c, g, or t
  modified_base (329)..(329): a, c, t, g, unknown or other
  misc_feature (329)..(329): n is a, c, g, or t
tcagctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatcctcctgcacgtgganccagcagtnattacaactntatctctgtaccaacacaccagacaaacgccccaaatcactgtattttgagtcaataagccgcctgacgggtccngatcgcttcncagctccagtctggacaacgaccggccctccgtcgacccttctcgtcgggcctcgacgtacgtggacggtatcggtaacggcgttagttactttaacgttacgttacggtacacgtaccttactaattacgtttacgacgggtacaaacggaccgaaacggtagggttacgttcggggacgggtaacggaaccgtaagtttcggaccgttcgtacgggtacacgaccgaacggtccgtccgccccgtcggtcctaccgttcgtcccgttcccgtccctcccg

SEQ ID NO: 327228 - DNA, 585 bp, Homo sapiens
  misc_feature: GZ8MTXP02IA3TZ.8.42.D09.1.454.CMB.2.raw
  modified_base (223)..(223): a, c, t, g, unknown or other
  misc_feature (223)..(223): n is a, c, g, or t
tcagctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgganccagcagtgattacaactatatcctctgtaccaacaacaccagacaacgaccccaaactcatgtattttgacggtacaaagtacgccggccctgacggggtccctgactcgtcttctcgaggtcctacccaacgtctcggacaacgaccggccctccgtcgaccgtctcgcgggtctacagactgacgagtgacggctagtattatactgcagtctactatacttcgaggcacgacgtaacgaggttacgtcgggacggaaggaccgtaacgtcggtacccgtcgtacggtccgaacgacccgaaggtccctaccgtcccccgtacggtacctacgttccgtacgttacccgacttcccccg

SEQ ID NO: 327229 - DNA, 593 bp, Homo sapiens
  misc_feature: GZ8MTXP02H098I.8.42.D09.1.454.CMB.2.raw
tcagctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctctgtaccaacaacaccagcaacgcccccaaatcatgattttgagtcaatagccggccctcgaggggtccctgactcgcttctcaggctcccaagtctggcaacgaccggccctcccgtgacccgtctccgtgggcctccgagacgtgaggatgaggctagtatttattactgacagctcattagttcgaggcacgacaacgacgggttatcgggacggacgggaccgtaagttcggacccgttaccgtagggtaccaacggtacccgaaacggtccgtacccggtccccccgtaccggtaccctacccgttccgtacccggtttaccccctacccccgtttccccg

SEQ ID NO: 327230 - DNA, 552 bp, Homo sapiens
  misc_feature: GZ8MTXP02G6F0G.8.42.D09.1.454.CMB.2.raw
  modified_base (224)..(224): a, c, t, g, unknown or other
  misc_feature (224)..(224): n is a, c, g, or t
  modified_base (401)..(401): a, c, t, g, unknown or other
  misc_feature (401)..(401): n is a, c, g, or t
  modified_base (418)..(418): a, c, t, g, unknown or other
  misc_feature (418)..(418): n is a, c, g, or t
  modified_base (429)..(429): a, c, t, g, unknown or other
  misc_feature (429)..(429): n is a, c, g, or t
  modified_base (542)..(542): a, c, t, g, unknown or other
  misc_feature (542)..(542): n is a, c, g, or t
tcagctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggacnccagcagtgaattacaactatactctcctgtaccaacaacaccagacaaacgccccaaactcatgattttgagtcaataagcggtacctcgacgggtcctgatcgcttctcaggtctccaagtctggacaacacggtcctccgtcgaccgtctcgtcgggctccagtactgaacggntggagctagattatacngtcagctcatntcgaggcagcaacgaggtactcgggaggaggtactaaggttacgaccggtactacggtcacgtaccgaacggtcctaccgtccccgtcggtcaccgttcctccggttaccccncccttacccg

SEQ ID NO: 327231 - DNA, 603 bp, Homo sapiens
  misc_feature: GZ8MTXP02ITRUM.8.42.D09.1.454.CMB.2.raw
  modified_base (221)..(221): a, c, t, g, unknown or other
  misc_feature (221)..(221): n is a, c, g, or t
  modified_base (230)..(230): a, c, t, g, unknown or other
  misc_feature (230)..(230): n is a, c, g, or t
  modified_base (265)..(265): a, c, t, g, unknown or other
  misc_feature (265)..(265): n is a, c, g, or t
  modified_base (272)..(272): a, c, t, g, unknown or other
  misc_feature (272)..(272): n is a, c, g, or t
  modified_base (276)..(276): a, c, t, g, unknown or other
  misc_feature (276)..(276): n is a, c, g, or t
  modified_base (447)..(447): a, c, t, g, unknown or other
  misc_feature (447)..(447): n is a, c, g, or t
tcagctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcatgganccagcagtnattacaactatatctctgtacacacaccagcaacnccccaancatntattttgagtcaatacgcgccctagacgggtccctgtactccgctttctcgaggtcctaccgagtcctggacaacgaccggccctcccgtgacccgtcctcgtcgggcctcgagtaccgtgaggactggacggtcttagtatttacttactgcagtcgtactattacttanagggtcaagacaacggtagggtacgttcgggacggtaagggactaacggttcgaccggttacgttacgggtacaccggtacccgaacggtcccgtacccggtccccgtccgggtacctacccgttccgtacccgtttccccgaaccccgtttcccg

SEQ ID NO: 327232 - DNA, 515 bp, Homo sapiens
  misc_feature: GZ8MTXP02I600Z.8.42.D09.1.454.CMB.2.raw
  modified_base (221)..(221): a, c, t, g, unknown or other
  misc_feature (221)..(221): n is a, c, g, or t
  modified_base (275)..(275): a, c, t, g, unknown or other
  misc_feature (275)..(275): n is a, c, g, or t
tcagctcgcgtgtccacgaccggtgctcgatttagacacatacgcagggaaagggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgganccagcagtgattacactatatctctgtaccaacaacaccagcaaagccccaaancatgattttgagtcaatagcgcctcagggtcctgatcgctctcaggctcccagtctggcaacacggcctccctgacccgtctcgtggctccagactgaggatgagctgacttatactgcagctcatacttcaggtcagcaacgaggttattcgggcggtaaggacctaagttcgacccgtcgtacggtcacgacccgaaggcctaccgccccgtcggcctactctccgtcccgccctccg

SEQ ID NO: 327233 - DNA, 679 bp, Homo sapiens
  misc_feature: GZ8MTXP02H5D1J.8.42.D09.1.454.CMB.2.raw
  modified_base (223)..(223): a, c, t, g, unknown or other
  misc_feature (223)..(223): n is a, c, g, or t
  modified_base (232)..(232): a, c, t, g, unknown or other
  misc_feature (232)..(232): n is a, c, g, or t
  modified_base (242)..(242): a, c, t, g, unknown or other
  misc_feature (242)..(242): n is a, c, g, or t
tcagctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagcctccctcgcgtccgggtctcctggacagtcagtcaccatcctcctgcactgganccagcagtnattacaactntatcctctgtaccaacaacaccagacaaacgaccccaaactcatgtattttgaggtacaatagccgcctcgacgggtccctgatcgcttctcacggtctcccagtcctgacctacgaccggtccctcccgtcgaccgttcctcgtcgggcctaccgagtacgtggaaggtagtcggaggtcgttagttactttagttaaccgtgtacacgtactactaacttacgttacgacggtacgacgaccgtaaacggtaggggttacgttacgggaccggggtaacggggtaaacccgtaacgggttaccggtacccgttaccggttaacggtacccgtaaccggtaccccggaaacggttccccgtacccggtaacccccgttaccgggtacccttacccgttccgttaccccggtttaccccctaacccccgttccccgg

SEQ ID NO: 327234 - DNA, 597 bp, Homo sapiens
  misc_feature: GZ8MTXP02GRZ1W.8.42.D09.1.454.CMB.2.raw
  modified_base (223)..(223): a, c, t, g, unknown or other
  misc_feature (223)..(223): n is a, c, g, or t
  modified_base (232)..(232): a, c, t, g, unknown or other
  misc_feature (232)..(232): n is a, c, g, or t
tcagctcgcgtgtccacgaccggtgctcgatttagacacatacgcaggggaaagggggggtctcaggaggcagcgctctcaggacgtcaccaccatggcctgggctctgctcctcctcaccctcctcactcagggcacagggtcctgggcccagtctgccctgactcagcctccctcgcgtccgggtctcctggacagtcagtcaccatctcctgcactgganccagcagtnattacaatatatctctgtaccaacaacaccagacaaacgccccaaactcatgtattttgagtcaataagcgcctcgacgggtcctgatcgcttctcagctcccaagtctggacaacaccggcctccctcgaccgtctcgtcgggctaccagtactgaggatgagctagatttatactgacagcctataattacttacgaggacagacaacgtagggttacgttacgggagggaacgggaacctaaaggttccgaacccggttacgtaacggtaccaaacggtaccccgaaacgggtcctacccggtcccccgttacggtacccgtaccttcccgttacccggtttacccccgaccctttaccccg

SEQ ID NO: 327235 - DNA, 592 bp, Homo sapiens
  misc_feature: GZ8MTXP02JWRQY.8.42.D09.1.454.CMB.2.raw
  modified_base (224)..(224): a, c, t, g, unknown or other
  misc_feature (224)..(224): n is a, c, g, or t
  modified_base (564)..(564): a, c, t, g, unknown or other
  misc_feature (564)..(564): n is a, c, g, or t
tcagctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatcctcctgcactgganccagcagtgattacaactatatctctgtaccaacaacaccaggacaaacgaccccaaactcatgtattttgagtacaataacgccggccctcgacggggtccctgactcgtcttctcaggctacccagtctgacacgaccggcctcctcgaccgtctcgcgggtcctaccgagacgtagaggactggaggtctagtactttatactgacgagtctactattattacgaggacagaccaaaggtaggttacgtcgggacggtacgggtaaccgtaaggttcggaacccgttcgtacgggtaccacggacccgaacggtcctacccgtccccgtcggtaccnccttccgtccgttcccccgccttacccg

SEQ ID NO: 327236 - DNA, 623 bp, Homo sapiens
  misc_feature: GZ8MTXP02GCOBV.8.42.D09.1.454.CMB.2.raw
  modified_base (223)..(223): a, c, t, g, unknown or other
  misc_feature (223)..(223): n is a, c, g, or t
  modified_base (295)..(295): a, c, t, g, unknown or other
  misc_feature (295)..(295): n is a, c, g, or t
tcagctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgganccagcagtgattacaatatatctctgtaccaacaacaccagacaaacgccccaaatcatgtattttgagtanaatagcgcctcgtacgggtcctgactcgtcttctcgacgctacccagtctcgacaacgaccggccctccgtgacccgtctcgtcgggtctccgagaccgtggacgtagtaggacggtctaggtaatttacgttaacctggacctagtccttactattacgttcgaggtacagaccgtaacggtagggtacggtttacgggacggggtaacgggaccgtaaacggttcggtaacccgttccggtaacggtaccgaccgtacccgaacggtccgtcccgtaaccccgtccgtaccgtaccttccggtcccgtttcccgacccgttccccg

SEQ ID NO: 327237 - DNA, 653 bp, Homo sapiens
  misc_feature: GZ8MTXP02I2FSU.8.42.D09.1.454.CMB.2.raw
  modified_base (221)..(221): a, c, t, g, unknown or other
  misc_feature (221)..(221): n is a, c, g, or t
  modified_base (230)..(230): a, c, t, g, unknown or other
  misc_feature (230)..(230): n is a, c, g, or t
  modified_base (239)..(239): a, c, t, g, unknown or other
  misc_feature (239)..(239): n is a, c, g, or t
  modified_base (266)..(266): a, c, t, g, unknown or other
  misc_feature (266)..(266): n is a, c, g, or t
  modified_base (274)..(274): a, c, t, g, unknown or other
  misc_feature (274)..(274): n is a, c, g, or t
  modified_base (278)..(278): a, c, t, g, unknown or other
  misc_feature (278)..(278): n is a, c, g, or t
tcagctcgcgtgtccacgaccggtgctcgatttagacacatacgcagggaaagggggggtctcaggaggcagcgctctcaggacgtcaccaccatggcctgggctctgctcctcctcaccctcctcactcaggcacagggtcctgggcccagtctgccctgactcagcctccctccgcgtccgggtctcctggacagtcagtcaccatctctgcactgganccagcagtnattacaatntatctctgtaccacacaccagacaacnccccaacncatntatttgagtacaatacgcgacctcgacgggtccctgactcgcttctacgacggtctacccaagtcctacggactaaccgaccggccctccgtcgtacccgtcttcgcgggtcctacgacgacgtgaggtataggacgtcgttagtagtttaacttacgtcgactagtactactaagttacttacgacggacgacgaacgtaaacggtaacggggttacgtacggggacggggtaacgggtaaaccgtaacgggtttaccggaccgttaccggtacgggtaacctaaccggacccgtaaacgggtccctaccccggtcccccgttacggtaccctacccgttcccgttaccccggttcccctaacccccttcccgg

SEQ ID NO: 327238 - DNA, 640 bp, Homo sapiens
  misc_feature: GZ8MTXP02ICI02.8.42.D09.1.454.CMB.2.raw
  modified_base (224)..(224): a, c, t, g, unknown or other
  misc_feature (224)..(224): n is a, c, g, or t
  modified_base (233)..(233): a, c, t, g, unknown or other
  misc_feature (233)..(233): n is a, c, g, or t
  modified_base (282)..(282): a, c, t, g, unknown or other
  misc_feature (282)..(282): n is a, c, g, or t
  modified_base (286)..(286): a, c, t, g, unknown or other
  misc_feature (286)..(286): n is a, c, g, or t
  modified_base (297)..(297): a, c, t, g, unknown or other
  misc_feature (297)..(297): n is a, c, g, or t
  modified_base (300)..(300): a, c, t, g, unknown or other
  misc_feature (300)..(300): n is a, c, g, or t
  modified_base (316)..(316): a, c, t, g, unknown or other
  misc_feature (316)..(316): n is a, c, g, or t
  modified_base (325)..(325): a, c, t, g, unknown or other
  misc_feature (325)..(325): n is a, c, g, or t
  modified_base (405)..(405): a, c, t, g, unknown or other
  misc_feature (405)..(405): n is a, c, g, or t
tcagctcgcgtgtccacgaccggtgctcgatttagacacatacgcagggaaagggggggtctcaggaggcagcgctctcaggacgtcaccaccatggcctgggctctgctcctcctcaccctcctcactcagggcacgagggtcctgggcccagtctcgccctgactcagcctccctccgcgtccggtctcctggacagtcagtcaccatctcctgcactgganccagcagtnattacaactatatctctcgtaccaacaacaccagacaaacgacccaacncatntatttgagtanaanagcgcctcgcggtccngatcgctcncgagctccagtctcgacacgaccgctccctcgtacctctccgtacggctaccgtacgacgtcggaaggagtaggacggtntacgtaatttaacgttacgtacgacgtaacgtctacgttaaattacgttacgacgggacaacgtacgaaacgggtaagggtacggttcgggggaaccggttaacgggaacgttaaacggttccgtaacccgggtttaccgaacggtacccgaacggtacccgaacggtcccctaccggtaacccccgttcggaccttacccgtccgtttaccccggtccccctaacccgtccccg

SEQ ID NO: 327239 - DNA, 628 bp, Homo sapiens
  misc_feature: GZ8MTXP02I7E3A.8.42.D09.1.454.CMB.2.raw
  modified_base (208)..(208): a, c, t, g, unknown or other
  misc_feature (208)..(208): n is a, c, g, or t
  modified_base (225)..(225): a, c, t, g, unknown or other
  misc_feature (225)..(225): n is a, c, g, or t
  modified_base (234)..(234): a, c, t, g, unknown or other
  misc_feature (234)..(234): n is a, c, g, or t
  modified_base (246)..(246): a, c, t, g, unknown or other
  misc_feature (246)..(246): n is a, c, g, or t
tcagctcgcgtgtccacgaccggtgctcgatttagacacatacgcaggggaaagggggggtctcaggaggcagcgctctcaggacgtcaccaccatggcctgggctctgctcctcctcaccctcctcactcagggcacgagggtcctgggcccagtctgccctgactcagcctccctcgcgtccggtctcctggacagtcagtcaccntcctcctgcactggacnccagcagtnattacaactatntctctgtaccaacaacaccaggcaaacgccccaaatccatgtattttgaggttcaataacgcgcctcgacgggtccctgactcgcttctcgagtctacccagtcctgaccacgaccggcctccgtcgaccgtctcgtgggctccgagtaccgtgtaacggaattcggaaggtcctaggtaactttaacgttaccgtgacctagtacttccaattacttcgagtccgaagtaccgaaagtacggggttaacttcgggaacgggaacggtaccgtaacggttacgacccggttcgtaaacggtcgaaccgtacccggaacggtcccgtacgcccccgttcggtacccgtcgttcccgtaccgggttccccctacccgttccccg

SEQ ID NO: 327240 - DNA, 621 bp, Homo sapiens
  misc_feature: GZ8MTXP02F93EJ.8.42.D09.1.454.CMB.2.raw
  modified_base (221)..(221): a, c, t, g, unknown or other
  misc_feature (221)..(221): n is a, c, g, or t
  modified_base (329)..(329): a, c, t, g, unknown or other
  misc_feature (329)..(329): n is a, c, g, or t
  modified_base (424)..(424): a, c, t, g, unknown or other
  misc_feature (424)..(424): n is a, c, g, or t
tcagctcgcgtgtccacgaccggtgctcgatttagacacatacgcagggaaaggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactgganccagcagtgattacaactatatctctagtaccaacaacaccaggcaaacgaccccaaactcatgtatttgagtcaatagcgccctcgacgggtcctgactcgtcttcncacgctacccagtctagacaaccgaccgtccctccctcgacccgttcgtccgtcggctccagtactgacgatggaggtctagattatacgtgacngtctactattacgttacaggacagaccaaacggtacggttaggttaccggacggtaaacggggtaaccgtaaacggtttccggaacccggttaccgtaacgggtaccgtaaccggtaccccggaaacggtcccgttacccgcccccgtacgggtcctacccgttccgttacccgttcccccgtccctttacccccgg

SEQ ID NO: 327241 - DNA, 638 bp, Homo sapiens
  misc_feature: GZ8MTXP02GYNSK.8.42.D09.1.454.CMB.2.raw
  modified_base (224)..(224): a, c, t, g, unknown or other
  misc_feature (224)..(224): n is a, c, g, or t
  modified_base (233)..(233): a, c, t, g, unknown or other
  misc_feature (233)..(233): n is a, c, g, or t
  modified_base (283)..(283): a, c, t, g, unknown or other
  misc_feature (283)..(283): n is a, c, g, or t
  modified_base (333)..(333): a, c, t, g, unknown or other
  misc_feature (333)..(333): n is a, c, g, or t
tcagctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccatctcctgcactgganccagcagtnattacaactatatctcctggtaccaacaacaccagcaaacgccccaaacncatgtattttgagtcaataagcggccctgacgggtccctgatcgtcttcncaggctcccaagtctggacaacgaccggcctccctcgaccgtctccgtcgggctccagactgacgatgagctagacttatacgtgacaagctacaattacttacgacggacaagaaccaaacggtacggggttaacgtttacggggacgggtaaacggggaacccgtaaaaggtttaccggtaacccgttaccgtttaacgggtaccgtaaccggtaccccgtaaacggcccgtaacccggtccccccgttacgggtaccctaccgttcccgttacccgttccccccgtaccccgtttcccccgg

SEQ ID NO: 327242 - DNA, 551 bp, Homo sapiens
  misc_feature: GZ8MTXP02GFYSL.8.42.D09.1.454.CMB.2.raw
  modified_base (223)..(223): a, c, t, g, unknown or other
  misc_feature (223)..(223): n is a, c, g, or t
  modified_base (364)..(364): a, c, t, g, unknown or other
  misc_feature (364)..(364): n is a, c, g, or t
tcagctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgganccagcagtgattacaatatatctctgtaccaacaacaccagacaaacgccccaaatcatgtattttgagtacaataagcgccctgacgggtccctgatcgcttctcacggctcccaagtctggacaacgaccgccctccgngacccgtctcgtcgggctccagactgacggatagagctagatttatacgtgcagtctacattacttcgaggacagaccaagtagggttactcgggacggtaacggactaagtacgaccgttacgtacggacacgacccgaacgtcctaccgccccgtcggtaccacttccgtcgtccccgctacccg

SEQ ID NO: 327243 - DNA, 692 bp, Homo sapiens
  misc_feature: GZ8MTXP02FW6PC.8.42.D09.1.454.CMB.2.raw
tcagctcgcgtgtccacgaccggtgctcgatttagacacatacgctaggggtaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacgaacttatactctcgtcgtaccaagaacacccaaggaccaaccggccccaaactccaactcgtattttagagtacaagtacgccgtacccgtacggtaccggggttcctcgacgtcgttaccttctcgtacggtcctaccctaagtccgtagacgtaacccgaccggaccccttccgtccgacccgttctccgttcgggacgtaccacggtagtcggaggtagtacgtaacgggtcttaggtactttttaaacgtcgttacggacacgtacttactaacttacgttacgacggacgaagtaacccgaaggtacgggtaacgtacggggtacggtagggttaacccgttaaagggttccggaaccgtttacggttacggacgtaacggacccgtaaggcccttccgggccccttggaacctcggttcccgtccgtcccccggtacttccccgg

SEQ ID NO: 327244 - DNA, 603 bp, Homo sapiens
  misc_feature: GZ8MTXP02GKURU.8.42.D09.1.454.CMB.2.raw
  modified_base (224)..(224): a, c, t, g, unknown or other
  misc_feature (224)..(224): n is a, c, g, or t
  modified_base (282)..(282): a, c, t, g, unknown or other
  misc_feature (282)..(282): n is a, c, g, or t
tcagctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcacgtgganccagcagtgattacactatatctctgtaccaacaacaccagcaacgaccccaatcatntattttgagtcaatagcgcctcgacgggtccctgactcgtcttctcacggtctcccagtctgcaacgccggcctccgtgaccgtctcgtcggctccgagtactggacggtatggacggtctagttattacgttacgtgaccagtccttacagttacttacgagtacgacgacgtaaacggtaggggtacgtaccggggacggtaacgggaccgtaaggttaccggtacccgttcggtaacggtaccgaaccggtcccgaacggtcctcccggcccccgttcggtacctccgtccgttccggtttcccccgcccttacccgg

SEQ ID NO: 327245 - DNA, 757 bp, Homo sapiens
  misc_feature: GZ8MTXP02GLUZ2.8.42.D09.1.454.CMB.2.raw
  modified_base (285)..(285): a, c, t, g, unknown or other
  misc_feature (285)..(285): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaatatatctctgtaccaacaacaccagacaaacgaccccaaatcatntattttgagtacaataacgcggaccctcgacggggtccctgactcgtcttctcgacggtcctacccgaagtctggaccaaccgaccggtccctcccgtacgacccgtcgtccgtcggggcctaccgacgacgtaggaacggtagtacggaacggtcttaggtaactttttaaacgtttaccgtacgaccgtaaacggtacccttaaccgtaaatttaacgtttaaccggaacgggtaaccgtaacgaacccgtaaaaccggtagggggtttaacgttacccgggggacgggggtaaaccggggtaaacccgttaaaaggtttacccggtaacccggttaccggttaacgggttaacccgaaccggtaccccggaaaaccggtcccggttaccccggtaaccccccggttccgggtaaccccttacccgtttcccgtttcccggtttacccccccgtaccccgtttcccccgg

SEQ ID NO: 327246 - DNA, 619 bp, Homo sapiens
  misc_feature: GZ8MTXP02G770Z.8.42.D09.1.454.CMB.2.raw
  modified_base (225)..(225): a, c, t, g, unknown or other
  misc_feature (225)..(225): n is a, c, g, or t
  modified_base (234)..(234): a, c, t, g, unknown or other
  misc_feature (234)..(234): n is a, c, g, or t
tcagctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcacgtggacnccagcagtnattacaactatatctctgtaccaacaacaccagacaacgccccaaatcatgtattttgagtacaatagcgcctgacgggtccctgactcgtcttctcgacggtcctacccgaagtctacgggaccaacgacccggccctccctcgacccgttctcgtcgggcctaccagaccgtgaggagtaggagcgtagtagtttaacttacgtcgacacgtcctactattacttcgacgcgaagaccgaagtagggttacgttacggacgggaacgggtaaccgtaggttaccgacccggttaccgtacgggtccgacggacccgaacggtccgtcccgtcccccgtacggtaccctaccgttccgtcccgttaccccctaccccgttcccg

SEQ ID NO: 327247 - DNA, 635 bp, Homo sapiens
  misc_feature: GZ8MTXP02H5F93.8.42.D09.1.454.CMB.2.raw
  modified_base (228)..(228): a, c, t, g, unknown or other
  misc_feature (228)..(228): n is a, c, g, or t
  modified_base (447)..(447): a, c, t, g, unknown or other
  misc_feature (447)..(447): n is a, c, g, or t
tcagctcgcgtgtccacgaccggtgctcgatttagacacatacgcagggaaagggggggtctcaggaggcagcgctctcaggacgtcaccaccatggcctgggctctgctcctcctcacccctcctcactcagggcacagggtcctgggcccagtctgccctgactcagccctccctccgccgtccgggtctcctggacagtcagtcaccatcctcctgcacgtgganccagcagtgaattacaatatatcctcctgtaaccaacaacaccagacaacgcccccaaatcatgtattttgagtcaatacgccggcctagacgggtccctgactctcttctcgaggtcctacccgaagtctacggacacgaccggccctcccgtcgtaccgtccgtcgtacggtcctacgagacctggacggtatggacggtctagtacttagttacgngtcacgtctactattacgttcgagtcacgtacgaacggtagggttacgtacggggacggtaacggtaaccgtaacggtttacgaacccggttacgtacggaccgtacggtaccccgtaacggtccgtccccggtaaccccgttcgtaccctacccgttcgtacccccggtcccttaacccccgtcccg

SEQ ID NO: 327248 - DNA, 554 bp, Homo sapiens
  misc_feature: GZ8MTXP02JDU3I.8.42.D09.1.454.CMB.2.raw
  modified_base (391)..(391): a, c, t, g, unknown or other
  misc_feature (391)..(391): n is a, c, g, or t
tcagctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaagcccccaaactcatgattttgaggtcaataagcgccctcaggggtccctgatcgcttctcaggctcccagtctggcaacacggcctccctgacccgtctctgggctccagactgaggntgagctgattattactgcagtctcatattccaaggtcagacgaacgagggtacgttcgggcggtagggaccgaagttcggaaccgtccgtacggtacgaacgccccgaaacggcctcggcccccgttcggtcaccgttcctccgttccccggtcccttccccg

SEQ ID NO: 327249 - DNA, 798 bp, Homo sapiens
  misc_feature: GZ8MTXP02JUXXB.8.42.D09.1.454.CMB.2.raw
  modified_base (223)..(223): a, c, t, g, unknown or other
  misc_feature (223)..(223): n is a, c, g, or t
tcagctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgganccagcagtgattacaactatatctctggtaccaacaaccaccaggacaaacgcccccaaactcatgattttgagtcaataagcggccctcgacggggtccctgatcgtcttctcgacggcctaccccgaacgtcgtggacaaccgaccggtccctcccctagtaccccgtcgtccgtcggggccttaccgagtaccgtggtaacggattacgggagggtccttagggtaagtttaactttaaccgttggacctaacggtcccttacctaaatttaacgtttccgaacgggggttaccaaacgggtaacccgaaaacgggtttaacgggggttaacgtttacccggggggaccgggggttaaacgggggtaaaaccccggttaaaacggggtttaccggggtaaaccccggtttaccccggttaaaacgggggttcccgaaacccggggttaaccccccggtaaaacggggccccgtttaaaccccggggccccccccgtttcgggggtttaaacccctaccccggttccccggtttaccccttttcccccccgaacccccgtttttaccccccgg

SEQ ID NO: 327250 - DNA, 723 bp, Homo sapiens
  misc_feature: GZ8MTXP02GGB5L.8.42.D09.1.454.CMB.2.raw
  modified_base (222)..(222): a, c, t, g, unknown or other
  misc_feature (222)..(222): n is a, c, g, or t
  modified_base (287)..(287): a, c, t, g, unknown or other
  misc_feature (287)..(287): n is a, c, g, or t
  modified_base (335)..(335): a, c, t, g, unknown or other
  misc_feature (335)..(335): n is a, c, g, or t
tcagctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcacatctcctgcactggacnccagcagtgaattacatatatctctagtaccaacaaccaccgagacaaacgaccccaaactcatntattttgagtcaatacgcgcctacgacgggtccctagactcgtcttcncgacggtctacccgaagtcgtggacctaacaccggtcctccgtcgtaccgttctccgtcgggcctaccgagtaccgtaggaacggtagtacgggacggtaccgttaaggtaactttaactttaaccggacgtacgtaaccgttaccttaacgttaaacgtttaacggttacgaacgggtaaccgtaaacggtaaaccgtaaacgggttaacgggtttaacgggtaccgggggaacggggtaaccgggtaaccggtaaacgggttacccggtaacccggttacgtaacgggtacccgtaaccggtaacccggtaccgtcccgttaccccgtccccgttacggtacccttacccgttcccgttaccccggttaccccctacccgttcccg

SEQ ID NO: 327251 - DNA, 680 bp, Homo sapiens
  misc_feature: GZ8MTXP02FKA1L.8.42.D09.1.454.CMB.2.raw
  modified_base (354)..(354): a, c, t, g, unknown or other
  misc_feature (354)..(354): n is a, c, g, or t
  modified_base (358)..(358): a, c, t, g, unknown or other
  misc_feature (358)..(358): n is a, c, g, or t
tcagctcgcgtgtccacgaccggtgctcgatttagacacatacgcagggaaaggggggagaggagcccagcactgggattccgaggtgtgtccattcggtgatcagcactgaacacagaggactcaccatggagttctggctgggctgggttttccttgttgcaatttcaaaaggtgtccagtgtgaggtgcagcgtggtggagaagtgggagggggcttgatccgagggcccggggggtccctgagactctcctgtgcagcctctggcttcaccatcagtagagactacatgagcgtcgggccccgcgaggctccgaggggaggggctgggaggtgggtctcgagtttattanccgngagtgggtcgcacacactacgctagaccgtccgtaggaaacgggcaagtacgttacccgacccgtctacccgaaagtaacgaacctaaacgttacccgaaaaggtaaacctaaggttagggttacgttaaactttaccttaaacctaaaagtaaccgggaaaacaaaggtaaaccctaaaacgaacggacccgggaaacggtaaccggaaccgggtacccgttaaaattaccgtttaacggtgtaccggaacgaaacggtacctagtaccgtaacgtacgggtcggacgacccggtacgggggacccaacgggggtaacccg

SEQ ID NO: 327252 - DNA, 607 bp, Homo sapiens
  misc_feature: GZ8MTXP02ILQ90.8.42.D09.1.454.CMB.2.raw
  modified_base (223)..(223): a, c, t, g, unknown or other
  misc_feature (223)..(223): n is a, c, g, or t
tcagctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgganccagcagtgaattacaactatatctcctgtaccaacaacaccagacaaacgccccaaactcatgtattttgagtacaataagcgccctcgacggggtcccctgactcgcttctcgacggctaccccaagtctcgacaaccgaccggtccctcccgtgacccgtcctccgtcgggcctccgagacctggaggactgaggctgtattattactgcagctcattacttcgagtcacgcgaacgtaggttacgttcgggacggaacgggactaaggtttcgacccgttaccggtacgtacgaccggtacccgaaacgggtccctacccggtcccccgttcgggtaccctaccggtcctttacccggttacccccttaccccgtccccg

SEQ ID NO: 327253 - DNA, 681 bp, Homo sapiens
  misc_feature: GZ8MTXP02FL1NB.8.42.D09.1.454.CMB.2.raw
  modified_base (199)..(199): a, c, t, g, unknown or other
  misc_feature (199)..(199): n is a, c, g, or t
  modified_base (225)..(225): a, c, t, g, unknown or other
  misc_feature (225)..(225): n is a, c, g, or t
  modified_base (234)..(234): a, c, t, g, unknown or other
  misc_feature (234)..(234): n is a, c, g, or t
  modified_base (288)..(288): a, c, t, g, unknown or other
  misc_feature (288)..(288): n is a, c, g, or t
  modified_base (299)..(299): a, c, t, g, unknown or other
  misc_feature (299)..(299): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacngtcagtcaccatctcctgccatgganccagcagtnattacaactatatctctagtaccaacaacaccagacaaacgaccccaactcatntatttgagtanaagtacgccgcctacgtcgggtccctgactcgtcttctcgacgtcctacccaagtcgtacggaccaacgacccggcccttccccgtacggtacccgttccgttccgtcggggtaccctacccgagtaaccgtggaacggtagtagggtacgcgttagtactttacttacgtcgtacagttacctactaatttacgttcgaacgggtacaacggaaccgtaaacgggtaggggttacggtacgggggacggggtaacgggtaccgtaaacggttaccggacccgttacggtaacggtaccgaccggaccccgtaacggcccgttacccggaacccccgttacggtacctacccgttccgttcccgtaccccctacccttcccg

SEQ ID NO: 327254 - DNA, 569 bp, Homo sapiens
  misc_feature: GZ8MTXP02IJCLS.8.42.D09.1.454.CMB.2.raw
  modified_base (226)..(226): a, c, t, g, unknown or other
  misc_feature (226)..(226): n is a, c, g, or t
  modified_base (235)..(235): a, c, t, g, unknown or other
  misc_feature (235)..(235): n is a, c, g, or t
  modified_base (272)..(272): a, c, t, g, unknown or other
  misc_feature (272)..(272): n is a, c, g, or t
  modified_base (281)..(281): a, c, t, g, unknown or other
  misc_feature (281)..(281): n is a, c, g, or t
  modified_base (329)..(329): a, c, t, g, unknown or other
  misc_feature (329)..(329): n is a, c, g, or t
  modified_base (412)..(412): a, c, t, g, unknown or other
  misc_feature (412)..(412): n is a, c, g, or t
tcagctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcacgcctccctccgccgtccgggtctcctggacagtcagtcaccatctcctgcacgtgganccagcagtnattacaactatatctctgtacaacacaccagacaacnccccaaacncatgtattttgagtacaatagcgcctcgacgggtcctgactcgcttcncgagctccagtctgacaacaccgcctccgtcgaccgtctcgtcggctcagctgagatgagtctagtattatacgtgcagtctntaatacttcgagtcaacgacgtaaacgtacgggttacgtacggggacgggtaacggaacgtaggttacgacccgttcgtacggtaccgaccgacccgaacggtccgtaccggtaaccccgttcggactaccgtccgtacctttccccgaccctcccg

SEQ ID NO: 327255 - DNA, 610 bp, Homo sapiens
  misc_feature: GZ8MTXP02I0RML.8.42.D09.1.454.CMB.2.raw
  modified_base (222)..(222): a, c, t, g, unknown or other
  misc_feature (222)..(222): n is a, c, g, or t
tcagctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagcctccctcgcgtccgggtctcctggacagtcagtcaccatctcctgcagtgganccagcagtgattacaactatactctctgtaaccaacaaccaccagaccaaacgaccccaaatcatgtattttgagtacaatacgcgaccgtcgacgggtcctgtactcgtcttctcgagtcctacccgtaagtcgtacgacaaccgtaccggccctcccgtcgtacccgtctccgtcggctcagtactgagatggagtctagtacttagtacgtgacagtcctataattcttacgaacgtcgaagacctaaaggtacgggtacgtacggggacggaacggggacctaacggttaccgaccgttaccgacgtaccgacgtacccgaacgtcccgttacccgccccgtttcggaacctccgttccgttcccgtccccggtcccttacccg

SEQ ID NO: 327256 - DNA, 637 bp, Homo sapiens
  misc_feature: GZ8MTXP02G2MOB.8.42.D09.1.454.CMB.2.raw
  modified_base (222)..(222): a, c, t, g, unknown or other
  misc_feature (222)..(222): n is a, c, g, or t
tcagctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcaccatctcctgcactgganccagcagtgattacaactatatctctgtaccaacaacaccagacaacgaccccaaactcatgtattttgagtacaataagccgcctcgacgggtccctgactcgtcttctcacggtctacccgaagtcgtcgacaaccgaccggtccctcccgtcgacccgttcctcgtcgggcctccgagtaccgtgaacggatggaggtcttagtacttacttacgtgacacgtctactattacttacgacggtacaagtacgaaggtacgggtacgttacggggacgggtaacgggtaacctaacgggttccggtaacccgttcggtaacggtaccgaccggtacccggtaacggtcccgtacccggcccccgttcggtaccctaccgttccgttcccggtttcccccggtacccttcccgg

SEQ ID NO: 327257 - DNA, 681 bp, Homo sapiens
  misc_feature: GZ8MTXP02G7IBE.8.42.D09.1.454.CMB.2.raw
  modified_base (224)..(224): a, c, t, g, unknown or other
  misc_feature (224)..(224): n is a, c, g, or t
  modified_base (233)..(233): a, c, t, g, unknown or other
  misc_feature (233)..(233): n is a, c, g, or t
  modified_base (316)..(316): a, c, t, g, unknown or other
  misc_feature (316)..(316): n is a, c, g, or t
  modified_base (329)..(329): a, c, t, g, unknown or other
  misc_feature (329)..(329): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccggtctccgtggacagtcagtcaccatctctgcactggacnccagcagtnaattacaactatatctctgtaccaacacaccagacaacgccccaatcatgtattttgagtcaatacgcgacctgacgggtccngtactcgtcttcncgacgtctacccgagtcgtggacacgaccggcctccgtacgtaccgtctcgtcgggctccgacgacgtgagactggacgtctagtacttaactttacgtgactacggtctactactttacgttaccgacgggtccttaaacggaccgttaaaagggttacggggttacgttaccgggggaaccgggtaacgggtaaaaccgttaagggttaccggtaacccggttacggtacgggttaaacccgaccgggtaacccgtaaacgggtcccttaaccccggggtcccccgtttacggtaccccgttaaaccgttccgtttaccccggttacccccgtttcccgttaacccccgg

SEQ ID NO: 327258 - DNA, 591 bp, Homo sapiens
  misc_feature: GZ8MTXP02IBTJ9.8.42.D09.1.454.CMB.2.raw
  modified_base (218)..(218): a, c, t, g, unknown or other
  misc_feature (218)..(218): n is a, c, g, or t
  modified_base (226)..(226): a, c, t, g, unknown or other
  misc_feature (226)..(226): n is a, c, g, or t
  modified_base (237)..(237): a, c, t, g, unknown or other
  misc_feature (237)..(237): n is a, c, g, or t
  modified_base (270)..(270): a, c, t, g, unknown or other
  misc_feature (270)..(270): n is a, c, g, or t
tcagctcgcgtgtccacgaccggtgctcgatttagacacatacgcagggaaaggggggtctcaggaggcagcgctctcaggacgtcaccaccatggcctgggctctgctcctcctcaccctcctcactcagggcacagggtcctgggcccagtctgccctgactcagcctcctcgcgtcggtctcctggacagtcagtcaccatctctgcactggacncagcagtnattacaatatntctctagacaacacaccagacaacgacccaacncatagtatttgagtacaatagcgcctcgacggtcctgatcgctctcgacgctacccgagtctacgacaacgccggccctccgtacgtaccgttctcgtcggtacctacacgacgtagagagtagaggtacgtagtattagttacgtacgtacgtacgtactactactacgtacgtacgtacgtacgtacgaacgtaacggttacggttacggacgggtacggtaacgtaacgtaacgtaccgtacgtacggtacgacgtaccgacggtaccgtaccgtcccgtacccgtaccgtactaccgtaccgtaccctaccctaccg

SEQ ID NO: 327259 - DNA, 580 bp, Homo sapiens
  misc_feature: GZ8MTXP02FJK8Y.8.42.D09.1.454.CMB.2.raw
tcagctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccaatctgccctgactcagcctccctccgcgtccgggtctcctggacagtcagtcaccatctcctgcactggagccagcagtgattacaactatatctcctggtaccaacaacacccaggacaaacgcccccaaactcatgattttgagtcaataagcgccctcaggggtccctgatcgcttctcaggctaccccaagtctggacacaccggcctccctgacccgtctcgtcggggctccgacgaccgtggaacggtataggacggcttaggatttattaacgtggacagtactcattacttcgaggcaaggccaaacgaggggttagttcgggacggaacgggaccgtaaggttcgaccggtactacgggtacacgacccgaaggctaccgcccccgtcggtccacttccgtacgttccccgccctcccg

SEQ ID NO: 327260 - DNA, 711 bp, Homo sapiens
  misc_feature: GZ8MTXP02IG5WJ.8.42.D09.1.454.CMB.2.raw
  modified_base (186)..(186): a, c, t, g, unknown or other
  misc_feature (186)..(186): n is a, c, g, or t
  modified_base (231)..(231): a, c, t, g, unknown or other
  misc_feature (231)..(231): n is a, c, g, or t
tcagctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagcctcctcgcgtccgggtntcctggacagtcagtcaccatctcctgcactgggacccagcagtnattacaatatatctctgtacaacaacaccagcaaagcccccaaatcatgtattttgagtcaaatacgcgacctgacgggtccctgactcgcttcgcaggctcccaagtctcggactaaccacggccctccgtgaccgttctccgtcggggcctaccgaagaccttggaacggtatacgggaacggtccttaggtactttaagttaacgtcgacgaacgtctacctaaagtttacttaccgaagggtccctaaaggaccccgtaaaacggtagggggtttaaaccgtttacccgggggacggggttaaaccgggggaaaccccttaaaaggggttttcccggaaaacccccgggtttcgtaaaacgggggttcccaccggttaacccgaaacggggtttcccacccggttaacccccccgttagggtaaccccttacgggtaccctttccccggggttaccccctacccgtttacccccgg

SEQ ID NO: 327261 - DNA, 693 bp, Homo sapiens
  misc_feature: GZ8MTXP02GL10N.8.42.D09.1.454.CMB.2.raw
  modified_base (197)..(197): a, c, t, g, unknown or other
  misc_feature (197)..(197): n is a, c, g, or t
  modified_base (222)..(222): a, c, t, g, unknown or other
  misc_feature (222)..(222): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctcgcgtccgggtctcctggacngtcagtcaccatctctgcactggancagcagtgattacactatactctctgtaccaacaacaccaggacaacgcccccaaatcatgtatttgagtcaatagcggcctgacggtcctgtacgtcgtcttctacgacggtcctacccgtaacgtctacgggacctaacgacccggtcctccccgtcgtacccgtccgtccgtcgggcctcccgaacgtaccgtggaacggtagtacgggagtccgtagttaactttagttaccgtatacgtacgtaccttagaacgtttacgttacgacggtacgaacgtaccgtaaaaggtacgggttacggtaccggggtacgggaaccgggtaaaccgtaacggtttaccggacccgttaccggtaacggttacccgaaccggtaccccgtaaaacgggtcccgtaccccggtcccccgttcggtaaccctccccggtttccgtaccccggttcccccgtaccccgtttccccgg

SEQ ID NO: 327262 - DNA, 707 bp, Homo sapiens
  misc_feature: GZ8MTXP02G61NW.8.42.D09.1.454.CMB.2.raw
  modified_base (223)..(223): a, c, t, g, unknown or other
  misc_feature (223)..(223): n is a, c, g, or t
tcagctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgganccagcagtgaattacaactatatctctgtaccaacaacaccagacaaacgacccccaaactcatgtattttgagtcaaatagcgccctcgacgggtcctgactcgtcttctcacggtctccccgaagtctcggacaaccgaccggccctcccgtcgtacccgtccgtcgtacgggtcctccgacgtaccgtggaggtacgtggacggtccgtagtaagtttacttacgtcgtacgtaacgccttactaacgttacgttaccgagggtaccaaacggtaccgtaaaaccggtaggggtttacggttaccggggacggggtaacgggggtaaacccttaaggggttaccggtacccgggttaccgttaacgggtacccggtacggtaacccccggtaaacgggtccgttccccgggtaacccccgtccgggttaccctaccgttccccggtttcccggtttacccccctaaccccgtttcccccgg

SEQ ID NO: 327263 - DNA, 609 bp, Homo sapiens
  misc_feature: GZ8MTXP02FJOEB.8.42.D09.1.454.CMB.2.raw
  modified_base (224)..(224): a, c, t, g, unknown or other
  misc_feature (224)..(224): n is a, c, g, or t
  modified_base (460)..(460): a, c, t, g, unknown or other
  misc_feature (460)..(460): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctctgcactggacnccagcagtgaacttacaactatactctctagtaccaacaacaccgagacaaacgaccccaactcatgtattttgagtcaatacgcgccctgacggggtccctgactccgtccttccgacgtaccgtacctaccgtacgtcgacgaccaaccgcccgtccctccgacgtccgtcgtcggcgtactacgactacgtaggacgtgaggtacgtcgttattaacgtttactacgtcgacncttacctatacgttacgtacgacgacgaactaaccggtaaggtacggttacgggacgggacgggtacggtaaccgtacggtaccgtacgtacgtacgacgacgacgactccgcccgtaacgtcgactccgtctcccgaccctcctaccg

SEQ ID NO: 327264 - DNA, 636 bp, Homo sapiens
  misc_feature: GZ8MTXP02IS921.8.42.D09.1.454.CMB.2.raw
  modified_base (195)..(195): a, c, t, g, unknown or other
  misc_feature (195)..(195): n is a, c, g, or t
  modified_base (232)..(232): a, c, t, g, unknown or other
  misc_feature (232)..(232): n is a, c, g, or t
  modified_base (242)..(242): a, c, t, g, unknown or other
  misc_feature (242)..(242): n is a, c, g, or t
  modified_base (416)..(416): a, c, t, g, unknown or other
  misc_feature (416)..(416): n is a, c, g, or t
tcagctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagcctccctcgcgtccggtctcctggacngtcagtcaccatcctcctgccactggagccagcagtnattacaactntatctctgtaccaacacaccagacaaacgcccccaaactcatgtattttgagtacaatagccgccctcgacggggtccctggtatcgtcttccgtcacggtctccccgaagtccgtcgactaacgaccggtccctccgtcgtacccgtctcgtcgggctcctagactggaggtntacggagtcgtagactttattcgtgacctagtctactattacgttaccgaagtcgaacgtacaacggtaggttacgttacgggaccgggtaacggtacccgtaaagttccgggtaccggtaccgttaacggggtcgaaaccggtccgaaacgggtcccttaccggtccccccggtcggtcctaccggttccctacccggtttccccccacccgtttaccg

SEQ ID NO: 327265 - DNA, 568 bp, Homo sapiens
  misc_feature: GZ8MTXP02GPQF0.8.42.D09.1.454.CMB.2.raw
  modified_base (233)..(233): a, c, t, g, unknown or other
  misc_feature (233)..(233): n is a, c, g, or t
  modified_base (242)..(242): a, c, t, g, unknown or other
  misc_feature (242)..(242): n is a, c, g, or t
  modified_base (251)..(251): a, c, t, g, unknown or other
  misc_feature (251)..(251): n is a, c, g, or t
  modified_base (301)..(301): a, c, t, g, unknown or other
  misc_feature (301)..(301): n is a, c, g, or t
  modified_base (323)..(323): a, c, t, g, unknown or other
  misc_feature (323)..(323): n is a, c, g, or t
  modified_base (444)..(444): a, c, t, g, unknown or other
  misc_feature (444)..(444): n is a, c, g, or t
tcagctcgcgtgtccacgaccggtgctcgatttagacacatacgcaggggaaaggggggggtctcaggaggcagcgctctcaggacgtcaccaccatggcctgggctctgctcctcctcaccctcctcactcagggcacagggtcctgggcccagtctgccctgactcagccctccctccgccggtccgggtctccgtggacagtcagtccaccatcctcctgcacgtggacnccagcagtnattacaatntatctctagaccaacacaccagacaacaccccaatcatgtatttgagtanaatagccgcctcgacgggtccngactcgtcttctcgacggtcctacccgaagtctcggacaaccgaccggccctcccgtacgaccgtcctcgcggcctacgagtacgtgacgtgcgaggtctagtattatcgtgacagtctanacttagtaccgagacgagaccaaggtacggtgtaccggaggacgaccgtagttcggacctagacggtcaccgacgacggccgtccgaacccgtggacctacgtcgtcccgtcccgacccttccg

SEQ ID NO: 327266 - DNA, 653 bp, Homo sapiens
  misc_feature: GZ8MTXP02JWAZG.8.42.D09.1.454.CMB.2.raw
  modified_base (222)..(222): a, c, t, g, unknown or other
  misc_feature (222)..(222): n is a, c, g, or t
  modified_base (231)..(231): a, c, t, g, unknown or other
  misc_feature (231)..(231): n is a, c, g, or t
  modified_base (240)..(240): a, c, t, g, unknown or other
  misc_feature (240)..(240): n is a, c, g, or t
  modified_base (268)..(268): a, c, t, g, unknown or other
  misc_feature (268)..(268): n is a, c, g, or t
tcagctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcatgganccagcagtnattacaatntatctctgtaccaacaacaccagcaacnccccaatcatgtattttgagtacaatacgcggcctgacgggtcctgactcgtcttctcgacggtcctacccgacgtcgtacgactaaccgaccggacctcccgtacgtaccgttccgtcgtcgggtcctaccgaacgtaccgtggaaggtacgtggaacggtcgtagtactttactaacgtcgtcacggtacctactaactttacgtcgaagttaccgaagaaccgtaaacggtaggggttaacggtacgggaaccggggtaacggaaaccgtaacggtttaccgaccgtaccgtacggtaccgaccggacccgaacgggtccctaccgtcccccggttacggtaccctacggttaccctcccggttacccctacccggttcccg

SEQ ID NO: 327267 - DNA, 680 bp, Homo sapiens
  misc_feature: GZ8MTXP02IBL8P.8.42.D09.1.454.CMB.2.raw
  modified_base (230)..(230): a, c, t, g, unknown or other
  misc_feature (230)..(230): n is a, c, g, or t
  modified_base (240)..(240): a, c, t, g, unknown or other
  misc_feature (240)..(240): n is a, c, g, or t
  modified_base (499)..(499): a, c, t, g, unknown or other
  misc_feature (499)..(499): n is a, c, g, or t
tcagctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctctgcactgagccagcagtnattacaattntatctcctgtaccaacaacacccaggacaacgcccccaaaactcaactgtaattttgaggtaccaagttaacgaccggtcccgtactacgggggtccccttgggacttcgccttactccgaggtcctcccaacgttcctcggcctaaccgacggtccctcccgttcgacccgtacccgtcttacggggccttaccaacgaccgtagacggtaagtcgtaggacgttacggtaattacgttaactggtacagtaccttanaacttagttacctacggacgacgtaacgaccgtaagggttacgttacggcggggaacgggaacccgtaaggttaccggttaccgggtacccgttaacggtccgtaacgaccccgaaacgggtctacccgtcccgttaccccgggactaccggtaccctcccggttccccgacccctccccg

SEQ ID NO: 327268 - DNA, 687 bp, Homo sapiens
  misc_feature: GZ8MTXP02JFHWM.8.42.D09.1.454.CMB.2.raw
  modified_base (225)..(225): a, c, t, g, unknown or other
  misc_feature (225)..(225): n is a, c, g, or t
  modified_base (234)..(234): a, c, t, g, unknown or other
  misc_feature (234)..(234): n is a, c, g, or t
  modified_base (318)..(318): a, c, t, g, unknown or other
  misc_feature (318)..(318): n is a, c, g, or t
  modified_base (421)..(421): a, c, t, g, unknown or other
  misc_feature (421)..(421): n is a, c, g, or t
tcagctcgcgtgtccacgaccggtgctcgatttagacacatacgcaggggaaaggggggggtctcaggaggcagcgctctcaggacgtcaccaccatggcctgggctctgctcctcctcaccctcctcactcagggcacagggtcctgggcccagtctgccctgactcagcctccctcgcgtccggtctcctggacagtcagtcaccatcctcctgcactggacnccagcagtnaattacaactatactcctccgtcggtaaccaacaaccacccgaggaccaaaccgacccccaaactcatgtattttgagtacaanacgccgacctcgacgggtcctgactcgtcttctcgacggtcctacccgaagtcgtcggaccaaccgccggtccctcccgcgacccgtctcgtcggctaccganaccgtaggacggatggacggtcttagacttttagacctgactagcctacattactcgaggtccaaagtaccgtaaaggtacggggtttaacgtcggggaacggggtaaccgggtaaaccgttaagggttacccgggtaaaccccggtttcgtaacgggggtacccaccgggttacccccgaagggttccccctacccgggttccccccgtggtttaccccacccgggtttctccccccggtttacccccaacccccgtttccccgg

SEQ ID NO: 327269 - DNA, 689 bp, Homo sapiens
  misc_feature: GZ8MTXP02IYHCH.8.42.D09.1.454.CMB.2.raw
  modified_base (210)..(210): a, c, t, g, unknown or other
  misc_feature (210)..(210): n is a, c, g, or t
  modified_base (226)..(226): a, c, t, g, unknown or other
  misc_feature (226)..(226): n is a, c, g, or t
  modified_base (277)..(277): a, c, t, g, unknown or other
  misc_feature (277)..(277): n is a, c, g, or t
  modified_base (312)..(312): a, c, t, g, unknown or other
  misc_feature (312)..(312): n is a, c, g, or t
  modified_base (324)..(324): a, c, t, g, unknown or other
  misc_feature (324)..(324): n is a, c, g, or t
tcagctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcaccntcctctgcactggacncagcagtgattacatatatctctagtaccaacacaccagacaacacccaancatgtatttgagtacaatagcgcctcgacggtccngactcgtcttcncgacgtctacccgtaagtccgtacgaccaacgccggttaccctcccgtccgacccgtccgttcgtcgggcctaccgacgtaccgtaggaggtacgtaggtacggtacgttagtaactttaacgttacgtacgactacgttacctacttaagtttaacgttacgacgggttaccgaaagaaccgtaaaggttcgggttaaacggttcggggaaccggggtaacggtaacccggttaaaacggttccggtaaccccggttacggtaacgggaacccgtaacgaccccgtaaaggtccccgttcccccgtaacccccggttacgacccgttacgtcccgttaccctttaccccgcccctttaacccgg

SEQ ID NO: 327270 - DNA, 670 bp, Homo sapiens
  misc_feature: GZ8MTXP02ISAGS.8.42.D09.1.454.CMB.2.raw
  modified_base (193)..(193): a, c, t, g, unknown or other
  misc_feature (193)..(193): n is a, c, g, or t
  modified_base (204)..(204): a, c, t, g, unknown or other
  misc_feature (204)..(204): n is a, c, g, or t
  modified_base (219)..(219): a, c, t, g, unknown or other
  misc_feature (219)..(219): n is a, c, g, or t
  modified_base (348)..(348): a, c, t, g, unknown or other
  misc_feature (348)..(348): n is a, c, g, or t
  modified_base (401)..(401): a, c, t, g, unknown or other
  misc_feature (401)..(401): n is a, c, g, or t
  modified_base (418)..(418): a, c, t, g, unknown or other
  misc_feature (418)..(418): n is a, c, g, or t
tcagctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagcctcctcgcgtccggtctctggacngtcagtcaccntcctctgcactgganccagcagtgattacaactatactcctctgtaccaacaacaccagcaaacgccccaaatcatgatttgagtcaatagccgcctgacgggtcctgactcgcttctcgaggtctccccgagtctggacaacnccggcctccgtgaccctcgtctcgggctcgagtacgtgacggtatcggaggtntaggtactttattacgngtacagtccttacattacgttcgaagggccaacggtccgtaaacggtaacgggggtttacttcccgggggaacggggtaaaccggtaccgttaaaacgggttttccggacccggtttacccgtagggttacccgaaaccgggttacccccgaaacggggttcccgttacccggccccccccgtttaaaggggttcccccgttaaacccttcccgtttaacccggttttacccccccccacccgtttaccccg

SEQ ID NO: 327271 - DNA, 636 bp, Homo sapiens
  misc_feature: GZ8MTXP01A4595.10.53.E09.1.454.CMB.2.raw
  modified_base (321)..(321): a, c, t, g, unknown or other
  misc_feature (321)..(321): n is a, c, g, or t
  modified_base (326)..(326): a, c, t, g, unknown or other
  misc_feature (326)..(326): n is a, c, g, or t
  modified_base (328)..(329): a, c, t, g, unknown or other
  misc_feature (328)..(329): n is a, c, g, or t
  modified_base (334)..(334): a, c, t, g, unknown or other
  misc_feature (334)..(334): n is a, c, g, or t
  modified_base (347)..(347): a, c, t, g, unknown or other
  misc_feature (347)..(347): n is a, c, g, or t
  modified_base (488)..(488): a, c, t, g, unknown or other
  misc_feature (488)..(488): n is a, c, g, or t
tcagcatagtagtgcacgaccggtgctcgatttagagagagtgtgttgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcactgggtccgtcaggctccaggcaaggggctggagtgggtggcagttatctcatttgatggagacaataaatactacagagactccgtggggccgattcaccatctccaaaagacaaatttgaagaacacgcngtttntnnaatanacagctgagacgntgaggacgacgacgtgtgtattacttgtttcgtttggtttcgttgtacgtcggtcggggtaacggtaacgttactacgacgacgacgggcgggacgggacggacccgtaccgtaccgtaccgtccgtccctcctaccaccncccacccgaaccgaccgaccgtaccgtccgttccccgttcccgtcccgtccctccccttaccctacccgaccgaccgaacccgaccgttccgggttaccgggaaccggacggaaccggcccggccgggttccggtccggttcggtcgg

SEQ ID NO: 327272 - DNA, 568 bp, Homo sapiens
  misc_feature: GZ8MTXP01BPBH4.10.53.E09.1.454.CMB.2.raw
  modified_base (242)..(242): a, c, t, g, unknown or other
  misc_feature (242)..(242): n is a, c, g, or t
  modified_base (262)..(262): a, c, t, g, unknown or other
  misc_feature (262)..(262): n is a, c, g, or t
  modified_base (350)..(350): a, c, t, g, unknown or other
  misc_feature (350)..(350): n is a, c, g, or t
  modified_base (362)..(362): a, c, t, g, unknown or other
  misc_feature (362)..(362): n is a, c, g, or t
  modified_base (378)..(378): a, c, t, g, unknown or other
  misc_feature (378)..(378): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtggagtcgtgggggagcgtggtccagccgtggggacgtccctnagactctcctgttacgcctntggattcaccttcagtagttatcctttgctacgtgggtccctcaggctccgaggcgaagggggctgggagtggggtggcagttatctnatttgactgganacaaataaataactangagactccggtcgggctatcacatcacaaagactaattagaaagaactacgtctagttctagactaaataggaacagcctagagagcgtagaggacacggtctgtgttaacttacgttgtttcgtttggttctcgttacgttcggttacggggtaactaccgttcgacgcgacggtcggggccgaacggg

SEQ ID NO: 327273 - DNA, 586 bp, Homo sapiens
  misc_feature: GZ8MTXP01CRWHN.10.53.E09.1.454.CMB.2.raw
  modified_base (360)..(360): a, c, t, g, unknown or other
  misc_feature (360)..(360): n is a, c, g, or t
tcagcatagtagtgcacgaccggtgctcgatttagagagagtgtgttgggtttggggctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggagcgtggtccagccagggaggtccctcagactctcctgtttagcctctggattcactcagtagttatcctttgcacgtgggtcctcaggcctccgagggccaagggggctggaggtggggtggcagttatctcatttgatgganacaaaataaatctacagagactccggtcgggcattcacatctacaaagacaattagaaagaacacgtctacgtttactagacaaagtagaaacacgcctagagacgcgtaggaaggacgacggctaagtgttagtttacgttgtttccggttttggtttccgttggttaccgttccgggtacgggggtaaacttacccgttacgacggtccgaacggttccggggg

SEQ ID NO: 327274 - DNA, 552 bp, Homo sapiens
  misc_feature: GZ8MTXP01A14NV.10.53.E09.1.454.CMB.2.raw
tcagcatagtagtgcacgaccggtgctcgatttagagagagtgtgttgggtttcctcgttgctctttaagaggtgtccagtgtcaggtgcagctggtggagtctggggaggcgtggtccagcctgggaggtccctcagactctcctgtttagcctctggattcaccttcagtagttatcctttgcactgggtccgtcaggctccaggcaaggggctggagtgggtgcagttatctcatttgatggagacaataaatactacagagactccgtcggggccattcaccatctccaaagacaatttgaaagaacacgctgtttctgacaaatgaaacagcctgagagctgaggacacggctgtgtattactgttcgttgtctgactcgtcggggatactcagcacgtgggcagggcaccgtgtcaccgtctcctcacgcctaccaccgaacgggcccacgtccggtccttcccccgtcggcccaacccctccttccaacgcgccaccttccgttcgggggccaacgcggccggcccgtcggggctcgccgtcggg

SEQ ID NO: 327275 - DNA, 550 bp, Homo sapiens
  misc_feature: GZ8MTXP01C7KE3.10.53.E09.1.454.CMB.2.raw
  modified_base (242)..(242): a, c, t, g, unknown or other
  misc_feature (242)..(242): n is a, c, g, or t
  modified_base (261)..(261): a, c, t, g, unknown or other
  misc_feature (261)..(261): n is a, c, g, or t
  modified_base (357)..(357): a, c, t, g, unknown or other
  misc_feature (357)..(357): n is a, c, g, or t
  modified_base (372)..(372): a, c, t, g, unknown or other
  misc_feature (372)..(372): n is a, c, g, or t
  modified_base (375)..(375): a, c, t, g, unknown or other
  misc_feature (375)..(375): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtggagtcgtggggggagcgtggtccagcctggggacgtccctnagactctcctgttagcctntggattcaccttcagtagttatcctttgcacgtgggtccctcaggctccgaggcaagggggctgggagtgggtggcagttatctcatttgatgganacaataaatactacnganacgtccggtcgggcatcacatctaccaagacaattagaagaacacgtcttgttctagacaaatagggaacagcctagagagcgtaggagacgacggctgtgtaattacttgtttcgttggttctgttacgttcggttacggggtaataccgttcacgcacgtcgggccgaacggg

SEQ ID NO: 327276 - DNA, 611 bp, Homo sapiens
  misc_feature: GZ8MTXP01EKJPL.10.53.E09.1.454.CMB.2.raw
  modified_base (241)..(241): a, c, t, g, unknown or other
  misc_feature (241)..(241): n is a, c, g, or t
  modified_base (351)..(351): a, c, t, g, unknown or other
  misc_feature (351)..(351): n is a, c, g, or t
  modified_base (367)..(367): a, c, t, g, unknown or other
  misc_feature (367)..(367): n is a, c, g, or t
  modified_base (518)..(518): a, c, t, g, unknown or other
  misc_feature (518)..(518): n is a, c, g, or t
tcagcatagtagtgcacgaccggtgctcgatttagagagagtgtgttgggtttgggggagacgagcccagcactggaagtcgccggtgcttccattcggtgatcatcactgaacacagaggactcaccatggagtttgggctgagcttgggttttcctcgttgcttcttttaagaggtgtccagtgtcaggtgcagctggtggagtcgtgggggagcgtggtccagcctgggacgtccctnagactctcctgtttacgcctctggattcaccttcagttagttacttcctttgctacgtgggtcctcagggcctccgaggcgaagggggctgggagtgggtggctagttanctcatttgatgggaanaacaaataaaaatactaacgagaacgtacctccgggttcgggggacctattaccacctatacctaccaaagaactaaatttagaaagtaacacgtcttacgttctacgacaaatacgaaacagacctagagagcgtaggagtacgacggtntgtaagttattacgttgtttcggtttgttcgttgttcgttacgggtaacgggggaacttccgttcgagttcgtaaccggttcggggaacccgg

SEQ ID NO: 327277 - DNA, 543 bp, Homo sapiens
  misc_feature: GZ8MTXP01D3DJK.10.53.E09.1.454.CMB.2.raw
tcagcatagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctgcctgtgtctctggggcagagggccaccatcaactgcaagtccagccagagttgtttatcagctccgacaataagaactactagcttggaccagcaagaaaccaggacagcctctaagctgctcatttactgggcatcgtaccgggatccccggggtcctgaccgattcgaagtggcagcgggtctgggacagtatttcactctcaccatcagcagcctgcaggctagaagagtgcggtctagtttatactgtcagctactattatactaacccctattccaacagttccggcccgttaggggaacccttaaaaggtcgggaaagtaattaaccgaaaacggttaaccgttcgggttcggtccg

SEQ ID NO: 327278 - DNA, 586 bp, Homo sapiens
  misc_feature: GZ8MTXP01EAE57.10.53.E09.1.454.CMB.2.raw
  modified_base (238)..(238): a, c, t, g, unknown or other
  misc_feature (238)..(238): n is a, c, g, or t
  modified_base (252)..(252): a, c, t, g, unknown or other
  misc_feature (252)..(252): n is a, c, g, or t
  modified_base (256)..(256): a, c, t, g, unknown or other
  misc_feature (256)..(256): n is a, c, g, or t
  modified_base (342)..(342): a, c, t, g, unknown or other
  misc_feature (342)..(342): n is a, c, g, or t
  modified_base (354)..(354): a, c, t, g, unknown or other
  misc_feature (354)..(354): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagctgggttttcctcgttgcttcttttaagaggtgtccagtgtcaggtgcagctggtggagtcgtgggggagcgtggtccagcctgggagtccctnagctctcctgttancctntggattcacttcagtagttatcctttgctacgtgggtcctcaggctccgaggcgaagggggctgggagtggggtgctagttatctnatttgatggaanacaaataaataactacaagagacctccggttcggggcctattcaccatactacaaagacaattagaaagaacacgtctgttctgacaaatggaaacagacctgagagctagaacggacacggcttgtgttaatttacgttgtttcggttttggttcgttcgttaccgttcgggttacgggggtaaacttacccgttccgaaggtccgacggttcgggggcccgtaaccgggg

SEQ ID NO: 327279 - DNA, 587 bp, Homo sapiens
  misc_feature: GZ8MTXP01EJ0UM.10.53.E09.1.454.CMB.2.raw
  modified_base (242)..(242): a, c, t, g, unknown or other
  misc_feature (242)..(242): n is a, c, g, or t
  modified_base (361)..(361): a, c, t, g, unknown or other
  misc_feature (361)..(361): n is a, c, g, or t
  modified_base (378)..(378): a, c, t, g, unknown or other
  misc_feature (378)..(378): n is a, c, g, or t
  modified_base (499)..(499): a, c, t, g, unknown or other
  misc_feature (499)..(499): n is a, c, g, or t
tcagcatagtagtgcacgaccggtgctcgatttagagagagtgtgttgggtttggggctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggagcgtggtccagcctgggagtccctnagactctcctgttagcctctgattcacctcagtagttatcctttgctacgtgggtccctcaggcctccgaggcaagggggctgggagtggggtgctagttatctctatttgatgggaanaacaaaataaatctaanaggacgaccgtccgggttcggggacctattcacctatactaccaaagactaaatttagaaagaacacgtcttagttactagacaaatgaaacagcctagagagactaggacgacgacggtntgttagttattacgttggtttcgtttggttcgttcgttacggttcggtagggggtaactaccgttcgacgtcgttaacggtccggggg

SEQ ID NO: 327280 - DNA, 545 bp, Homo sapiens
  misc_feature: GZ8MTXP01DBN1V.10.53.E09.1.454.CMB.2.raw
  modified_base (237)..(237): a, c, t, g, unknown or other
  misc_feature (237)..(237): n is a, c, g, or t
  modified_base (297)..(297): a, c, t, g, unknown or other
  misc_feature (297)..(297): n is a, c, g, or t
  modified_base (337)..(337): a, c, t, g, unknown or other
  misc_feature (337)..(337): n is a, c, g, or t
  modified_base (348)..(348): a, c, t, g, unknown or other
  misc_feature (348)..(348): n is a, c, g, or t
  modified_base (362)..(362): a, c, t, g, unknown or other
  misc_feature (362)..(362): n is a, c, g, or t
  modified_base (365)..(365): a, c, t, g, unknown or other
  misc_feature (365)..(365): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggagcgtggtccagcctgggagtccctnagactctcctgttagcctctggattcaccttcagtagttatcctttgcactgggtccgtnaggctccaggcaagggggctggagtgggtgcagttatctnatttgatgganacaataataactanganactccgtcggggcattcacatctacaaagacaattagaaagaacacgctgttctgacaaatggaaacagacctgagagctgaggacacggctgtgtaattacgttgtttcgtttggttctgttacgttcggttacgggggtaacttaccgttcgacgcgttacgtcggggccgaacgggg

SEQ ID NO: 327281 - DNA, 572 bp, Homo sapiens
  misc_feature: GZ8MTXP01D4C8X.10.53.E09.1.454.CMB.2.raw
  modified_base (321)..(321): a, c, t, g, unknown or other
  misc_feature (321)..(321): n is a, c, g, or t
  modified_base (425)..(425): a, c, t, g, unknown or other
  misc_feature (425)..(425): n is a, c, g, or t
  modified_base (504)..(504): a, c, t, g, unknown or other
  misc_feature (504)..(504): n is a, c, g, or t
  modified_base (568)..(568): a, c, t, g, unknown or other
  misc_feature (568)..(568): n is a, c, g, or t
tcagcatagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctgcctgtgtctcgtgggcgagagggccaccatcaactgcaagtccagccagtagtgtttatcagctccgacaataagaactactagcttggaaccagacaacgaaaccaggaacacgccctaccaagctagctctatttacgngggacacgtccgtaacccggggtaactccccccgggggtccctaggacccgtattccgaagggtcggcagggtcgggtctagggacagtactttcactctcacntcagcagcctgcgaggctagaacgagtcggcggtacttagtttactacgtgtcaagtcctatattactacgtaaccctnttcacttcgttccggcccgttagggaaccttaaaggtggaagaactaacgaaacgttactcggngtcc

SEQ ID NO: 327282 - DNA, 595 bp, Homo sapiens
  misc_feature: GZ8MTXP01APXYQ.10.53.E09.1.454.CMB.2.raw
  modified_base (273)..(273): a, c, t, g, unknown or other
  misc_feature (273)..(273): n is a, c, g, or t
  modified_base (351)..(351): a, c, t, g, unknown or other
  misc_feature (351)..(351): n is a, c, g, or t
  modified_base (363)..(363): a, c, t, g, unknown or other
  misc_feature (363)..(363): n is a, c, g, or t
  modified_base (459)..(459): a, c, t, g, unknown or other
  misc_feature (459)..(459): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagcgtggttttcctcgttgctctttaagaggtgtccagtgtcaggtgcagctggtggagtcgtgggggagcgtggtccaggccgtgggacgtccctcagactctcctgtttacgcctctggattcaccttnagtagttatcctttgctacgtgggtcctcaggcctccgaaggcgaagggggctgggaggtggggtgctagttatctanatttgactgganaacaaataaataactacaagagacctccgggtcggggacctattccacatcctaacaaagactaattacgaaagacacgtcttgttacagaacaanacgaacgacgacgagagagcgaggacgacgtacgtcgtgtgttaacgttcgttggtttcgtttcggttcgttcggttacggttcgggttacgggtaacgttaccgtcgtacgtacggttacggtcgggccggtcgg

SEQ ID NO: 327283 - DNA, 661 bp, Homo sapiens
  misc_feature: GZ8MTXP01D5O9Q.10.53.E09.1.454.CMB.2.raw
  modified_base (241)..(241): a, c, t, g, unknown or other
  misc_feature (241)..(241): n is a, c, g, or t
  modified_base (255)..(255): a, c, t, g, unknown or other
  misc_feature (255)..(255): n is a, c, g, or t
  modified_base (258)..(258): a, c, t, g, unknown or other
  misc_feature (258)..(258): n is a, c, g, or t
  modified_base (267)..(267): a, c, t, g, unknown or other
  misc_feature (267)..(267): n is a, c, g, or t
  modified_base (292)..(292): a, c, t, g, unknown or other
  misc_feature (292)..(292): n is a, c, g, or t
tcagcatagtagtgcacgaccggtgctcgatttagagagagtgtgttgggtttggggctgggagacgagcccagcactggaagtcgccggtgtttccattcggtgatcatcactgaacacagaggactcacatggagtttgggctgagctgggttttcctcgttgctcttttaagaggtgtccagtgtcaggtgcagctggtggagtctgggggagcgtggtccagcctggggagtccctnagactctctgttanctntgatcactnagtattatcttgcacgtgggtccgnaggcctccgaggacgaaagggggcgtggaggtgggtgggcgtagttattctctactttagtagtaggagaacaaaaaataaaataactaaacaaagaagacgtaccggttcggggtaccggtacttacaaccaactactaaccaaaacgaaactaaattaagtaaagaaacgaaacgacgttcgtttacgttacgtaacgtaaaataaagaaacgaacgaccgtacgaggaaggacgtacgtaggaacgaacggacgtggttagttaagtttaacgtttacgtttcggttttcggtttcgttcgttacgttaacgggtacgggggtaacggtaaccgttacgttacgtaaccggaacccgggaacccgg

SEQ ID NO: 327284 - DNA, 541 bp, Homo sapiens
  misc_feature: GZ8MTXP01BJQGL.10.53.E09.1.454.CMB.2.raw
  modified_base (247)..(247): a, c, t, g, unknown or other
  misc_feature (247)..(247): n is a, c, g, or t
  modified_base (478)..(478): a, c, t, g, unknown or other
  misc_feature (478)..(478): n is a, c, g, or t
  modified_base (483)..(483): a, c, t, g, unknown or other
  misc_feature (483)..(483): n is a, c, g, or t
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggagcgtggtccagcctgggaggtccctnagactctcctgtttagcctctggatcaccttcagtagttatcctttgcactgggtcctcaggctccaggcaagggggctggagtggggtgcagttatctcatttgatggaagacaataaatctacagagactcgtcgggcgatcacatctacaaagactaatttagaagtaacacgtacttcgtttacgtgtacaaatagaacagcctagaagagctgacggacaacggtnttgtnttagttacgttgtttcgttggttctgtcgtcgggtacggggtacttacgttcgcgtcg

SEQ ID NO: 327285 - DNA, 586 bp, Homo sapiens
  misc_feature: GZ8MTXP01A1I0U.10.53.E09.1.454.CMB.2.raw
  modified_base (244)..(244): a, c, t, g, unknown or other
  misc_feature (244)..(244): n is a, c, g, or t
  modified_base (363)..(363): a, c, t, g, unknown or other
  misc_feature (363)..(363): n is a, c, g, or t
tcagcatagtagtgcacgaccggtgctcgatttagagagagtgtgttgggtttggggctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggagcgtggtccagccgtgggacgtccctnagctctcctgttacgctctggattcactcagtagttatcctttgctacgtgggtcctcaggctccgaggcgaagggggctggaggtggggtggctagttatctctagtttgagtggaanaacaaaataaataactacgagacgtactcccgggttcggggcctatccacactactaccaaagactaaactttagaaacgtaacacgtcttgtttactacgacaaatcgaaacacgaccgtagagagcgtaggaggacgacggtctaagttgttatttacgttgtttcgtttggttcgttgttacgtcggtacggggtaacttccgttgacgtcgcgtcgggg

SEQ ID NO: 327286 - DNA, 593 bp, Homo sapiens
  misc_feature: GZ8MTXP01AEE2E.10.53.E09.1.454.CMB.2.raw
  modified_base (238)..(238): a, c, t, g, unknown or other
  misc_feature (238)..(238): n is a, c, g, or t
  modified_base (257)..(257): a, c, t, g, unknown or other
  misc_feature (257)..(257): n is a, c, g, or t
  modified_base (345)..(345): a, c, t, g, unknown or other
  misc_feature (345)..(345): n is a, c, g, or t
  modified_base (356)..(356): a, c, t, g, unknown or other
  misc_feature (356)..(356): n is a, c, g, or t
tcagcatagtagtgcacgaccggtgctcgatttagagagagtgtgttgggtttgggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggagcgtggtccagcctgggagtccctnagactctcctgttagcctntggattcaccttcagtagttatcctttgctacgtgggtcccgtcaggcctccgaggcaagggggctgggagtgggtggcagttatctnatttgatgganacaataaataactacaagagacctccggttcggggcctattccaaccatactaccaaagactaattagaaagaacacgtctgttctagacaaatacggaaacagcctagaagagcgtaggacggacgtacggtctggtgttaattacgttggtttcggtttggttcgttcggttacgttcgggttacgggggtaacttaccgttcgacggccgttacggtcggggccgtaaccgggg

SEQ ID NO: 327287 - DNA, 563 bp, Homo sapiens
  misc_feature: GZ8MTXP01C7CLC.10.53.E09.1.454.CMB.2.raw
tcagcatagtagtgcacgaccggtgctcgatttagagagagtgtgttgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcactggtccgtcaggctccaggcaaggggctggagtgggtggcagttatctcatttgatggagacaataaatactacagagactccgtcgggcattcaccatctaccaaagacaaatttgaagaacacgctgtttctgacaaatgaacagcctgagacgctgagacacggctgtgtatactgttcgttgtctgactcgtcggggatacgttcagcacgtgggccagggcaccgtggtaccaccgtcgtcctcacgccctccacccgaacgggcccacgtccggtccttcccctcggcccaacccctccttaccaacgcgaccaccttcgttcgggggccaacggacgccggtcccgcgggcctcggccgtaacggg

SEQ ID NO: 327288 - DNA, 608 bp, Homo sapiens
  misc_feature: GZ8MTXP01E1UDQ.10.53.E09.1.454.CMB.2.raw
  modified_base (259)..(259): a, c, t, g, unknown or other
  misc_feature (259)..(259): n is a, c, g, or t
  modified_base (333)..(333): a, c, t, g, unknown or other
  misc_feature (333)..(333): n is a, c, g, or t
  modified_base (456)..(456): a, c, t, g, unknown or other
  misc_feature (456)..(456): n is a, c, g, or t
  modified_base (469)..(469): a, c, t, g, unknown or other
  misc_feature (469)..(469): n is a, c, g, or t
tcagcatagtagtgcacgaccggtgctcgatttagagagagtgtgttgggtttgggggagctacaacaggcaggcaggggcagcaagatggtgttgcagacccaggtcttcatttctctgttgctctggatctctggtgccgtacggggacatcgtgatgacccagtctccagacctccctgcctgtgtctcgtgggcgaggacgggcccaccatcaactgacaagtccagccagtagttgttttatcagctaccgaanaaataagaactactagcttaggaaccagacaagaaaccaggacacgccctacaagctagctactaatttacggngggacacgtaccgtaaccccgggacgttccccccgggggtaccctgaaccgtattccgaaggttcggccagggtccgggtcgtaggggactagtactttccactctccacatcagcacgtccngcagctagaaagnggcggacggtacttaagtttactcgtcgtacacgctaaacttattacctaacctaacccctattaccacttacgttccggaccgttaacggggaacttaaagggtgaacgtaactaacgaaacgacgtcgggttaagcc

SEQ ID NO: 327289 - DNA, 553 bp, Homo sapiens
  misc_feature: GZ8MTXP01B2L8P.10.53.E09.1.454.CMB.2.raw
  modified_base (240)..(240): a, c, t, g, unknown or other
  misc_feature (240)..(240): n is a, c, g, or t
  modified_base (370)..(370): a, c, t, g, unknown or other
  misc_feature (370)..(370): n is a, c, g, or t
  modified_base (457)..(457): a, c, t, g, unknown or other
  misc_feature (457)..(457): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtggagtcgtgggggagcgtggtccagcctgggacgtccctnagactctcctgttacgcctctggattcaccttcagtagttatcctttgcacgtgggtcctcaggctccgaggcaagggggctggagtgggtgcagttatctcatttgatggagacaaataaataactacngagactccggttcggggcctattcaccatctacaaagacaattagaaacgaacacgtctgttcagacaaataggaacagcctagagngctgaggcacggctgtgtaattacgttgtttcgtttggttctgttacgttcgggttacggggtaatccgttcacgcgacgtcggggccgtaacggg

SEQ ID NO: 327290 - DNA, 591 bp, Homo sapiens
  misc_feature: GZ8MTXP01DJAT4.10.53.E09.1.454.CMB.2.raw
  modified_base (241)..(241): a, c, t, g, unknown or other
  misc_feature (241)..(241): n is a, c, g, or t
  modified_base (260)..(260): a, c, t, g, unknown or other
  misc_feature (260)..(260): n is a, c, g, or t
  modified_base (343)..(343): a, c, t, g, unknown or other
  misc_feature (343)..(343): n is a, c, g, or t
  modified_base (346)..(346): a, c, t, g, unknown or other
  misc_feature (346)..(346): n is a, c, g, or t
  modified_base (359)..(359): a, c, t, g, unknown or other
  misc_feature (359)..(359): n is a, c, g, or t
  modified_base (374)..(374): a, c, t, g, unknown or other
  misc_feature (374)..(374): n is a, c, g, or t
tcagcatagtagtgcacgaccggtgctcgatttagagagagtgtgttgggtttgggggagacgagcccagcactggaagtcgccggtgtttccattcggtgatcatcactgaacacagaggactcaccatggagtttgggctgagcttgggttttcctcgttgctcttttaagaggtgtccagtgtcaggtgcagctggtggagtcgtgggggagcgtggtccagcctggggacgtccctnagactctcctgttagcctntggattcacttcagtagttatcctttgctacgtgggtcctcaggcctccgaggcgaagggggctgggagtggggtgcagttanctntatttgatggaanacaaataaatacaangacgacgtccggttcggggcctattccacctatctaccaaagactaattagaaagaacacgtcttagttactagactaaatacggaaacagaccgtagagagctagaacggacgacggtcgtgttgttaactttacgttgtttcgtttggttcgtcgttacgttcgggttacggggtaacttaccgttcgacgtcgttacggtcgggccgtaacggg

SEQ ID NO: 327291 - DNA, 581 bp, Homo sapiens
  misc_feature: GZ8MTXP01B2YUO.10.53.E09.1.454.CMB.2.raw
  modified_base (242)..(242): a, c, t, g, unknown or other
  misc_feature (242)..(242): n is a, c, g, or t
  modified_base (272)..(272): a, c, t, g, unknown or other
  misc_feature (272)..(272): n is a, c, g, or t
  modified_base (364)..(364): a, c, t, g, unknown or other
  misc_feature (364)..(364): n is a, c, g, or t
tcagcatagtagtgcacgaccggtgctcgatttagagagagtgtgttgggtttggggctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggagcgtggtccagcctgggagtccctnagactctcctgtttagcctctgattcactnagtattatcctttgcacgtgggtcccgtcaggcctccgaggcgaagggggctgggaggtgggggtggctagttatctctatttggatggaanacaaaattaaatctaacagacgactccggttcggggcctatcacactctaccaaagactaaatttagaaagtaacacgtctgtttactagacaaatagaacacgcctagagagactaggaacggacgacggcttggtagttatttacgttgtttcgtttggttcgttggttacgttcgggtacggggtaacttccgtcgacgtccgaacggtcgggg

SEQ ID NO: 327292 - DNA, 711 bp, Homo sapiens
  misc_feature: GZ8MTXP01A2ZDH.10.53.E09.1.454.CMB.2.raw
  modified_base (165)..(165): a, c, t, g, unknown or other
  misc_feature (165)..(165): n is a, c, g, or t
  modified_base (181)..(181): a, c, t, g, unknown or other
  misc_feature (181)..(181): n is a, c, g, or t
  modified_base (245)..(245): a, c, t, g, unknown or other
  misc_feature (245)..(245): n is a, c, g, or t
  modified_base (264)..(264): a, c, t, g, unknown or other
  misc_feature (264)..(264): n is a, c, g, or t
  modified_base (273)..(273): a, c, t, g, unknown or other
  misc_feature (273)..(273): n is a, c, g, or t
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagctgggttttccncgttgctcttttaagnggtgtccagtgtcaggtgcagctggtggagtcgtgggggagcgtggtccgagcgtgggcgtccnagactctctgtacgcctgngtatcactnagtatctcttgctacggtcgggtcctacgacggtcctaccggaggtacggacgggggtcgtagggggagggttgggggtcgtacgtaggttactccctagttagtttgagtaggaaacaaactaaataaactacacgagacgtaccgtcggggtaccgggaccttactaccaacctactacctaaacgaaaacgtaacttaaagttaacgggaaactaaccgtaaccggttactttacggtttacgtacggaaactaaaagtaacgaaaccgaacggtcccgttaaggaaacggtaaggtccggtaagggaaacggtaaccggaaccggtacgttggttaagtttaacgtttacgtttcggttttcggtttcggttcgtaacggtaaccggttccgggggtaacggggttaacttaccccgttaagccggtaaccggg

SEQ ID NO: 327293 - DNA, 580 bp, Homo sapiens
  misc_feature: GZ8MTXP01A4TPK.10.53.E09.1.454.CMB.2.raw
  modified_base (241)..(241): a, c, t, g, unknown or other
  misc_feature (241)..(241): n is a, c, g, or t
  modified_base (274)..(274): a, c, t, g, unknown or other
  misc_feature (274)..(274): n is a, c, g, or t
  modified_base (359)..(359): a, c, t, g, unknown or other
  misc_feature (359)..(359): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtggagtcgtgggggagcgtggtccagcctggggacgtccctnagactctcctgtttagcctctggattcaccttnagtagttatcctttgctacgtgggtcctcaggcctccgaggcgaagggggctgggagtgggtgctagttatctcatttgatgganaacaaataaatactaacaagacgtacctccgggttcggggcctattccaaccactactaccaaagactaattagaaacgaacacgcttgttctagacaaatacggaacagaccgtagagagcgtaggaaggacgacggtctgtgttaattacttgtttcgtttggttctgttacgttcggttacggggtaataccgtcgacgcgacgtcgggccgaacggg

SEQ ID NO: 327294 - DNA, 553 bp, Homo sapiens
  misc_feature: GZ8MTXP01BSVFX.10.53.E09.1.454.CMB.2.raw
  modified_base (160)..(160): a, c, t, g, unknown or other
  misc_feature (160)..(160): n is a, c, g, or t
  modified_base (242)..(242): a, c, t, g, unknown or other
  misc_feature (242)..(242): n is a, c, g, or t
  modified_base (304)..(304): a, c, t, g, unknown or other
  misc_feature (304)..(304): n is a, c, g, or t
  modified_base (349)..(349): a, c, t, g, unknown or other
  misc_feature (349)..(349): n is a, c, g, or t
  modified_base (361)..(361): a, c, t, g, unknown or other
  misc_feature (361)..(361): n is a, c, g, or t
  modified_base (441)..(441): a, c, t, g, unknown or other
  misc_feature (441)..(441): n is a, c, g, or t
  modified_base (457)..(457): a, c, t, g, unknown or other
  misc_feature (457)..(457): n is a, c, g, or t
  modified_base (477)..(477): a, c, t, g, unknown or other
  misc_feature (477)..(477): n is a, c, g, or t
tcagcatagtagtgcacgaccggtgctcgatttagagagagtgtgttgggtttggggctgggagacgagcccagcactggaagtcgccggtgtttccattcggtgatcatcactgaacacagaggactcaccatggagtttgggctgagcgtggtttccncgtagctctttaagaggtgtccagtgtcaggtgcagctggtggagtcgtgggggagcgtggtccagccgtgggacgtccctnagactctcctgttacgcctctggattcacctcagtagttatcctttgcacgtgggtcccgtnaggcctccgaggcgaagggggctgggagtgggtgctagttatctntatttgatgganacaaaataaatctacagagaccgtccggttcggggctatcacatctacaaagactaattagaagaacacgtctgtttacngacaaatgaacagccngagagctgaggacacgggtntgtgttatcttgttggtttcgtttgttcgttcggtaacgtcgggtaacgggtaactccgttcgtaacgcgtaacgg

SEQ ID NO: 327295 - DNA, 562 bp, Homo sapiens
  misc_feature: GZ8MTXP01B8ZI8.10.53.E09.1.454.CMB.2.raw
  modified_base (246)..(246): a, c, t, g, unknown or other
  misc_feature (246)..(246): n is a, c, g, or t
  modified_base (274)..(274): a, c, t, g, unknown or other
  misc_feature (274)..(274): n is a, c, g, or t
  modified_base (343)..(343): a, c, t, g, unknown or other
  misc_feature (343)..(343): n is a, c, g, or t
  modified_base (346)..(346): a, c, t, g, unknown or other
  misc_feature (346)..(346): n is a, c, g, or t
  modified_base (357)..(357): a, c, t, g, unknown or other
  misc_feature (357)..(357): n is a, c, g, or t
  modified_base (413)..(413): a, c, t, g, unknown or other
  misc_feature (413)..(413): n is a, c, g, or t
  modified_base (417)..(417): a, c, t, g, unknown or other
  misc_feature (417)..(417): n is a, c, g, or t
tcagcatagtagtgcacgaccggtgctcgatttagagagagtgtgttgggtttggggctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtggagtcgtgggggagcgtggtccagccgtgggacgtccctnagctctcctgttagcctctgatcacctnagtattactccttgctacgtgggtcctcaggcctccgaggcgaagggggctggagtgggtgctagttanctntattgatgganacaaaataaatcacagacacgtcgtcgggcatcacatcacaaagactaattgaaanaacncgcttagttactgacaaatgaaacacgctagagagactgaacggtaccgacggtctggtacgttatttacgttggtttcgtttgggttccttggttaccgttcgggtacggggtaacttcccgtagacgtcgttaacggtcgggg

SEQ ID NO: 327296 - DNA, 650 bp, Homo sapiens
  misc_feature: GZ8MTXP01BS0OF.10.53.E09.1.454.CMB.2.raw
  modified_base (237)..(237): a, c, t, g, unknown or other
  misc_feature (237)..(237): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagctgggttttcctcgttgctctttaagaggtgtccagtgtcaggtgcagctggtggagtcgtgggggagcgtggtccagcctgggacgtccctnagctctcctgttacgcctctggacttcaccttcagtagttatcctttgcctacgtgggtccgtcaggcctccgaggcaagggggctgggaggtgggggtgctaggttatctctatttgattgggaacaacgtaaattaaactaaactaacgaaggtaacgtacccgttcccgggttacgggggaccctaattccaaccctactacctaaccaaagtaactaaatttagaaacgaactacgtcttacgttctacgactaaagtacggaaacacgtacctagacgacgcgtaggacggacgtacggtcgttggtgttaacgtttacgttggtttcggtttggttacgtggttaccgttcgggttacgggggtaacttaccgttcgacggtacgacggtcggggccgtaaccgggg

SEQ ID NO: 327297 - DNA, 617 bp, Homo sapiens
  misc_feature: GZ8MTXP01ECW7S.10.53.E09.1.454.CMB.2.raw
  modified_base (251)..(251): a, c, t, g, unknown or other
  misc_feature (251)..(251): n is a, c, g, or t
  modified_base (380)..(380): a, c, t, g, unknown or other
  misc_feature (380)..(380): n is a, c, g, or t
  modified_base (452)..(452): a, c, t, g, unknown or other
  misc_feature (452)..(452): n is a, c, g, or t
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtggagtcgtgggggagcgtggtccagccgtggggacgtccctnagactctcctgtttacgcctctggatcacttcagtagttatcctttgctacgtcgggtcccgtcaggcctaccgagggcgaagggggctgggaggtggggtcgctagttatcctatatttgatggaaanaactaataaatacacagacgacgtcggtcgggctatcactatcaacaaagactaattacgaaagaacacgtnttacgtttcagtactaaatagaacacgacgtaggaacgagaccgtaggaacgaccggtaacgtgttagttagtttaagttacgtttcggtttcggttttcggttcgttaacgggtaccggttccgggttaacgggggtaacttacccgttcgaacggtaacccgg

SEQ ID NO: 327298 - DNA, 585 bp, Homo sapiens
  misc_feature: GZ8MTXP01B9Z3S.10.53.E09.1.454.CMB.2.raw
  modified_base (236)..(236): a, c, t, g, unknown or other
  misc_feature (236)..(236): n is a, c, g, or t
  modified_base (255)..(255): a, c, t, g, unknown or other
  misc_feature (255)..(255): n is a, c, g, or t
  modified_base (357)..(357): a, c, t, g, unknown or other
  misc_feature (357)..(357): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagctgggttttcctcgttgctctttaagaggtgtccagtgtcaggtgcagctggtggagtcgtgggggagcgtggtccagcctgggagtccctnagactctcctgttagcctntggattcaccttcagtagttatccctttgcacgtggggtccctcaggcctccgaggcaagggggctgggaggtggggtgctagttatctcatttgactgganacaaataaataactacaaggacgtaccgtcccgggttcggggcctattccaacctatctaccaaagactaattagaaagaacacgtctgttctagacaaatggaacagcctagagagcgtagaggacacggtctgtgttaattacgttggtttcgtttggttctggttaccgttcggggttacgggggtaattccgttcgacggcgacggtcgggggccgtaacgggg

SEQ ID NO: 327299 - DNA, 544 bp, Homo sapiens
  misc_feature: GZ8MTXP01AW3K4.10.53.E09.1.454.CMB.2.raw
  modified_base (237)..(237): a, c, t, g, unknown or other
  misc_feature (237)..(237): n is a, c, g, or t
  modified_base (251)..(251): a, c, t, g, unknown or other
  misc_feature (251)..(251): n is a, c, g, or t
  modified_base (255)..(255): a, c, t, g, unknown or other
  misc_feature (255)..(255): n is a, c, g, or t
  modified_base (268)..(268): a, c, t, g, unknown or other
  misc_feature (268)..(268): n is a, c, g, or t
  modified_base (341)..(341): a, c, t, g, unknown or other
  misc_feature (341)..(341): n is a, c, g, or t
  modified_base (352)..(352): a, c, t, g, unknown or other
  misc_feature (352)..(352): n is a, c, g, or t
  modified_base (366)..(366): a, c, t, g, unknown or other
  misc_feature (366)..(366): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggagcgtggtccagcctgggagtccctnagctctcctgttancctntggattcaccttnagtagttatcctttgctacgtgggtcctcaggcctccgaggcaagggggctgggagtgggtgctagttatctnatttgatgganacaataaatacacngagactccggtcgggccattcacatctaccaaagactaattagaaagaacacgtactgttctgacaaataggaacagcctagagagctgaggacacggctgtgtaattacttgtttcgttgttctgttacgttcgggttacggggtaatccgttcgagcgacgtcggggccgaacggg

SEQ ID NO: 327300 - DNA, 578 bp, Homo sapiens
  misc_feature: GZ8MTXP01A9GZA.10.53.E09.1.454.CMB.2.raw
  modified_base (250)..(250): a, c, t, g, unknown or other
  misc_feature (250)..(250): n is a, c, g, or t
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtggagtcgtgggggagcgtggtccagccgtgggacgtccctnagactctcctgtttagcctctggatcaccttcagttagttactcctttgctacgtgggtccctcaggctccgaggcaagggggctgggagtgggtgctagttatcctcatttgatggaaacgacaataaatactacagagtacctcggttcgggccgtattcacatctaccaaagactaattagaacgaacacgtacttagtttctacgacaaatagaacagaccgtagagagtcgtaggacggacgaacggtcttgttagttattacgttgtttcggtttggttcgtgtacgttcggtacgggggtaacttaccgttcgaacgtccg

SEQ ID NO: 327301 - DNA, 602 bp, Homo sapiens
  misc_feature: GZ8MTXP01DJZLW.10.53.E09.1.454.CMB.2.raw
  modified_base (190)..(190): a, c, t, g, unknown or other
  misc_feature (190)..(190): n is a, c, g, or t
  modified_base (239)..(239): a, c, t, g, unknown or other
  misc_feature (239)..(239): n is a, c, g, or t
  modified_base (271)..(271): a, c, t, g, unknown or other
  misc_feature (271)..(271): n is a, c, g, or t
  modified_base (302)..(302): a, c, t, g, unknown or other
  misc_feature (302)..(302): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagctgggttttcctcgttgctcttttaagaggtgtccagtgtcaggtncagctggtggagtcgtgggggagcgtggtccagcctggggacgtccctnagactctcctgttagcctctggattcaccttnagtagttatcctttgctacgtggggtccctnaggcctccgaggcgaagggggctgggagtggggtgctagttatctacatttgatggaagaactaaataaataactaacaaggaacgtaccgtccgggttccggggacctattccaaccctatctaccaaagactaaatttagaaagaacacgtctgttactagacaaataggaaacagacctagagagcgtaggaacggacgtacggtctggtgttaattacgttggttttcggttgttcgtgttacgttcgggttacggggtaacttaccgttcagcgttacggtcgggccgtaacggg

SEQ ID NO: 327302 - DNA, 572 bp, Homo sapiens
  misc_feature: GZ8MTXP01DIV5G.10.53.E09.1.454.CMB.2.raw
  modified_base (242)..(242): a, c, t, g, unknown or other
  misc_feature (242)..(242): n is a, c, g, or t
  modified_base (344)..(344): a, c, t, g, unknown or other
  misc_feature (344)..(344): n is a, c, g, or t
  modified_base (355)..(355): a, c, t, g, unknown or other
  misc_feature (355)..(355): n is a, c, g, or t
tcagcatagtagtgcacgaccggtgctcgatttagagagagtgtgttgggtttgggggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtggagtcgtgggggagcgtggtccagccgtgggacgtccctnagactctcctgttagcctctggattcaccttcagtagttatcctttgcacgtgggtcctcaggctccgaggcgaagggggctggagtgggtgcagttatctnatttgatgganacaaataaataactacaagagaccgtccgttcggggccattcaaccatctacaaagacaaatttagaaagaacacgtcttagttcagacaaatgggaacagcctagagagctagaggactacggcttgtgtaatttacgttgtttcgtttggttctggttacgttcgggttacggggtaacttaccgttcgacgtcgacgtcggggccgtaaccggg

SEQ ID NO: 327303 - DNA, 577 bp, Homo sapiens
  misc_feature: GZ8MTXP01AH3QX.10.53.E09.1.454.CMB.2.raw
  modified_base (347)..(347): a, c, t, g, unknown or other
  misc_feature (347)..(347): n is a, c, g, or t
  modified_base (358)..(358): a, c, t, g, unknown or other
  misc_feature (358)..(358): n is a, c, g, or t
  modified_base (372)..(372): a, c, t, g, unknown or other
  misc_feature (372)..(372): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggaggcgtggtccagccgtgggacggtccctcagactctcctgtttagcctctggattcaccttcagtagttatcctttgctacgtgggtcctcaggcctccgaggcaagggggctgggagtgggtgctagttatctnatttgatgganacaataatactacngagacgtccggttcggggcctattcaccatctacaaagactaatttagaaagaacacgtctagttctagacaaatggaacagcctagacgagctaggacggacacggtctggtgttaattacgttggtttcgtttggttcgtgttacgttcgggttacgggggtaacttaccgttcgacggtcgacggtcggggccgaaccgggg

SEQ ID NO: 327304 - DNA, 585 bp, Homo sapiens
  misc_feature: GZ8MTXP01CR23W.10.53.E09.1.454.CMB.2.raw
  modified_base (250)..(250): a, c, t, g, unknown or other
  misc_feature (250)..(250): n is a, c, g, or t
  modified_base (266)..(266): a, c, t, g, unknown or other
  misc_feature (266)..(266): n is a, c, g, or t
  modified_base (276)..(276): a, c, t, g, unknown or other
  misc_feature (276)..(276): n is a, c, g, or t
  modified_base (355)..(355): a, c, t, g, unknown or other
  misc_feature (355)..(355): n is a, c, g, or t
  modified_base (370)..(370): a, c, t, g, unknown or other
  misc_feature (370)..(370): n is a, c, g, or t
  modified_base (512)..(512): a, c, t, g, unknown or other
  misc_feature (512)..(512): n is a, c, g, or t
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagcttgggttttcctcgttgcttcttttaagaggttgtccagtgtcaggtgcagctggtggagtcgtgggggagcgtggtccagcctgggacgtccctnagctctctgttagctntgatcacttnagtattatccttgctacgtgggtcctcaggcctccgagggcgaagggggcttgggaggtgggggtgctagttatccctntagtttgataggaanaactaataaactactaacgagacgaccgttcgggtcgggccgtattccactatacctacaaacgtactaattagaaacgacacgtcttgtttacgtagactaaatacgaacacgcctagagacgcgtagacggacgaacggnttgtagttagtttacgttgtttcggtttggttctcggtcgttcgggtacgggggtacttaccgtcgaacgtcg

SEQ ID NO: 327305 - DNA, 598 bp, Homo sapiens
  misc_feature: GZ8MTXP01BEJ4U.10.53.E09.1.454.CMB.2.raw
  modified_base (242)..(242): a, c, t, g, unknown or other
  misc_feature (242)..(242): n is a, c, g, or t
  modified_base (345)..(345): a, c, t, g, unknown or other
  misc_feature (345)..(345): n is a, c, g, or t
  modified_base (362)..(362): a, c, t, g, unknown or other
  misc_feature (362)..(362): n is a, c, g, or t
tcagcatagtagtgcacgaccggtgctcgatttagagagagtgtgttgggtttggggctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggagcgtggtccagcctgggagtccctnagctctcctgttacgcctctggattcacctcagtagttatccctttgcactggggtccctcaggctccgaggcgaagggggctgggagtggggtgctagttanctctatttgatgggaanactaaaataaatctacaggagtacctccgggttcggggctatccacatactacaaagactaatttagaaagaaccacgtactgtttactagactaaataggaaacacgaccgtagagtagacgtaggacggacgacgggtctggttgttagtttacgttggtttcggtttgggttccgttggttacgttcgggtacgggggtaacttaccgttcgacgtccgttaacgtccggggg

SEQ ID NO: 327306 - DNA, 563 bp, Homo sapiens
  misc_feature: GZ8MTXP01CC2BQ.10.53.E09.1.454.CMB.2.raw
  modified_base (253)..(253): a, c, t, g, unknown or other
  misc_feature (253)..(253): n is a, c, g, or t
  modified_base (268)..(268): a, c, t, g, unknown or other
  misc_feature (268)..(268): n is a, c, g, or t
  modified_base (272)..(272): a, c, t, g, unknown or other
  misc_feature (272)..(272): n is a, c, g, or t
  modified_base (374)..(374): a, c, t, g, unknown or other
  misc_feature (374)..(374): n is a, c, g, or t
  modified_base (389)..(389): a, c, t, g, unknown or other
  misc_feature (389)..(389): n is a, c, g, or t
  modified_base (426)..(426): a, c, t, g, unknown or other
  misc_feature (426)..(426): n is a, c, g, or t
  modified_base (481)..(481): a, c, t, g, unknown or other
  misc_feature (481)..(481): n is a, c, g, or t
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagcgttgggttttcctcgttgcttcttttaagaggtgtccagtgtcaggtgcagctgggtggagtcgtgggggaggcgtggtccagccgtgggacgtccctnagactctcctgttancctntgatcacttcagtagttatcctttgctacgtcgggtcctcacggcctccgaggcgaagggggtctgggagtgggtgctagttatctctatttgatcggaaanaactaataaatacanagacgtccgtcgggtcggcatacacactactacaaanactaattagaagaacacgtcttgtttacgtagtactaaatacgaacacgcagagngtgtagacggacgaacgtgttgtgttagttcgttgtttcgtttggttcgtgtacgtcgggtacgggtacttacgtcgcgtcg

SEQ ID NO: 327307 - DNA, 766 bp, Homo sapiens
  misc_feature: GZ8MTXP01CSYXC.10.53.E09.1.454.CMB.2.raw
  modified_base (243)..(243): a, c, t, g, unknown or other
  misc_feature (243)..(243): n is a, c, g, or t
  modified_base (308)..(308): a, c, t, g, unknown or other
  misc_feature (308)..(308): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagcgtgggttttcctcgttgctcttttaagaggtgtccagtgtcaggtgcagctggtggagtcgtggggggagcgtggtccagccgtgggacggtcccctnagactctcctgttacgcctctggacttcacttcagtagttatcctttgctacgtcgggtcccgtnacggcctccgaggcgaagggggctgggaggtggggtggctaggtttatcttctagttttgaacgttagggaagaacctaaaattaaactaaactaacgaaggtaacgtacccgttacccgggttcgggggaccctacttccgaaaccctaacttacctaaccgtaaaacggtaaaccttaaaagttttacggaaaacggtaaacccgtaaccgggttcctttacggttttacctaaggtaaaccctaaaaagttacgggggaaaacctacggggtacccttagggaacgacggtaccgtagggaacgggaccgtaacgggtcgttacggttagtttaacgtttcgtttcgggttttccggttttggtttacgttcgggttaccggttccggggttacgggggtaaccttacccgttcgtaacggtccggttacgggttccgggggcccgtaaccgggg

SEQ ID NO: 327308 - DNA, 588 bp, Homo sapiens
  misc_feature: GZ8MTXP01BW8AU.10.53.E09.1.454.CMB.2.raw
  modified_base (265)..(265): a, c, t, g, unknown or other
  misc_feature (265)..(265): n is a, c, g, or t
  modified_base (269)..(269): a, c, t, g, unknown or other
  misc_feature (269)..(269): n is a, c, g, or t
  modified_base (280)..(280): a, c, t, g, unknown or other
  misc_feature (280)..(280): n is a, c, g, or t
  modified_base (370)..(370): a, c, t, g, unknown or other
  misc_feature (370)..(370): n is a, c, g, or t
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggagcgtggtccagcctggggacggtccctcagactctcctgttacncctntggatcacttnagtagttatcctttgctactgggtcctcgaggctccgaggcgaagggggctgggaggtgggtgctagttactcctctatttgatggaaanaacaataaatactacagacgtacgtccggtcgggacgtattcacatcacaaagactaattagaacgaacacgtcttcgtttactagtactaaatacgaaacagcctagaagcgtcgtaggacggacgaacggtcttggtagttagttacgttggtttcggtttcggttcgtaaggtaccgttcgggtaccggggacttacccgtcgaacgtaacccgg

SEQ ID NO: 327309 - DNA, 543 bp, Homo sapiens
  misc_feature: GZ8MTXP01ALBIT.10.53.E09.1.454.CMB.2.raw
  modified_base (444)..(444): a, c, t, g, unknown or other
  misc_feature (444)..(444): n is a, c, g, or t
  modified_base (513)..(513): a, c, t, g, unknown or other
  misc_feature (513)..(513): n is a, c, g, or t
  modified_base (523)..(523): a, c, t, g, unknown or other
  misc_feature (523)..(523): n is a, c, g, or t
tcagcatagtagtgcacgaccggtgctcgatttagagagagtgtgttgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcactgggtccgtcaggctccaggcaaggggctggagtgggtggcagttatctcatttgatggagacaataaatactacagagactccgtcggggccattcaccatctccaaagacaatttgaaagaacacgcttagtttctgacaaatgaacagcctagagacgctgagacaggctgtgtatctgttcgtttggtctgacgtcgtcggggaatacttcagtcacgtgggccagggccacccgtggtcaccgtctccnctacgccctccacgaacggcccactcggtcctcccctcggccaaccctccttaccacgcgcaccttcgnggggcaacgngcgcccgtggctgccgtcgg

SEQ ID NO: 327310 - DNA, 660 bp, Homo sapiens
  misc_feature: GZ8MTXP01BSOFB.10.53.E09.1.454.CMB.2.raw
  modified_base (239)..(239): a, c, t, g, unknown or other
  misc_feature (239)..(239): n is a, c, g, or t
  modified_base (258)..(258): a, c, t, g, unknown or other
  misc_feature (258)..(258): n is a, c, g, or t
  modified_base (300)..(300): a, c, t, g, unknown or other
  misc_feature (300)..(300): n is a, c, g, or t
tcagcatagtagtgcacgaccggtgctcgatttagagagagtgtgttgggttgggggagacgagcccagcactggaagtcgccggtgtttccattcggtgatcatcactgaacacagaggactcaccatggagtttgggctgagcttgggttttcctcgttgctcttttaagaggtgtccagtgtcaggtgcagctggtggagtcgtgggggagcgtggtccagcctgggacgtccctnagactctcctgttagcctntggacttcacttcagtagttatccttgctacgtgggtccctnaggctccgaggcgaagggggctgggagtggggtgctagttatctctatttgatggaagaacaaataaactaactacaaggacgtaccttccgggttcggggacctattccaacctatacctaaccaaagtactaaatttacgaaacgaactacgtcttagttactagtacaaagtacggaaactacggtacctaggaagacgacgtaggaaacggtaccgacgggtacttaggttagttaacgttttaacgttgggttttccggtttggttaccgttacggttaccgttccggggttacgggggtaacttacccgttcgaacggtccgttacgggtccgggggttaacccgtaaccgggg

SEQ ID NO: 327311 - DNA, 590 bp, Homo sapiens
  misc_feature: GZ8MTXP01A8D0U.10.53.E09.1.454.CMB.2.raw
  modified_base (240)..(240): a, c, t, g, unknown or other
  misc_feature (240)..(240): n is a, c, g, or t
  modified_base (360)..(360): a, c, t, g, unknown or other
  misc_feature (360)..(360): n is a, c, g, or t
  modified_base (376)..(376): a, c, t, g, unknown or other
  misc_feature (376)..(376): n is a, c, g, or t
tcagcatagtagtgcacgaccggtgctcgatttagagagagtgtgttgggtttgggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggaggcgtggtccagccgtgggagtccctnagactctcctgttagcctctggattcaccttcagtagttatcctttgctacgtgggtcccgtcaggcctccgaggcgaagggggctgggagtggggtgctagttatctcatttgatgganaacaataataactacngagactcggtcgggctatcacatctacaagactaattagaagacacgcttgttctagacaaatggaacacgcctagagagcgtaggacggacgtacggtcgtggttgttaagtttacgttggtttcggttttggttcgtcggttaccgttcgggttaccgggggtaacttaccgttaacgacgtaccgttacgggtcggggcccgtaaccgggg

SEQ ID NO: 327312 - DNA, 715 bp, Homo sapiens
  misc_feature: GZ8MTXP01CT8RT.10.53.E09.1.454.CMB.2.raw
  modified_base (252)..(252): a, c, t, g, unknown or other
  misc_feature (252)..(252): n is a, c, g, or t
  modified_base (268)..(268): a, c, t, g, unknown or other
  misc_feature (268)..(268): n is a, c, g, or t
  modified_base (278)..(278): a, c, t, g, unknown or other
  misc_feature (278)..(278): n is a, c, g, or t
  modified_base (335)..(335): a, c, t, g, unknown or other
  misc_feature (335)..(335): n is a, c, g, or t
  modified_base (364)..(364): a, c, t, g, unknown or other
  misc_feature (364)..(364): n is a, c, g, or t
  modified_base (383)..(383): a, c, t, g, unknown or other
  misc_feature (383)..(383): n is a, c, g, or t
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagcgttgggttttcctcgttgcttcttttaagaggtgtccagtgtcaggtgcagctgggtggagtcgtgggggagcgtggtccagccgtgggacgtccctnagactctctgttgctntgatcacttnagtattatcttgctagtggtcctcaggcctccgaggcgagggggctggggagtgggngctagttatcctctagttgatgggaaaanaactaagtaaactactaanacgggtacgaaccgttccgggttacggggaccgtacttaccacacttacctaaaccaaagtaactaaagtttaacggaaacaaactaacgtacttacggtttactacggtaaactaaaagtacgaaaccgtacgtacccgtaggaaacggtacggtacgtaacgggaaccgggaaccggtaaccgggtgttacgggtttacgtttaaacgttttaacggtttcgggttttccgggttttcgggtttacccggttaacgggttaacccggggtttccgggggttaaccggggttaaaccgtttacccgttaaccggttaaccgggtaaccggg

SEQ ID NO: 327313 - DNA, 636 bp, Homo sapiens
  misc_feature: GZ8MTXP01DOCMC.10.53.E09.1.454.CMB.2.raw
  modified_base (241)..(241): a, c, t, g, unknown or other
  misc_feature (241)..(241): n is a, c, g, or t
  modified_base (261)..(261): a, c, t, g, unknown or other
  misc_feature (261)..(261): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtggagtcgtgggggagcgtggtccagccgtgggacgtccctnagactctcctgttacgcctntggattcaccttcagtagttatcctttgctacgtggtcccgtcaggcctccgaggcgaagggggctgggaggtggggtgctagttatctctagtttgagtaggaagaactaaattaaactaaactaacgaaggaacgtaccgttcccgggttacggggaccctattaccaacctactacctaaccaaagtaactaaatttagaaacgtaacacgtactcgttactagaacaaatacggaaacaagaccgtagagacgcgtaggacggacgtacggtacgtgttgttaatttacgttggtttcggtttggttcgtcgttacgttcgggttacggggtaactacgtcgacgtcgttacggtcggggccgtaaccggg

SEQ ID NO: 327314 - DNA, 577 bp, Homo sapiens
  misc_feature: GZ8MTXP01BUP0M.10.53.E09.1.454.CMB.2.raw
  modified_base (237)..(237): a, c, t, g, unknown or other
  misc_feature (237)..(237): n is a, c, g, or t
  modified_base (297)..(297): a, c, t, g, unknown or other
  misc_feature (297)..(297): n is a, c, g, or t
  modified_base (338)..(338): a, c, t, g, unknown or other
  misc_feature (338)..(338): n is a, c, g, or t
  modified_base (352)..(352): a, c, t, g, unknown or other
  misc_feature (352)..(352): n is a, c, g, or t
  modified_base (366)..(366): a, c, t, g, unknown or other
  misc_feature (366)..(366): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggagcgtggtccagcctgggagtccctnagctctcctgttagcctctggattcaccttcagtagttatcctttgctacgtgggtcctnaggctccgaggcgaagggggctgggagtgggtgctagttanctcatttgatgganacaataatactacngagaccgtccggttcggggcctattccacctatctaccaaagactaatttagaaacgaactacgtctagttctagacaaataggaactagcctagagagcgtaggacggacgacggtctgtgtaatttacgttgtttcgtttggttctcggttacgttcgggttacggggtaacttaccgttcgacgcgttacggtcggggccgtaacggg

SEQ ID NO: 327315 - DNA, 630 bp, Homo sapiens
  misc_feature: GZ8MTXP01DWPNJ.10.53.E09.1.454.CMB.2.raw
  modified_base (249)..(249): a, c, t, g, unknown or other
  misc_feature (249)..(249): n is a, c, g, or t
  modified_base (267)..(267): a, c, t, g, unknown or other
  misc_feature (267)..(267): n is a, c, g, or t
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagctgggttttcctcgttgcttcttttaagaggtgtccagtgtcaggtgcagctggtggagtcgtgggggagcgtggtccagccgtgggacgtccctnagactctctgttagcctntggatcacttcagtagttatcctttgctacgtgggtccctcgaggcctccgaggcgaagggggtctgggaggtgggtggctaggttatcctctagtttggatgggaaaagaactaagtaaaactacgtaaacaggtacgtacgttccgggttacggggcctagttaccacactcctaaccaaagtaactaaatttagaaacgtaaacacgtacttacgtttacgtagtaactaaattacgaaactagtacgtaggaagagtccgtaggacggacgaacgggtcttggttagttagtttacgttggtttcggtttggttcgtggtacgttcgggtacggggtacttaccgttcgaacgtaaccg

SEQ ID NO: 327316 - DNA, 580 bp, Homo sapiens
  misc_feature: GZ8MTXP01AE6HJ.10.53.E09.1.454.CMB.2.raw
  modified_base (242)..(242): a, c, t, g, unknown or other
  misc_feature (242)..(242): n is a, c, g, or t
  modified_base (271)..(271): a, c, t, g, unknown or other
  misc_feature (271)..(271): n is a, c, g, or t
  modified_base (342)..(342): a, c, t, g, unknown or other
  misc_feature (342)..(342): n is a, c, g, or t
  modified_base (356)..(356): a, c, t, g, unknown or other
  misc_feature (356)..(356): n is a, c, g, or t
tcagcatagtagtgcacgaccggtgctcgatttagagagagtgtgttgggtttggggctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggagcgtggtccagcctgggagtccctnagctctcctgttagcctctggattcactnagtagttatcctttgcactgggtcctcgaggcctccgaggcgaagggggctgggagtggggtgctagttanctcatttgatgganactaaaataatctacagagactccggttcggggcctatcactatctaccaaagacaattagaagaacacgtcttagttcagacaaatgaacagcctagagagtaccgtggaaggaccgacgggtctggtcgttatttaccgttggtttccggtttgggttcgttgggttaccgtcgggggttacggggtaacttcccgttacgacggtcgaacgggtccggggg

SEQ ID NO: 327317 - DNA, 643 bp, Homo sapiens
  misc_feature: GZ8MTXP01C03OO.10.53.E09.1.454.CMB.2.raw
  modified_base (252)..(252): a, c, t, g, unknown or other
  misc_feature (252)..(252): n is a, c, g, or t
  modified_base (329)..(329): a, c, t, g, unknown or other
  misc_feature (329)..(329): n is a, c, g, or t
tcagcatagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctgcctgtgtctcgtgggcgagacgggccacatcaactgacaagtccagccagtagttgtttatcagctaccganaaataagaactactagctggtaaccagacaagaaacaggaacacgccctacctaagctgccttactaacttttacgngggtaccacgttacccgtaaccccggggtaacgttcccccccgggggtccccacggtaccgtactttccggaaagggttcgggaaccgtacgggtccgggggttactagggggaaccaggttactttaccaccttctaccaccataccagcacgcctcgacgaggctagaagaggtcggcggtacttagtttaactacgtgtacaacgtctaacttaacttaactaacctaacccctattcctacgttacgttaccggccgttaacgggaccttaaaggtgaagaactaacgaacgttaacgtcgttcggaacc

SEQ ID NO: 327318 - DNA, 551 bp, Homo sapiens
  misc_feature: GZ8MTXP01BRP2V.10.53.E09.1.454.CMB.2.raw
  modified_base (244)..(244): a, c, t, g, unknown or other
  misc_feature (244)..(244): n is a, c, g, or t
  modified_base (343)..(343): a, c, t, g, unknown or other
  misc_feature (343)..(343): n is a, c, g, or t
  modified_base (346)..(346): a, c, t, g, unknown or other
  misc_feature (346)..(346): n is a, c, g, or t
  modified_base (357)..(357): a, c, t, g, unknown or other
  misc_feature (357)..(357): n is a, c, g, or t
  modified_base (371)..(371): a, c, t, g, unknown or other
  misc_feature (371)..(371): n is a, c, g, or t
  modified_base (413)..(413): a, c, t, g, unknown or other
  misc_feature (413)..(413): n is a, c, g, or t
  modified_base (462)..(462): a, c, t, g, unknown or other
  misc_feature (462)..(462): n is a, c, g, or t
tcagcatagtagtgcacgaccggtgctcgatttagagagagtgtgttgggtttggggctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggagcgtggtccagccaggggacgtccctnagtactctcctgtttagcctctggattcacctcagtagttatcctttgcacgtgggtcctcaggctcgaggcgaaggggctggagtgggtgctagttanctntattgatgganacaaaataaatcanagagactccggtgggcatcacatcacaagactaattagaaanacacgctcgttactagacaaatgaacgagtcgtgagagcgtagaggacncggctgtcgttattacgttgtttcgtttggttcgttcggttaccgttcgggtacggggtaacttccgttcgacgtccgaacggtcgggg

SEQ ID NO: 327319 - DNA, 558 bp, Homo sapiens
  misc_feature: GZ8MTXP01B6UI2.10.53.E09.1.454.CMB.2.raw
  modified_base (488)..(488): a, c, t, g, unknown or other
  misc_feature (488)..(488): n is a, c, g, or t
tcagcatagtagtgcacgaccggtgctcgatttagagagagtgtgttgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcactgggtccgtcaggctccaggcaaggggctggagtgggtggcagttatctcatttgatggagacaataaatactacagagactcgtcgggccattcacatctccaaagacaatttgaagaacacgctgtttctgcaaatgaacagcctgagagctgagacacggctgtgtattacgtgtttcgttgttctgtactcggtcggggaatacttcgagcgacgtggggccacgggcacccgtggtcaccgtctcctcacgcctccaccgaacggcccatccggtccttcccccgtcggcccncccctccttccaacgcgccacccgttcgttcgggggccaacgcgccggccctgggcctcgccgtaacggg

SEQ ID NO: 327320 - DNA, 589 bp, Homo sapiens
  misc_feature: GZ8MTXP01AI6MB.10.53.E09.1.454.CMB.2.raw
  modified_base (237)..(237): a, c, t, g, unknown or other
  misc_feature (237)..(237): n is a, c, g, or t
  modified_base (345)..(345): a, c, t, g, unknown or other
  misc_feature (345)..(345): n is a, c, g, or t
  modified_base (475)..(475): a, c, t, g, unknown or other
  misc_feature (475)..(475): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagctgggttttcctcgttgctctttaagaggtgtccagtgtcaggtgcagctggtggagtcgtgggggagcgtggtccagcctgggacgtccctnagactctcctgttacgcctctggattcaccttcagtagttatcctttgcacgtgggtcctcgaggcctccgaggcgaagggggctgggagtggggtgctagttatctntatttgatggagtacaaataaatactacgaagacgtaccgttccgggtacggggcctagttccacctatcctacaaagtactaattagaaacacacgtctagttcagactaaatggaaacagcctagagngcgtggacgacgtacggtctggtgttaattacgttggtttcgtttggttcgtcggttacgttcgggttacggggtaacttccgttaacgagtcgacgtcggggccgtaaccggg

SEQ ID NO: 327321 - DNA, 771 bp, Homo sapiens
  misc_feature: GZ8MTXP01C9HQ7.10.53.E09.1.454.CMB.2.raw
  modified_base (251)..(251): a, c, t, g, unknown or other
  misc_feature (251)..(251): n is a, c, g, or t
  modified_base (368)..(368): a, c, t, g, unknown or other
  misc_feature (368)..(368): n is a, c, g, or t
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctgggtggagtcgtgggggagcgtggtccagccgtgggacgtccctnagactctccttgttacgcctgtggtactcaccttcagttagttactcctttgctacgtgggtcctcaggcctccgaggcgaagggggtctaggggagtgggtgactagttatccctntatttgacgtaggaaataaactaaattaaaatacctaaagacggaaacgtcccgttccgggttaccgggggacctacgttaccaaccctaataccttaacccgaaaaacgtaacctaaagtttaacgggaaaactaaaccgtaacgtacgtttacggttttacctaacggtaaaccgtaaaattaacggaaaactaccgaacccgtaggaaacggtacggtacccgtaagggtaaccgggaaaccgtaaacccgggttcgttaggggtttaagtttaaccgttttaacggtttcgggtttttacgggtttttcgggttcccggtttaacgggtaacccgggtttaacgggggttaacccgggggttaaactttaccccggtttaacggaacgttaacccgggg

SEQ ID NO: 327322 - DNA, 692 bp, Homo sapiens
  misc_feature: GZ8MTXP01D23T1.10.53.E09.1.454.CMB.2.raw
  modified_base (241)..(241): a, c, t, g, unknown or other
  misc_feature (241)..(241): n is a, c, g, or t
  modified_base (260)..(260): a, c, t, g, unknown or other
  misc_feature (260)..(260): n is a, c, g, or t
  modified_base (348)..(348): a, c, t, g, unknown or other
  misc_feature (348)..(348): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagcttgggttttcctcgttgctcttttaagaggtgtccagtgtcaggtgcagctggtggagtcgtgggggaggcgtggtccagccgtgggaggtccctnagactctcctgttagcctntggattcaccttcagtagttatccctttgctacgtgggtcccgtcaggctccgaggcgaaggggctggagtggggtgctagttatctnagtttgagtggagaactaaataaataactacaaggacgtaccgttcccgggttcggggacctaagttccaaccctatacctaaccaaaagtactaaatttaggaaaacgtaactaacgtcttagtttaccgtagaaacctaaaagttacgggaaaactacggtaccctaggaaagaacgccgttaagggaaacggaaccgtaacgggtcttagggttcggttaaacttttaaccgttgggtttttaccggttttggttccgttagggttacccgtttggggttaccgggggttaaacttaccgttcgaacgggtacgaccgggttcgggggccgtaacccgggg

SEQ ID NO: 327323 - DNA, 554 bp, Homo sapiens
  misc_feature: GZ8MTXP01BL1JF.10.53.E09.1.454.CMB.2.raw
  modified_base (238)..(238): a, c, t, g, unknown or other
  misc_feature (238)..(238): n is a, c, g, or t
  modified_base (256)..(256): a, c, t, g, unknown or other
  misc_feature (256)..(256): n is a, c, g, or t
  modified_base (296)..(296): a, c, t, g, unknown or other
  misc_feature (296)..(296): n is a, c, g, or t
  modified_base (335)..(335): a, c, t, g, unknown or other
  misc_feature (335)..(335): n is a, c, g, or t
  modified_base (338)..(338): a, c, t, g, unknown or other
  misc_feature (338)..(338): n is a, c, g, or t
  modified_base (349)..(349): a, c, t, g, unknown or other
  misc_feature (349)..(349): n is a, c, g, or t
  modified_base (364)..(364): a, c, t, g, unknown or other
  misc_feature (364)..(364): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagctgggttttcctcgttgcttcttttaagaggtgtccagtgtcaggtgcagctggtggagtcgtgggggagcgtggtccagcctgggagtccctnagctctcctgttagcctnggattcaccttcagtagttatcctttgcacgtgggtcctnaggctccaggcaagggggctgggagtgggtgctagttanctnatttgatgganacaataaatactacngagactcggttcggggccattcaccatctaccaaagactaattagaagaaacacgtctgttctagacaaataggaacagcctagagagcgtaggaggacgacggcgtgtgtaattacgttgtttcgtttggttcgtgacgttcggttacgggggtaacttaccgttcgacgcgacgtcgggccgaacggg

SEQ ID NO: 327324 - DNA, 555 bp, Homo sapiens
  misc_feature: GZ8MTXP01DS89E.10.53.E09.1.454.CMB.2.raw
  modified_base (252)..(252): a, c, t, g, unknown or other
  misc_feature (252)..(252): n is a, c, g, or t
  modified_base (359)..(359): a, c, t, g, unknown or other
  misc_feature (359)..(359): n is a, c, g, or t
  modified_base (371)..(371): a, c, t, g, unknown or other
  misc_feature (371)..(371): n is a, c, g, or t
  modified_base (491)..(491): a, c, t, g, unknown or other
  misc_feature (491)..(491): n is a, c, g, or t
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagcgtgggttttcctcgttgcttcttttaagaggtgtccagtgtcaggtgcagctgggtggagtcgtgggggagcgtggtccagccgtggggacgtccctnagactctcctgtttacgcctctggatcaccttcagtagttatcctttgctacgtgggtccctcaggctccgaggcgaagggggctgggagtgggtgcagttatcctntattgatggaanaacaataaatactacagacgacgtcggtcgggactattcacatcacaaagtactaattagaacacacgtcttgttctagtacaaatacgaacagcctgacgagctaggagacgaacggtnttgtgttattacgttgttcgttgttctgtacgttcggtacggggacttaccgttcgcgtaacgg

SEQ ID NO: 327325 - DNA, 588 bp, Homo sapiens
  misc_feature: GZ8MTXP01DDVW7.10.53.E09.1.454.CMB.2.raw
  modified_base (247)..(247): a, c, t, g, unknown or other
  misc_feature (247)..(247): n is a, c, g, or t
  modified_base (262)..(262): a, c, t, g, unknown or other
  misc_feature (262)..(262): n is a, c, g, or t
  modified_base (276)..(276): a, c, t, g, unknown or other
  misc_feature (276)..(276): n is a, c, g, or t
  modified_base (306)..(306): a, c, t, g, unknown or other
  misc_feature (306)..(306): n is a, c, g, or t
  modified_base (342)..(342): a, c, t, g, unknown or other
  misc_feature (342)..(342): n is a, c, g, or t
  modified_base (357)..(357): a, c, t, g, unknown or other
  misc_feature (357)..(357): n is a, c, g, or t
  modified_base (375)..(375): a, c, t, g, unknown or other
  misc_feature (375)..(375): n is a, c, g, or t
  modified_base (441)..(441): a, c, t, g, unknown or other
  misc_feature (441)..(441): n is a, c, g, or t
  modified_base (507)..(507): a, c, t, g, unknown or other
  misc_feature (507)..(507): n is a, c, g, or t
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagctgggttttcctcgttgctctttaagaggtgtccagtgtcaggtgcagctggtggagtcgtgggggagcgtggtccagcctggggacgtccctnagactctctgttacncctctgatcacttnagtattactcctttgctacgtgggtccctnaggcctccgaggcgaagggggcttgggagtgggggngctagttactccgtntagtttggaatgggaaanaactaataaatactaacagacgtaccgtcggttcgggctatcacatctacaaagactaattagaanacacgcttagtttcagtaactaaagtagaaactgacctagaacgagctaggacggtacgaacggtnttagttgttatttacgttgtttcgtttgggttacctggtacgttcgggtacggggtaacttaccgttaacgaacgtaaccg

SEQ ID NO: 327326 - DNA, 579 bp, Homo sapiens
  misc_feature: GZ8MTXP01D00JD.10.53.E09.1.454.CMB.2.raw
  modified_base (240)..(240): a, c, t, g, unknown or other
  misc_feature (240)..(240): n is a, c, g, or t
  modified_base (307)..(307): a, c, t, g, unknown or other
  misc_feature (307)..(307): n is a, c, g, or t
  modified_base (350)..(350): a, c, t, g, unknown or other
  misc_feature (350)..(350): n is a, c, g, or t
  modified_base (361)..(361): a, c, t, g, unknown or other
  misc_feature (361)..(361): n is a, c, g, or t
  modified_base (370)..(370): a, c, t, g, unknown or other
  misc_feature (370)..(370): n is a, c, g, or t
  modified_base (376)..(376): a, c, t, g, unknown or other
  misc_feature (376)..(376): n is a, c, g, or t
  modified_base (379)..(379): a, c, t, g, unknown or other
  misc_feature (379)..(379): n is a, c, g, or t
  modified_base (478)..(478): a, c, t, g, unknown or other
  misc_feature (478)..(478): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtggagtcgtgggggagcgtggtccagcctgggacgtccctnagactctcctgtttacgccttcgtggacttccaccttcagtagttatcctttgctacgtgggtcctnaggcctccgaggcaagggggctggagtgggtgctagttatctnatttgatgganacaataaanactacnganactccggtcgggccattcacatctacaagactaattagaaagaacacgtctgttcagacaatagaaacagcctagagagcgtagaacggacgtaccggntaggttagttaactttacgttgtttcggtttggttcgtgttacgttcgggttacgggggtaacttaccgttcgaaggtccgacggtcggggccgaaccggg

SEQ ID NO: 327327 - DNA, 559 bp, Homo sapiens
  misc_feature: GZ8MTXP01AR2UL.10.53.E09.1.454.CMB.2.raw
  modified_base (271)..(271): a, c, t, g, unknown or other
  misc_feature (271)..(271): n is a, c, g, or t
  modified_base (346)..(346): a, c, t, g, unknown or other
  misc_feature (346)..(346): n is a, c, g, or t
  modified_base (357)..(357): a, c, t, g, unknown or other
  misc_feature (357)..(357): n is a, c, g, or t
  modified_base (479)..(479): a, c, t, g, unknown or other
  misc_feature (479)..(479): n is a, c, g, or t
tcagcatagtagtgcacgaccggtgctcgatttagagagagtgtgttgggtttgggggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtggagtcgtgggggagcgtggtccagcctgggagtccctcagctctcctgttagcctctggattcaccttnagtagttatcctttgcctacgtgggtcctcaggctccgaggcgaagggggctggagtggggtgctagttatcgtnatttgatgganaacaaataaataacacaagacgactccggtcggggcctattcaaccactctaccaaagacaattagaagaacacgctagttctagacaaataggaacagcctagagagcgtgaggacacggntgtgtaattacttgttcgtttgttcgtgttacgttcggttacggggtaactaccgttcgagcgacgtcggggcgaacggg

SEQ ID NO: 327328 - DNA, 692 bp, Homo sapiens
  misc_feature: GZ8MTXP01EPPVG.10.53.E09.1.454.CMB.2.raw
  modified_base (195)..(195): a, c, t, g, unknown or other
  misc_feature (195)..(195): n is a, c, g, or t
  modified_base (245)..(245): a, c, t, g, unknown or other
  misc_feature (245)..(245): n is a, c, g, or t
  modified_base (260)..(260): a, c, t, g, unknown or other
  misc_feature (260)..(260): n is a, c, g, or t
  modified_base (264)..(264): a, c, t, g, unknown or other
  misc_feature (264)..(264): n is a, c, g, or t
  modified_base (372)..(372): a, c, t, g, unknown or other
  misc_feature (372)..(372): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagcttggggtttttcctcgttgcttcttttaaagaggtgtccagtgtcaggtncagctggtggagtcgtgggggagcgtggtccagccgtggggacgtccctnagctctcctgttacncctntggacttcacttcagtattactccctttgcctacgtcgggtcctcacggcctccgaggcgaagggggctagggaggtgggtgctagttatctctatttgaagtggaanaactaaaataaactaactaacaaggtacgtaaccgttcccgggttacgggggacctattccaacctatacctaacaaaacgtaactaaagtttaagaaacgaaactacgtacttacgttacctagtaactaaaagtacggaaactacgacctagaacgagcgtaggaacggaccgtaacggtcttaggtagttaacgtttaccgtttggtttaccggtttggttccgtacggttaccggttcggggttaacccgggggtaaactttacccgtaacgtacggacgttaaccggggttccgggggaacccgtaacccggggg

SEQ ID NO: 327329 - DNA, 607 bp, Homo sapiens
  misc_feature: GZ8MTXP01AG97I.10.53.E09.1.454.CMB.2.raw
  modified_base (250)..(250): a, c, t, g, unknown or other
  misc_feature (250)..(250): n is a, c, g, or t
  modified_base (268)..(268): a, c, t, g, unknown or other
  misc_feature (268)..(268): n is a, c, g, or t
  modified_base (279)..(279): a, c, t, g, unknown or other
  misc_feature (279)..(279): n is a, c, g, or t
  modified_base (305)..(305): a, c, t, g, unknown or other
  misc_feature (305)..(305): n is a, c, g, or t
  modified_base (339)..(339): a, c, t, g, unknown or other
  misc_feature (339)..(339): n is a, c, g, or t
  modified_base (363)..(363): a, c, t, g, unknown or other
  misc_feature (363)..(363): n is a, c, g, or t
  modified_base (488)..(488): a, c, t, g, unknown or other
  misc_feature (488)..(488): n is a, c, g, or t
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagctgggttttcctcgttgcttcttttaagaggtgtccagtgtcaggtgcagctgggtggagtcgtgggggaggcgtggtccagccgtgggagtccctnagctctcctgttagcctntggatcacttnagtattatccttgcacgtgggtcctnaggcctcgaggcgtaagggggttgaggttggggngctaggttatctcatttgatgganaaacaaattaatactaacagtacgaccttccgggtacggggcccgtattccaccatacctacaaagactaattagaacgaacacgtctgtttcaggtacaaagtgaaccgagtccgtagagacgngtaggacggaccgacggtctggttagttacgtttaccgttggtttcgttttacgggttcttcggttaaccgtcgggtaacgggggtaaacttacccgttagaaccgttcgtaaccgggg

SEQ ID NO: 327330 - DNA, 822 bp, Homo sapiens
  misc_feature: GZ8MTXP01CYKKQ.10.53.E09.1.454.CMB.2.raw
  modified_base (243)..(243): a, c, t, g, unknown or other
  misc_feature (243)..(243): n is a, c, g, or t
  modified_base (277)..(277): a, c, t, g, unknown or other
  misc_feature (277)..(277): n is a, c, g, or t
  modified_base (398)..(398): a, c, t, g, unknown or other
  misc_feature (398)..(398): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtggagtcgtgggggagcgtggtccagccgtggggacggtccctnagactctcctgtttagccctctggattcaccttnagtagttactcctttgctacgtcgggtcccgtcaggcctccgagggccgaaaggggggctagggggaggttgggggtgggctaggtttactcttacgtagttttggaacttagggggaaanaacctaaaaattaaaacttaaacccgttaaacgaagggtaaaccggtaacccgtttccccgggggtttaccggggggacccctaactttacccgaaaccctaacttaccgtaaaccctaaaaacggtaaacctaaaagttttaacggaaaacgtaaacccgtaacgtaccgtttacgtttaccgtacggtaaactaaaacgttaacggaaacgaacgtacccgttaaggaacggaacggaccgttaagggaaacggggaaccgtaaccggggtcgttaggtttacggtttaaacgttttaccggtttgggtttttccgggtttagggttttcgtacggttaccggttccggggttaccgggggtaaactttacccgttaacgacggtaccggttaccggttcgggggaacccggtaacccgggg

SEQ ID NO: 327331 - DNA, 706 bp, Homo sapiens
  misc_feature: GZ8MTXP01AKJSS.10.53.E09.1.454.CMB.2.raw
  modified_base (175)..(175): a, c, t, g, unknown or other
  misc_feature (175)..(175): n is a, c, g, or t
  modified_base (242)..(242): a, c, t, g, unknown or other
  misc_feature (242)..(242): n is a, c, g, or t
  modified_base (254)..(254): a, c, t, g, unknown or other
  misc_feature (254)..(254): n is a, c, g, or t
  modified_base (257)..(257): a, c, t, g, unknown or other
  misc_feature (257)..(257): n is a, c, g, or t
  modified_base (268)..(268): a, c, t, g, unknown or other
  misc_feature (268)..(268): n is a, c, g, or t
  modified_base (350)..(350): a, c, t, g, unknown or other
  misc_feature (350)..(350): n is a, c, g, or t
  modified_base (369)..(369): a, c, t, g, unknown or other
  misc_feature (369)..(369): n is a, c, g, or t
tcagcatagtagtgcacgaccggtgctcgatttagagagagtgtgttgggtttgggggagacgagcccagcactggaagtcgccggtgtttccattcggtgatcatcactgaacacagaggactcaccatggagtttgggctgagcttgggttttcctcgttgcttcttttaagnggtgtccagtgtcaggtgcagctggtggagtcgtgggggagcgtggtccagccgtgggacgtccctnagctctctgttnctntgattcacttnagtagttatcctttgctacgtgggtccgtcaggcctccgagggccgaagggggtctgggaggtggggtgctagtttatcctntagtttgacgttagggaanaactaaataaaatacctaagaagacgtacccgttcccgggttacgggggacctaattccaacctactacctaaccaaacgtaactaaatttaacgaaacgaaactacgtacgttcgtttactacggtaactaaagtacggaaacgaacggtaccgtaggaacgagaccgtaggtaacgggaacgtaaccgggtcgttaggttaggttaacgttttacggtttacggttttcggttttcgggtttaccgttcggttaccggttaccggggttaccgggggtaaactttacccgtcgtaacgggtccggttaccggtccgggggaaccgtaacccgggg

SEQ ID NO: 327332 - DNA, 641 bp, Homo sapiens
  misc_feature: GZ8MTXP01EF9Y2.10.53.E09.1.454.CMB.2.raw
  modified_base (243)..(243): a, c, t, g, unknown or other
  misc_feature (243)..(243): n is a, c, g, or t
  modified_base (271)..(271): a, c, t, g, unknown or other
  misc_feature (271)..(271): n is a, c, g, or t
  modified_base (357)..(357): a, c, t, g, unknown or other
  misc_feature (357)..(357): n is a, c, g, or t
tcagcatagtagtgcacgaccggtgctcgatttagagagagtgtgttgggtttggggctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtggggggagcgtggtccagcctgggagtccctnagctctcctgttagctctggattcactnagtagttatcctttgctacgtgggtcctcacggctccgaggcgaagggggctgggagtgggtggctagttatctctattgatgganaactaaaaataaactctaacagacgtacctccgggttacggggcctatcactatactacaaagaactaaagttagaaacgaacacgtaccttagtttactacggtactaaacgtagaaacacgaccgtaggaagagacgtaggtaacggaaccgacggtcgtggttaagttacgtttaaccgtttggtttccggttttgggtttcgttcggttaccggttccgggttaacgggggtaaccttacccgttaccgacgtaacccggttaacgggttaacccggggg

SEQ ID NO: 327333 - DNA, 546 bp, Homo sapiens
  misc_feature: GZ8MTXP01E0UJP.10.53.E09.1.454.CMB.2.raw
  modified_base (239)..(239): a, c, t, g, unknown or other
  misc_feature (239)..(239): n is a, c, g, or t
  modified_base (257)..(257): a, c, t, g, unknown or other
  misc_feature (257)..(257): n is a, c, g, or t
  modified_base (353)..(353): a, c, t, g, unknown or other
  misc_feature (353)..(353): n is a, c, g, or t
  modified_base (370)..(370): a, c, t, g, unknown or other
  misc_feature (370)..(370): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtggagtcgtgggggagcgtggtccagcctgggagtccctnagctctcctgttagcctntggattcaccttcagtagttatcctttgcacgtgggtccgtcaggctccgaggcaagggggctgggagtggggtgcagttatctcatttgatgganaacaaataataactacngagactccggttcggggcctattcaccatctaccaaagacaattgaaagaacacgctgttctgacaaatggaacagcctgagagctgaggacacggctgtgtaattacttgttcgtttgttcgtgacgttcggttcgggggtaactaccttcgacgcacgtcggggccgaacgggg

SEQ ID NO: 327334 - DNA, 578 bp, Homo sapiens
  misc_feature: GZ8MTXP01AJTNZ.10.53.E09.1.454.CMB.2.raw
  modified_base (248)..(248): a, c, t, g, unknown or other
  misc_feature (248)..(248): n is a, c, g, or t
  modified_base (388)..(388): a, c, t, g, unknown or other
  misc_feature (388)..(388): n is a, c, g, or t
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggagcgtggtccaggcctgggacgtccctnagactctcctgttacgcctctggatcacttcagtagttactcctttgctacgtgggtcctcgacggctccgaggcgaagggggctgggaggtggggtgctagttactcctcagtttgatggaaagactaataaatcctanagacgactccggttcgggcgtatcacactctacaaagactaacttagaacaacacgtacttgtttctacgtacaaatacgaacagcgtagacgagtctaggacgacgaacggcgttgtcgttagttacgttggtttcggtttggttcgtggtacgttcggtacgggggtacttaccgttcgaaggtcccg

SEQ ID NO: 327335 - DNA, 720 bp, Homo sapiens
  misc_feature: GZ8MTXP01BX69P.10.53.E09.1.454.CMB.2.raw
  modified_base (340)..(340): a, c, t, g, unknown or other
  misc_feature (340)..(340): n is a, c, g, or t
tcagcatagtagtgcacgaccggtgctcgatttagagagagtgtgttgggtttgggggagctacaacaggcaggcaggggcagcaagatggtgttgcagacccaggtcttcatttctctgttgctctggatctctggtgccgtacggggacatcgtgatgacccagtctccagacctccctgcctgtcgtctcgtggggcgaggacgggcccaaccatacaactgacaagtccagccagtagttgtttatcagcctaccgaacaaataacgtaactacttagcttaggaccagacaaacgaaaccaggacacgcctacctaagctagctactatttacgngggactaacgtccggtaacccggggaacgttccccccgggggtaccctaggaacccgtacgttccgaaagggtcgggcgtacggggtccggggttcgtaggggaacctaggtacttttccaccttccaccaccatccagaccgacgcccgtgacgacggactaaggtaaacggcggttacgggaccggttacttaacggttttaacttaccgttacggttaccaaacgtacctaaacgtttaaactttacgttaaacccgttaacccctacttacctaaaccgttaccgtttccccggggacccgttaaacgggggaacccgttaaaaggttcggaaacgtaacgtaacgtaaaacggttaccgtggttaacgggtaacc

SEQ ID NO: 327336 - DNA, 590 bp, Homo sapiens
  misc_feature: GZ8MTXP01B0R2C.10.53.E09.1.454.CMB.2.raw
  modified_base (240)..(240): a, c, t, g, unknown or other
  misc_feature (240)..(240): n is a, c, g, or t
  modified_base (259)..(259): a, c, t, g, unknown or other
  misc_feature (259)..(259): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagcttgggttttcctcgttgctcttttaagaggtgtccagtgtcaggtgcagctggtggagtcgtgggggagcgtggtccagccgtgggacgtccctnagactctcctgttagcctntggattcaccttcagtagttactcctttgctacgtcgggtcctcaggctccgaggcaagggggctggagtgggtgctagttatctcagtttgacgtggaagaacaaataaataactaacaagacgtaccgtccgggttcggggacctattccgaacctactactaccaaagactaagttagaaacgaacacgtcttagttactagacaaatacgaacacgcctagagagcgtagacggactacggtctgttgtaattacgttgtttcgtttggttctcgttacgttcggttacggggtaataccgtcgacgcgacggtcgggcgtaacggg

SEQ ID NO: 327337 - DNA, 571 bp, Homo sapiens
  misc_feature: GZ8MTXP01AVOYV.10.53.E09.1.454.CMB.2.raw
  modified_base (182)..(182): a, c, t, g, unknown or other
  misc_feature (182)..(182): n is a, c, g, or t
  modified_base (248)..(248): a, c, t, g, unknown or other
  misc_feature (248)..(248): n is a, c, g, or t
  modified_base (344)..(344): a, c, t, g, unknown or other
  misc_feature (344)..(344): n is a, c, g, or t
  modified_base (352)..(352): a, c, t, g, unknown or other
  misc_feature (352)..(352): n is a, c, g, or t
  modified_base (356)..(356): a, c, t, g, unknown or other
  misc_feature (356)..(356): n is a, c, g, or t
  modified_base (369)..(369): a, c, t, g, unknown or other
  misc_feature (369)..(369): n is a, c, g, or t
  modified_base (498)..(498): a, c, t, g, unknown or other
  misc_feature (498)..(498): n is a, c, g, or t
  modified_base (564)..(564): a, c, t, g, unknown or other
  misc_feature (564)..(564): n is a, c, g, or t
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagctgggttttcctcgttgcttcttttaagnggtgtccagtgtcaggtgcagctgggtggagtcgtgggggagcgtggtccagcctgggagtccctnagactctcctgtttacgcctctggatcaccttcagttagttatcctttgctacgtgggtcctcagggctccgaggcgaagggggctgggagtgggngcagttancctnatttgatggaaanacaataaatactacagtacgactccgggttcgggaccgtattccacatcctacaaagactaattagaaagaacacgacttgttctagactaaatacgaacagctaggaagacgcgtagaggacaacggnttgtagttatttacgtgtttcgtttggttcctgtacgttcgggtacggggtaacttccgttaacgngtaaccg

SEQ ID NO: 327338 - DNA, 597 bp, Homo sapiens
  misc_feature: GZ8MTXP01EJ0NL.10.53.E09.1.454.CMB.2.raw
  modified_base (252)..(252): a, c, t, g, unknown or other
  misc_feature (252)..(252): n is a, c, g, or t
  modified_base (281)..(281): a, c, t, g, unknown or other
  misc_feature (281)..(281): n is a, c, g, or t
  modified_base (379)..(379): a, c, t, g, unknown or other
  misc_feature (379)..(379): n is a, c, g, or t
  modified_base (524)..(524): a, c, t, g, unknown or other
  misc_feature (524)..(524): n is a, c, g, or t
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagcttggggtttttcctcgttgcttcttttaagaggtgtccagtgtcaggtgcagctggtggagtcgtgggggagcgtggtccagccgtgggacgtccctnagctctcctgttagcctctggatcacttnagtagttactcctttgctacgtgggtcctcgaggcctccgaggcgaagggggctgggaggtggggtgactagttactcctactagtttgatggaaaanaacaagttaaactacgtacaaggtacgtacgtccgggttacggggcctattaccacatactacaaagactaattagaaagaacacgtcttgtttacgagtacaaatagaacagccgtagaagagtcgtagacggacgtaacggtnttgtagttacttacgttgtttcggtttggttcgtgtacgttcgggtacggggtaacttaccgtcgaaggtccg

SEQ ID NO: 327339 - DNA, 643 bp, Homo sapiens
  misc_feature: GZ8MTXP01ECO0Y.10.53.E09.1.454.CMB.2.raw
  modified_base (246)..(246): a, c, t, g, unknown or other
  misc_feature (246)..(246): n is a, c, g, or t
  modified_base (259)..(259): a, c, t, g, unknown or other
  misc_feature (259)..(259): n is a, c, g, or t
  modified_base (263)..(263): a, c, t, g, unknown or other
  misc_feature (263)..(263): n is a, c, g, or t
  modified_base (356)..(356): a, c, t, g, unknown or other
  misc_feature (356)..(356): n is a, c, g, or t
  modified_base (371)..(371): a, c, t, g, unknown or other
  misc_feature (371)..(371): n is a, c, g, or t
  modified_base (390)..(390): a, c, t, g, unknown or other
  misc_feature (390)..(390): n is a, c, g, or t
  modified_base (504)..(504): a, c, t, g, unknown or other
  misc_feature (504)..(504): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagcttggggtttttcctcgttgcttcttttaaaggaggtgtccagtgtcaggtgcagctggtggagtcgtgggggagcggtggtccagccgtgggacgtccctnagctctctgttancctntgatcacttcagtattatcctttgctacgtcggggtccctcgacggtcctaccgaggcgaagggggtctgggaggtggggtgctagttatctntagtttgactggaanaacaaataaataactaacnggtacgtaccgttccgggttacggggacctattccaacctatacctaacaaagtactaaagttagaaactactacgtcttgttcagaactaaagtcggaaactagcctaggagngcgtaggaacggacgtacggtcttagttgttaactttcggttggttttccggttttggtcgtacggttaccggttcggggttacggggtaacttacccgtaagacggtcgttaccgggtcgggggcccgtaaccggggg

SEQ ID NO: 327340 - DNA, 638 bp, Homo sapiens
  misc_feature: GZ8MTXP01CAEO7.10.53.E09.1.454.CMB.2.raw
  modified_base (242)..(242): a, c, t, g, unknown or other
  misc_feature (242)..(242): n is a, c, g, or t
  modified_base (257)..(257): a, c, t, g, unknown or other
  misc_feature (257)..(257): n is a, c, g, or t
  modified_base (261)..(261): a, c, t, g, unknown or other
  misc_feature (261)..(261): n is a, c, g, or t
  modified_base (278)..(278): a, c, t, g, unknown or other
  misc_feature (278)..(278): n is a, c, g, or t
  modified_base (342)..(342): a, c, t, g, unknown or other
  misc_feature (342)..(342): n is a, c, g, or t
  modified_base (358)..(358): a, c, t, g, unknown or other
  misc_feature (358)..(358): n is a, c, g, or t
  modified_base (376)..(376): a, c, t, g, unknown or other
  misc_feature (376)..(376): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagcgttgggttttcctcgttgcttcttttaagaggtgtccagtgtcaggtgcagctggtggagtcgtgggggagcgtggtccagccgtgggacgtccctnagactctctgttacncctntggattcaccttcagtnttatcctttgcacgtgggtcctcaggctccgaggcaagggggctgggagtgggtggcagtttanctcatttgactggganaacaaataaatactaacngataccgtccggttcggggcctattcaccatacctacaaagaactaactttagaaacgtaacacgtcttagttactagtacaaatcggggaaactacggtcctaggaagagacgtaggaacggtacgaacgggccttggttagttaacgtttaacgtttcggtttccggtttttgggttcgttcggttaccgttcggggttacgggggtaacttacccgtttaacgacggtcggttaccggtcgggggcccgtaaccggggg

SEQ ID NO: 327341 - DNA, 611 bp, Homo sapiens
  misc_feature: GZ8MTXP01B1JCB.10.53.E09.1.454.CMB.2.raw
  modified_base (252)..(252): a, c, t, g, unknown or other
  misc_feature (252)..(252): n is a, c, g, or t
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtggagtcgtgggggagcgtggtccagccgtggggacggtccctnagactctcctgttacgcctctggtatccaccttcagtagttactcctttgctacgtgggtcctcaggctccgaggcgaagggggctgggaggtgggtgctagttatcctctagtttgagtaggaaagaactaataaatactacgagtacgtacgtccgggtacgggccgtattccacatcctaacgaaaagtactaaattagaaacaacacgtcttgtttactagactaaatacgaaacagccgtaggaagacgtcgtaggacggacgaacgggtcttgtagttagtttacgttggttttcggtttgttacgttggtaccgttcgggttacggggtacttaccggttcgaacggtccgg

SEQ ID NO: 327342 - DNA, 584 bp, Homo sapiens
  misc_feature: GZ8MTXP01BGJ2G.10.53.E09.1.454.CMB.2.raw
  modified_base (239)..(239): a, c, t, g, unknown or other
  misc_feature (239)..(239): n is a, c, g, or t
  modified_base (258)..(258): a, c, t, g, unknown or other
  misc_feature (258)..(258): n is a, c, g, or t
  modified_base (342)..(342): a, c, t, g, unknown or other
  misc_feature (342)..(342): n is a, c, g, or t
tcagcatagtagtgcacgaccggtgctcgatttagagagagtgtgttgggtttgggggagacgagcccagcactggaagtcgccggtgtttccattcggtgatcatcactgaacacagaggactcaccatggagtttgggctgagcttgggttttcctcgttgctcttttaagaggtgtccagtgtcaggtgcagctggtggagtcgtgggggagcgtggtccagcctgggagtccctnagactctcctgttagcctntggattcaccttcagtagttatccttgctacgtgggtcctcaggcctccaggcaagggggctgggagtggggtgcagttatctnatttgatggaagacaaataaataactacaagagtactcccgtcgggggcctattccacctatcctaccaaagactaaattagaaagaacacgtcttagtttctagacaaatgggaaacagcctagaacgagcgtggaacggacacggcttgtgtaacgttacttgttcgtttggttcgtgttaccgttcggttaccgggggaattacccgttcgacggtcttacggtcggggcccgaacggg

SEQ ID NO: 327343 - DNA, 649 bp, Homo sapiens
  misc_feature: GZ8MTXP01B5BC3.10.53.E09.1.454.CMB.2.raw
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggagcgtggtccagccgtgggacgtccctcagactctcctgttacgcctctggtatcaccttcagttagttacttcctttgctacgtgggtccgtcgaggctccgaggcgaagggggctgggaggtggggtgcgtagttatcctctagtttgatggaaagaacaagtaaatacacgaagacgtaccgtcgggttaccggggccgtattccaacactacctaacgaaagtaactaaatttagaaacgaactaacgtcgttacgtttacgtacggaactaaaagtacgaaaccgtacgacccgtaggaacgaggtaccgtagggaacggaaccgaacgggtcgttgttacggttacgtttacgttggtttaccggtttggtttccgtgtccggttaaccgggttacgggggtacttaccgttcgaacgtccgg

SEQ ID NO: 327344 - DNA, 721 bp, Homo sapiens
  misc_feature: GZ8MTXP01DKUI4.10.53.E09.1.454.CMB.2.raw
  modified_base (192)..(192): a, c, t, g, unknown or other
  misc_feature (192)..(192): n is a, c, g, or t
  modified_base (240)..(240): a, c, t, g, unknown or other
  misc_feature (240)..(240): n is a, c, g, or t
  modified_base (312)..(312): a, c, t, g, unknown or other
  misc_feature (312)..(312): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagcttgggttttcctcgttgcttcttttaagaggtgtccagtgtcaggtncagcgtggtggagtcgtgggggagcgtgtccagcctgggacgtccctnagactctcctgtttacgccctgtggtacttcaccttcaagtagttactccctttgcctacgtcgggtccctnacggcctccgaggcgaaggggctgggagtgggtgctagttatctctagtttgagtagggaagaactaaaagtaaataacaacgaaggaacgtacccgttcccgggttacgggggccctaacgtttccaacccgtacttactaaaccgaaagtaacttaaagttaacgaaaacgtaaccgtacgttcgtttacgttacgtaacgtaaactaaacgtaacggaaacgacggtaccgtaggacgacgtcgtacggaaacggaccgtaacggtcgttaggttagtttaacgtttacgtttcggttttacgggttttcggttaccgttacgggttaccggttccgggggttaaaccgggttaaccttacccgtcgaccggtacgttacggggtccgggaacccggtaacccggg

SEQ ID NO: 327345 - DNA, 746 bp, Homo sapiens
  misc_feature: GZ8MTXP01CGGLB.10.53.E09.1.454.CMB.2.raw
  modified_base (250)..(250): a, c, t, g, unknown or other
  misc_feature (250)..(250): n is a, c, g, or t
  modified_base (262)..(262): a, c, t, g, unknown or other
  misc_feature (262)..(262): n is a, c, g, or t
tcagcatagtagtgcacgaccggtgctcgatttagagagagtgtgttgggttttcctcgttgctctttaagaggtgtccagtgtcaggtgcagctgggtggagtcgtggggggaggcgtggtccagcctgggaggtccctcagactctcctgtttagcctctggattcaccttcagtagttatcctttgcacgtgggtccgtcaggcctccgaggcgaagggggctgggaggtggggtggcagttatctntatttgatgganaacaaataaatactacagagactccggtcggggccattcaccatctaccaaagacaaatttgaaagaacacgcttgtttcagacaaatgaaacagcctagagacgctaggaggacacggcttgtgtatttacgttggtttcgttggttctggtacgttcgggtacgggggtaactaccgttcgacgcgacggttcgggggaccgacggggcccacccgtcggttacccgtaccccggttccttcccgttaccgaccgtacccctacccgaacccgaaacccggggtcccctaaccggttccccgggttcccccgtttcccccccgtacgggtccccctaacccccttccccgttaccccgaaaccggaccggtacccctaaccccgggttcccgggttcggggggaccccaaacccgggccgggtcccccgggggtccccggtccgggggcccgttcccgggttaaccccggtttaaccggggg

SEQ ID NO: 327346 - DNA, 752 bp, Homo sapiens
  misc_feature: GZ8MTXP01DZ71E.10.53.E09.1.454.CMB.2.raw
  modified_base (251)..(251): a, c, t, g, unknown or other
  misc_feature (251)..(251): n is a, c, g, or t
  modified_base (266)..(266): a, c, t, g, unknown or other
  misc_feature (266)..(266): n is a, c, g, or t
  modified_base (269)..(269): a, c, t, g, unknown or other
  misc_feature (269)..(269): n is a, c, g, or t
  modified_base (279)..(279): a, c, t, g, unknown or other
  misc_feature (279)..(279): n is a, c, g, or t
tcagcatagtagtgcacgaccggtgctcgatttagagagagtgtgttgggtttgggtagctctgggagacgagcccagcactggaagtcgccggtgtttccattcggtgatcatcactgaacacagaggactcaccatggagtttgggctgagtcttgggttttcctcgttgcttcttttaagaggtgtccagtgtcaggtgcagctggtggagtcgtgggggagcgtggtccagccgtgggacgtccctnagactctctgttacnctntgatcacttnagtattatcctttgctacgtcgggtcctcaggcctaccgaggccgaagggggctgggaggtgggtgactagtttactccgttctagttttgaagttagggaaaactaaactaaagtaaaaacttaccgtaaacgaaacggtacggtaaccgtttcccggggttaccgggggacccctaagtttacccaacctaacttaccctaaaccgtaaaaacggtaaccttaaaagttttacggaaaacgtaaaccgtaacggttaccttttaggttttttaacgggaaacttaaagttaacggtaaacacggtaccgttaggaaggaaacgtcggttaaggaacgggaacgtaaccgggtgtttaggttacggttaagttttacggtttcggttttgggttttcggtttcgttacggttaaccgttacggggttaacggggttaaacttaccgtttacgaacggttccgtaacccgggg

SEQ ID NO: 327347 - DNA, 617 bp, Homo sapiens
  misc_feature: GZ8MTXP01AELPI.10.53.E09.1.454.CMB.2.raw
  modified_base (378)..(378): a, c, t, g, unknown or other
  misc_feature (378)..(378): n is a, c, g, or t
  modified_base (393)..(393): a, c, t, g, unknown or other
  misc_feature (393)..(393): n is a, c, g, or t
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagcgtggtggagtcgtgggggagcgtggtccaggccgtggggacgtccctcgagtactctcctgttacgcctctggactcacttcagtagttactcctttgctacgtgggtcctcaggctccgaggcgaagggggctgggaggtgggtgctagttatcctctagtttgatggaaanaacaataaatactanagacgtacgtccggtcgggccgtattcactactctaaccaaagtactaattagaaacgtaacacgtacttagtttactacgtaactaaatacgaaactagacctagaacgagtcgtaggacggacgaacggtcgttggtagttacgtttacgttcggtttcggtttcggttcgtcggtaccgttccgggtacgggggtaaccttaccgttcgaacggtaaccgg

SEQ ID NO: 327348 - DNA, 567 bp, Homo sapiens
  misc_feature: GZ8MTXP01AOM34.10.53.E09.1.454.CMB.2.raw
  modified_base (268)..(268): a, c, t, g, unknown or other
  misc_feature (268)..(268): n is a, c, g, or t
  modified_base (297)..(297): a, c, t, g, unknown or other
  misc_feature (297)..(297): n is a, c, g, or t
  modified_base (340)..(340): a, c, t, g, unknown or other
  misc_feature (340)..(340): n is a, c, g, or t
  modified_base (351)..(351): a, c, t, g, unknown or other
  misc_feature (351)..(351): n is a, c, g, or t
  modified_base (545)..(545): a, c, t, g, unknown or other
  misc_feature (545)..(545): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggagcgtggtccagcctgggagtccctcagctctcctgttagcctctggattcaccttnagtagttatcctttgcacgtgggtccgtnaggcctccgaggcaagggggctgggaggtggtgcagttatctnatttgatgganacaataaatactacaagtagactcccggttcggggccattccaaccatacctaccaaagacaattagaaagaacacgtcttagttctagtacaaatacggaaacacgccgtagagagtcgtaggacgacgacggcgtgtgttaattacgttgtttcgttggtttcgtgttcgttcggttcggggtaatccgtcngcgacgtcggggccgtaacggg

SEQ ID NO: 327349 - DNA, 564 bp, Homo sapiens
  misc_feature: GZ8MTXP01C30KA.10.53.E09.1.454.CMB.2.raw
  modified_base (326)..(326): a, c, t, g, unknown or other
  misc_feature (326)..(326): n is a, c, g, or t
  modified_base (409)..(409): a, c, t, g, unknown or other
  misc_feature (409)..(409): n is a, c, g, or t
  modified_base (489)..(489): a, c, t, g, unknown or other
  misc_feature (489)..(489): n is a, c, g, or t
tcagcatagtagtgcacgaccggtgctcgatttagagagagtgtgttgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcactgggtccgtcaggctccgaggcaaggggctggagtgggtggcagttatctcatttgatggagaacaataaatactacagagactcgtcgggccattcacatctaccaaagacaaatttgaagaacacgctgtttcngacaaatgaaacagcctgagacgctagaggacacggctgtgtattactgtttcgttggtctgtacgtcgtacggggaatactnagcacgtcggggcagggcacctggtcaccgtcgtcctcacgcctaccaccgacgggccctacgtccggttccttccccgnggccaacccctccttaccaagcgtccaccttcggttcggggccaacgcggccggcccgtgggccgtcgccgtcgg

SEQ ID NO: 327350 - DNA, 675 bp, Homo sapiens
  misc_feature: GZ8MTXP01EB58K.10.53.E09.1.454.CMB.2.raw
  modified_base (245)..(245): a, c, t, g, unknown or other
  misc_feature (245)..(245): n is a, c, g, or t
  modified_base (357)..(357): a, c, t, g, unknown or other
  misc_feature (357)..(357): n is a, c, g, or t
tcagcatagtagtgcacgaccggtgctcgatttagagagagtgtgttgggtttggggctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtggggggagcgtggtccagccgtgggacgtccctnagactctcctgtttacgctctggacttcactcagtagttactcctttgctacgtgggtcccgtcgacggcctccgaggcgaagggggctgggaggtgggtgctagttatctntatttggagtaggaagtaacaaaaattaaactaacgtaacagacgtacgtccgggttcggggacctattaccacctatacctaccaaagaactaaagtttacgaaagaacctacgtacgttcggtttacagtaacctaaaattcggaaaccacggaccgtaggaagacggtacgtaggtaacgggaccgacgggtcttaaggttacgttagtttaccgttggtttccggtttgggtttcgttcgggttaacccggttcggggttaaccgggggtaacttaaccccggttcgacgggtccgttaacggggtcccggggg

SEQ ID NO: 327351 - DNA, 652 bp, Homo sapiens
  misc_feature: GZ8MTXP01A37T3.10.53.E09.1.454.CMB.2.raw
  modified_base (241)..(241): a, c, t, g, unknown or other
  misc_feature (241)..(241): n is a, c, g, or t
  modified_base (314)..(314): a, c, t, g, unknown or other
  misc_feature (314)..(314): n is a, c, g, or t
  modified_base (362)..(362): a, c, t, g, unknown or other
  misc_feature (362)..(362): n is a, c, g, or t
  modified_base (373)..(373): a, c, t, g, unknown or other
  misc_feature (373)..(373): n is a, c, g, or t
tcagcatagtagtgcacgaccggtgctcgatttagagagagtgtgttgggtttgggggagacgagcccagcactggaagtcgccggtgtttccattcggtgatcatcactgaacacagaggactcaccatggagtttgggctgagctgggttttcctcgttgcttcttttaagaggtgtccagtgtcaggtgcagctggtggagtcgtgggggagcgtggtccagccgtgggacgtccctnagactctccttgtttacgcccttcgtggtacttccacctttcagtagttactcctttgctacgtggggtcctnaggcctccgagggcaagggggctaggggagtgggtgctagttactctnatttgatgganaactaaataaactactaacaagacgtaccgtccgggttcggggacctattccaaccactacctaccaaagtaactaattagaaacgaacctaacgtcttacgtttctacgaactaaatacggaaacacgtaccgtaggaacgagcgtacggaacggacgacggtcgttacggttgttaacgtttacgttggtttcggtttggttcgttacgttaccggttcgggttacgggggtaacttaccgttcgacggtccgttacgggtcgggccgtaaccgggg

SEQ ID NO: 327352 - DNA, 583 bp, Homo sapiens
  misc_feature: GZ8MTXP01AGJYY.10.53.E09.1.454.CMB.2.raw
  modified_base (322)..(322): a, c, t, g, unknown or other
  misc_feature (322)..(322): n is a, c, g, or t
  modified_base (450)..(450): a, c, t, g, unknown or other
  misc_feature (450)..(450): n is a, c, g, or t
tcagcatagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctgcctgtgtctcgtgggcgagagggccaccatcaactgacaagtccagccagtagttgttttatcagctaccgaacaataagaactacttagcttggaccagacaagaaaccaggacagccctacaagctgctactatttacgngggcagtccgtaacccggggactcccccgggggtccctaggacccgtattcgaaggtcgggcagggcgggtcgtaggggactaggtactttccactctcaccatcagcacgcctgacgagctagaagnggtcggcggtacttagtttactacgtgtacgagtactaacttaatacgtacctaacccctattaccacttacgttccggacccgttagggaaccttaaggtggaacgaataccgaaacgttacgtggttcgtc

SEQ ID NO: 327353 - DNA, 604 bp, Homo sapiens
  misc_feature: GZ8MTXP01EHCG8.10.53.E09.1.454.CMB.2.raw
  modified_base (192)..(192): a, c, t, g, unknown or other
  misc_feature (192)..(192): n is a, c, g, or t
  modified_base (240)..(240): a, c, t, g, unknown or other
  misc_feature (240)..(240): n is a, c, g, or t
  modified_base (259)..(259): a, c, t, g, unknown or other
  misc_feature (259)..(259): n is a, c, g, or t
  modified_base (272)..(272): a, c, t, g, unknown or other
  misc_feature (272)..(272): n is a, c, g, or t
  modified_base (358)..(358): a, c, t, g, unknown or other
  misc_feature (358)..(358): n is a, c, g, or t
  modified_base (361)..(361): a, c, t, g, unknown or other
  misc_feature (361)..(361): n is a, c, g, or t
  modified_base (376)..(376): a, c, t, g, unknown or other
  misc_feature (376)..(376): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagcttgggttttcctcgttgcttcttttaagaggtgtccagtgtcaggtncagctggtggagtcgtgggggagcgtggtccagcctgggacgtccctnagctctcctgttacgcctntggattcaccttnagtagttactcctttgctacgtgggtcctcaggctccgaggcgaagggggctgggagtggggtgctagttatctcatttgatgganaanaataaataactaacngaacgtaccgtcccggtcggggacctattacacctatactacaaagactaattagaaagtaactacgtctgttcagtacaaatagaacagtcctagagagcgtagaacggactacggtcttaggtctaagttcgttggtttcgtttggttaccttgggttacgttcggggttacgggggtaacttcgttaacgacggtaccgacgggtccgggggccgtaacccgggg

SEQ ID NO: 327354 - DNA, 617 bp, Homo sapiens
  misc_feature: GZ8MTXP01D6LLM.10.53.E09.1.454.CMB.2.raw
  modified_base (249)..(249): a, c, t, g, unknown or other
  misc_feature (249)..(249): n is a, c, g, or t
  modified_base (268)..(268): a, c, t, g, unknown or other
  misc_feature (268)..(268): n is a, c, g, or t
  modified_base (365)..(365): a, c, t, g, unknown or other
  misc_feature (365)..(365): n is a, c, g, or t
tcagcatagtagtgcacgaccggtgctcgatttagagagagtgtgttgggtttggggagctctgggagacgagcccagcactggaagtcgccggtgtttccattccggtgatcatcactgaacacagaggactcaccatggagtttgggctgagctgggttttcctcgttgcttcttttaagaggtgtccagtgtcaggtgcagctggtggagtcgtgggggagcgtggtccagcctgggacgtccctnagactctcctgttagcctntggatcacttcagtagttatccttgctactgggtcctcaggcctcgaggcgaagggggctgggagtgggtgcagttactctctatttgatgggaaanaacaataaatactagagacgacgtccggtcgggcgattcaccatctaccaaagactaattagaaacgaacacgtcttagtttacgtagaacaaatacgaaacacgccgtaggaacgagtaccgtaggaacgggaaccgtaacgggtcgttggtacgtttaagtttacgtttcgggttttcggttttcggtttcgttaaggtaccggttaacggggtaccgggggtaacttacccgttcgaacggtaacccgg

SEQ ID NO: 327355 - DNA, 698 bp, Homo sapiens
  misc_feature: GZ8MTXP01AOHBM.10.53.E09.1.454.CMB.2.raw
  modified_base (252)..(252): a, c, t, g, unknown or other
  misc_feature (252)..(252): n is a, c, g, or t
  modified_base (271)..(271): a, c, t, g, unknown or other
  misc_feature (271)..(271): n is a, c, g, or t
  modified_base (363)..(363): a, c, t, g, unknown or other
  misc_feature (363)..(363): n is a, c, g, or t
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagtcttgggttttcctcgttgcttcttttaaggaggtgtccagtgtcaggtgcagctggtggagtcgtgggggagcgtggtccagccgtgggacgtccctnagctctcctgttacgcctntgatccacttcagttagttactcctttgctacgtgggtccctgacggcctccgaggcgaagggggctgggagtgggtcgcgtagttatcctntatttgatggaaacaactaagtaaactactaagacggtaaccgtaccgttcccggggtttaccggggacccgtacttacccaacctactacccgtaaaccaaaacgaaccttaaagtttacgaaaagtaacccgtaacgtacttagtttacgacgtaaacgtaaagtacgaaactcgaccgtagacgacgacgtgaacgggacgtaacggtcgttaggttcgtttaacgtttacggtttacgttttcgggttttcgggtttaccgttaacggttaccgggtttaacggggttaacgggggttaaaccttacccgtttccggaacggtaacccggg

SEQ ID NO: 327356 - DNA, 618 bp, Homo sapiens
  misc_feature: GZ8MTXP01CZ2YT.10.53.E09.1.454.CMB.2.raw
  modified_base (239)..(239): a, c, t, g, unknown or other
  misc_feature (239)..(239): n is a, c, g, or t
  modified_base (253)..(253): a, c, t, g, unknown or other
  misc_feature (253)..(253): n is a, c, g, or t
  modified_base (257)..(257): a, c, t, g, unknown or other
  misc_feature (257)..(257): n is a, c, g, or t
  modified_base (343)..(343): a, c, t, g, unknown or other
  misc_feature (343)..(343): n is a, c, g, or t
  modified_base (356)..(356): a, c, t, g, unknown or other
  misc_feature (356)..(356): n is a, c, g, or t
  modified_base (375)..(375): a, c, t, g, unknown or other
  misc_feature (375)..(375): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagcttgggtttttcctcgttgcttcttttaagaggtgtccagtgtcaggtgcagctggtggagtcgtgggggagcgtggtccagcctgggagtcccnagctctcctgttancctntggattcaccttcagtagttatcctttgcactgggtcctcaggctccgaggcgaagggggctgggaggtgggtggctagttatctntatttgagtgganaactaaataaatactaacnggagtaccgttccgggttcggggaccctattccaaccactactacaaagactaattacgaaagaacacgtactgttctagactaaatacggaactacgctacgagagtcgtaggacggaccgtacggtcgttgttagttaacgtttacgttcggttttcggttttggttcgttacgttacggttcgggttacgggggtaacttaccgtcgtacggcgttaccggtcggggcccgtaaccgggg

SEQ ID NO: 327357 - DNA, 653 bp, Homo sapiens
  misc_feature: GZ8MTXP01CQA11.10.53.E09.1.454.CMB.2.raw
  modified_base (216)..(216): a, c, t, g, unknown or other
  misc_feature (216)..(216): n is a, c, g, or t
  modified_base (249)..(249): a, c, t, g, unknown or other
  misc_feature (249)..(249): n is a, c, g, or t
  modified_base (336)..(336): a, c, t, g, unknown or other
  misc_feature (336)..(336): n is a, c, g, or t
  modified_base (342)..(342): a, c, t, g, unknown or other
  misc_feature (342)..(342): n is a, c, g, or t
  modified_base (355)..(355): a, c, t, g, unknown or other
  misc_feature (355)..(355): n is a, c, g, or t
  modified_base (369)..(369): a, c, t, g, unknown or other
  misc_feature (369)..(369): n is a, c, g, or t
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagctgggttttcctcgttgcttcttttaagaggtgtccagtgtcaggtgcagctggtggagtcgngggggagcgtggtccagccgtgggacgtccctnagactctcctgttagcctctgatcaccttcagtagttatcctttgctacgtcgggtccgtcagggctccgaggcgaaggggctgggngtgggngctagttatcctnatttgagtggaaanaactaataaatactaacagacgtccgttccgggtcggggcctagtaccacctagtacctaacaaagtaactaaatttagaaacgtaaacacgtacgttacgtttacgtacgtaactaaaatacgaaaccaacgaccgtaggaaagacggtcgtaacgggacgggaaccgaacgggtcgttggtttagttacgtttaaccggtttggttttcggttttcgggttccgttaaggtacccggttcggggtacgggggttaacttacccgtttcgaacggtaaccggg

SEQ ID NO: 327358 - DNA, 566 bp, Homo sapiens
  misc_feature: GZ8MTXP01CVFIW.10.53.E09.1.454.CMB.2.raw
  modified_base (175)..(175): a, c, t, g, unknown or other
  misc_feature (175)..(175): n is a, c, g, or t
  modified_base (256)..(256): a, c, t, g, unknown or other
  misc_feature (256)..(256): n is a, c, g, or t
  modified_base (260)..(260): a, c, t, g, unknown or other
  misc_feature (260)..(260): n is a, c, g, or t
  modified_base (302)..(302): a, c, t, g, unknown or other
  misc_feature (302)..(302): n is a, c, g, or t
  modified_base (343)..(343): a, c, t, g, unknown or other
  misc_feature (343)..(343): n is a, c, g, or t
  modified_base (354)..(354): a, c, t, g, unknown or other
  misc_feature (354)..(354): n is a, c, g, or t
tcagcatagtagtgcacgaccggtgctcgatttagagagagtgtgttgggtttgggggagacgagcccagcactggaagtcgccggtgtttccattcggtgatcatcactgaacacagaggactcaccatggagtttgggctgagcttgggttttcctcgttgcttcttttaagnggtgtccagtgtcaggtgcagctggtggagtcgtgggggagcgtggtccagcctgggacgtccctcagactctcctgttancctntggattcaccttcagtagttatccctttgcactgggtccgtnaggctccaggcaagggggctggagtgggtggcagttatctnatttgatgganacaataaataactacaagagactccgttcgggggccattcaccatctaccaaagacaatttagaacgaacacgtctagttctagacaaataggaacagcctagagagctgaggacacggctgtgttaattacgttgtttcggtttggtttcgtgttacgttcggttacgggggtaattacccgttcacggcacgtcggggccgtaaccgggg

SEQ ID NO: 327359 - DNA, 625 bp, Homo sapiens
  misc_feature: GZ8MTXP01C2VZQ.10.53.E09.1.454.CMB.2.raw
  modified_base (270)..(270): a, c, t, g, unknown or other
  misc_feature (270)..(270): n is a, c, g, or t
  modified_base (281)..(281): a, c, t, g, unknown or other
  misc_feature (281)..(281): n is a, c, g, or t
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagctgggttttcctcgttgcttcttttaagaggtgtccagtgtcaggtgcagctggtggagtcgtgggggagcgtggtccagccgtgggacggtccctcagactctcctgttacgcctntgatcaccttnagtagttatcctttgctacgtgggtcctcaggctccgaggcgaagggggctggggagtgggtggctagttatcctctatttggatggaaacgaactaataaactacgtaacaggacgtaccgttccggggtcggggaccgtacttaccaaccgtattacctaaccaaaagtactaaatttacgaaacgtaaacacgtacgttgtttacgtacgactaaatacgaacagcctagacgacgtcgtaggacggacgtaacggtcttgttgttacgtttacgttgtttacggtttcggttcgttggtacgttcggggtacggggtacttaccgttcgaacggtaaccg

SEQ ID NO: 327360 - DNA, 585 bp, Homo sapiens
  misc_feature: GZ8MTXP01DD40R.10.53.E09.1.454.CMB.2.raw
  modified_base (288)..(288): a, c, t, g, unknown or other
  misc_feature (288)..(288): n is a, c, g, or t
  modified_base (307)..(307): a, c, t, g, unknown or other
  misc_feature (307)..(307): n is a, c, g, or t
  modified_base (380)..(380): a, c, t, g, unknown or other
  misc_feature (380)..(380): n is a, c, g, or t
tcagcatagtagtgcacgaccggtgctcgatttagagagagtgtgttgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcacgtgggtccgtcaggctccaggcaaggggctggagtgggtgcagttatctcattgagtggagaacaataaatactacagagactcgtcgggcatcacanctaccaaagacaattgaanaacacgctgtttctgacaaatgaacagctgagagctgagacacggctgtgtattactgtttcgtttggttctntacgtcgtacggggaactacttgagcacgtcggggccagggccaccgtcggctacccgtctcctcacgcctacccgaccgaacggcccacgtcccggtcccttcccccgtcggccctaaccctcccttaccgaaacgcgacccgaccgttcgttcgggggacccaacgacggcccgggtcccgcgggcctcggcccgttaacggg

SEQ ID NO: 327361 - DNA, 588 bp, Homo sapiens
  misc_feature: GZ8MTXP01DPUX4.10.53.E09.1.454.CMB.2.raw
  modified_base (252)..(252): a, c, t, g, unknown or other
  misc_feature (252)..(252): n is a, c, g, or t
  modified_base (269)..(269): a, c, t, g, unknown or other
  misc_feature (269)..(269): n is a, c, g, or t
  modified_base (371)..(371): a, c, t, g, unknown or other
  misc_feature (371)..(371): n is a, c, g, or t
  modified_base (476)..(476): a, c, t, g, unknown or other
  misc_feature (476)..(476): n is a, c, g, or t
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagcttggggtttttccctcgttgcttcttttaaagaggtgtccagtgtcaggtgcagctggtggagtcgtgggggagcgtggtccagcctgggagtccctnagctctctgttagcctntgatcaccttcagtagttatcctttgctacgtcgggtccgtcaggcctccgaggcgaagggggctgggagtgggtgctagttatcctctatttgatggaaanaacaataaatactaacgagacgtacgtcgggtcgggcctattcaccatcctacaaagtactaattagaaacgaacacgtcttacgttactagactaaatgaaacngcctagaagcgtcgtaggacggcaacggtcgttgttacgttagttacgttggtttcggtttgttccgtggtaccgttcgggtacgggggtacttaccgttcgaacgtaaccg

SEQ ID NO: 327362 - DNA, 605 bp, Homo sapiens
  misc_feature: GZ8MTXP01EAGMV.10.53.E09.1.454.CMB.2.raw
  modified_base (239)..(239): a, c, t, g, unknown or other
  misc_feature (239)..(239): n is a, c, g, or t
  modified_base (348)..(348): a, c, t, g, unknown or other
  misc_feature (348)..(348): n is a, c, g, or t
  modified_base (360)..(360): a, c, t, g, unknown or other
  misc_feature (360)..(360): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtggagtcgtgggggagcgtggtccagcctgggagtccctnagactctcctgttacgcctctggattcaccttcagtagttatcctttgctacgtgggtccgtcaggctccgaggcgaagggggctgggaggtggggtgctagttatctnagtttgatgganacaataaataacacaagagactccggttcggggcctattcaccatctacaaagacaattagaaagaacacgtctgtttacctagaactaaagtacggaaacaacgtacctagaggagcgtaggacggacacggtctgtagttaagtttaacgttggtttacggttttggttcgttcggttacgttcgggttacgggggtaacttaccgttcgaacggtccgacggttcggggccggtaaccgggg

SEQ ID NO: 327363 - DNA, 783 bp, Homo sapiens
  misc_feature: GZ8MTXP01E05BT.10.53.E09.1.454.CMB.2.raw
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagcttgggttttcctcgttgctcttttaagaggtgtccagtgtcaggtgcagctggtggagtcgtgggggagcgtggtccaggccgtgggacggtccctcagactctcctgttacgcctctggactcaccttcagttagttatcctttgctacgttcgggtcccgtcgacggcctccgagggccgaaggggggtctgggggaggtgggggtggcctaggtttatcccttacgtagttttgaagttgggaaaacgtaaactaaagttaaaactaactaaaccgaaaggtaacggtacccggttcccgggttaccgggggaccctaacgttacccaaccctaacttaccgtaaaccctaaaaaggaaccttaaaagtttacggaaaacgtaaaccgtaccggttacgtttacggttttaccgtacggtaaacctaaaagttacgaaaaccgacgtaccgtaaggaacggtacgaccgttagggaacgggaaccgtaacgggtcctttgggttacgtttaaacgtttacgttttcgggttttccgggtttttcggggtttccgttaacgggtacccggttaaccggggttaacggggggtaacttacccggtttaacgttaacgggtaacccggg

SEQ ID NO: 327364 - DNA, 590 bp, Homo sapiens
  misc_feature: GZ8MTXP01CG0R6.10.53.E09.1.454.CMB.2.raw
  modified_base (260)..(260): a, c, t, g, unknown or other
  misc_feature (260)..(260): n is a, c, g, or t
  modified_base (337)..(337): a, c, t, g, unknown or other
  misc_feature (337)..(337): n is a, c, g, or t
  modified_base (450)..(450): a, c, t, g, unknown or other
  misc_feature (450)..(450): n is a, c, g, or t
  modified_base (456)..(456): a, c, t, g, unknown or other
  misc_feature (456)..(456): n is a, c, g, or t
  modified_base (533)..(533): a, c, t, g, unknown or other
  misc_feature (533)..(533): n is a, c, g, or t
  modified_base (566)..(566): a, c, t, g, unknown or other
  misc_feature (566)..(566): n is a, c, g, or t
tcagcatagtagtgcacgaccggtgctcgatttagagagagtgtgttgggtttgggggagctacaacaggcaggcaggggcagcaagatggtgttgcagacccaggtcttcatttctctgttgctctggatctctggtgccgtacggggacatcgtgatcgacccagtcctccagacctccctgcctgtgtctcgtgggcgagacgggccaccatcaactgacaacgtccagccagtagttgttttatcagctaccgaanaaataagaactactagcttaggaaccagacaacgaaaccgaggaacacgccctactaagctcgctactagtttacgngggactacgtaccggtaacccgggtacgttccccccggggtccctaggacccgtattcgaaacggtcggcgtacgggtccgggtgtgggactagtacttcactcgtacactanacagcncgctcgcgagacgtagaacgtcggtcggtcgtattagttactcgtgtacgaactcttaactactactacctaacctnttacacgttcgtaccggcgttaggacttaaggnaactaacacgaacgttcgtgcgtc

SEQ ID NO: 327365 - DNA, 672 bp, Homo sapiens
  misc_feature: GZ8MTXP01BCXGM.10.53.E09.1.454.CMB.2.raw
  modified_base (239)..(239): a, c, t, g, unknown or other
  misc_feature (239)..(239): n is a, c, g, or t
  modified_base (256)..(256): a, c, t, g, unknown or other
  misc_feature (256)..(256): n is a, c, g, or t
tcagcatagtagtgcacgaccggtgctcgatttagagagagtgtgttgggttggggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtggagtcgtgggggagcgtggtccagccgtgggacgtcccnagctctctgttagcctntgattcaccttcagtagttatcctttgctacgtcgggtccctcgaggtcctccgaggacgaagggggctggaggtgggtgctagttatctatagttgacgtggaaagtaacaaaagttaaactaaactacgaagacgtacccgttcccgggttacggggacctacttaccaacctactacctaacaaacgtaactaaattacgaaacgaaactacgtacttacgttactacgaacgtaaagtacggaaacgtagaccgtaggaacgagtcgtagaacggacgtacggtacgtacgttgttaacgtttagttcggttttacggtttcggttacgttacggttaccggttcggttaccgggggtaacttaccgttaacgtacggtaccgttacgggtccggggaaccggtaaccgggg

SEQ ID NO: 327366 - DNA, 570 bp, Homo sapiens
  misc_feature: GZ8MTXP01DJ8YR.10.53.E09.1.454.CMB.2.raw
  modified_base (196)..(196): a, c, t, g, unknown or other
  misc_feature (196)..(196): n is a, c, g, or t
  modified_base (244)..(244): a, c, t, g, unknown or other
  misc_feature (244)..(244): n is a, c, g, or t
  modified_base (362)..(362): a, c, t, g, unknown or other
  misc_feature (362)..(362): n is a, c, g, or t
  modified_base (377)..(377): a, c, t, g, unknown or other
  misc_feature (377)..(377): n is a, c, g, or t
  modified_base (410)..(410): a, c, t, g, unknown or other
  misc_feature (410)..(410): n is a, c, g, or t
tcagcatagtagtgcacgaccggtgctcgatttagagagagtgtgttgggtttggggctgggagacgagcccagcactggaagtcgccggtgtttccattcggtgatcatcactgaacacagaggactcaccatggagtttgggctgagcttgggttttcctcgttgctcttttaagaggtgtccagtgtcaggtncagctggtggagtcgtggggggagcgtggtccagcctgggagtccctnagactctcctgttagcctctggattcacctcagtagttatcctttgctacgtgggtccgtcaggctccgaggcgaagggggctgggagtgggtggctagttatctctatttgatgganacaaaataaatctanagagactccggtcggggcatcacatctacaaanactaattagaagaacacgctgtttactagactaaatgaaacagcctgagagacgtaggaggacgacggctgttgttatttacgttgttttcgtttggttacgttcgttaccgttcgggttacgggggtaacttaccgtcgacgtccgaacggtaacgggg

SEQ ID NO: 327367 - DNA, 665 bp, Homo sapiens
  misc_feature: GZ8MTXP01EV8QY.10.53.E09.1.454.CMB.2.raw
  modified_base (242)..(242): a, c, t, g, unknown or other
  misc_feature (242)..(242): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagtcttgggttttcctcgttgcttcttttaagaggtgtccagtgtcaggtgcagctggtggagtcgtgggggagcgtggtccagccgtgggacgtccctnagactctccttgtttacgcccttcgtggtacttccaccttcagtagtttactcctttgctacgtcgggtcctcgaggcctcgaggcgaaggggcgtgggtaggtggggtggtcgtagttagttctactgtttagacgtggaagtaacaaataaacgtaaactaacaaggacgtaccgttcccgggttacggggtaccgtaattccacctactactaaccaaagaactaaattagaaacgaacaacgtctcgttactgtaacaactagggaacacgtactagagagcgtaggaggaccgtacgggtcttggttgttaacgtttacgtttgttttcggtttcggtttcgttaggttaccggttccgggttacgggggtaaccttacgtccgtacgccgttaccggtcggggcccggtaacccggg

SEQ ID NO: 327368 - DNA, 665 bp, Homo sapiens
  misc_feature: GZ8MTXP01AT2SE.10.53.E09.1.454.CMB.2.raw
  modified_base (274)..(274): a, c, t, g, unknown or other
  misc_feature (274)..(274): n is a, c, g, or t
  modified_base (333)..(333): a, c, t, g, unknown or other
  misc_feature (333)..(333): n is a, c, g, or t
  modified_base (343)..(343): a, c, t, g, unknown or other
  misc_feature (343)..(343): n is a, c, g, or t
  modified_base (346)..(346): a, c, t, g, unknown or other
  misc_feature (346)..(346): n is a, c, g, or t
  modified_base (360)..(360): a, c, t, g, unknown or other
  misc_feature (360)..(360): n is a, c, g, or t
tcagcatagtagtgcacgaccggtgctcgatttagagagagtgtgttgggtttggggctgggagacgagcccagcactggaagtcgccggtgtttccattcggtgatcatcactgaacacagaggactcaccatggagtttgggctgagcgtgggttttcctcgttgctcttttaagaggtgtccagtgtcaggtgcagctggtggagtcgtgggggagcgtggtccaggcctggggacgtccctcagctctcctgttagcctctggatcactnagtagttctcttgctacgtcgggtcctcaggctcgaggcgaagggggctgggagtgggnggctagttanctnagtttgagtggaanactaaaataaactctacgagaagtacccgttccggggttacggggacctacttaccaacctataccctaccgaaaatacctaaagtttacgaaaacgtaacctacggttctttacgtttaccgtaacgaacgtaaacgtacgaacgacgtcgtaggacggtacgtaggtacggacggtaccggtacggtcgttaaggttagtttacgtttacgtttcgggttttacggtttcggttcggttcggttaccgggtccggggttaacggtaaccttacccgtggaccggtcggttaaccgggtcgggg

SEQ ID NO: 327369 - DNA, 617 bp, Homo sapiens
  misc_feature: GZ8MTXP01BCJYH.10.53.E09.1.454.CMB.2.raw
  modified_base (250)..(250): a, c, t, g, unknown or other
  misc_feature (250)..(250): n is a, c, g, or t
  modified_base (365)..(365): a, c, t, g, unknown or other
  misc_feature (365)..(365): n is a, c, g, or t
  modified_base (378)..(378): a, c, t, g, unknown or other
  misc_feature (378)..(378): n is a, c, g, or t
  modified_base (480)..(480): a, c, t, g, unknown or other
  misc_feature (480)..(480): n is a, c, g, or t
  modified_base (513)..(513): a, c, t, g, unknown or other
  misc_feature (513)..(513): n is a, c, g, or t
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtggagtcgtgggggagcgtggtccagccgtgggacgtccctnagctctctgtttacgcctctggatcaccttcagttagttactcctttgctacgtgggtcccgtcagggcctccgagggcgaagggggctgggaggtggggtgctaggtatccctnatttgatggaaanaactaataaatactaacgagacgtacgtccgggtcggggcctattccacactcgacaaagactaattagaaagacacgtcttagttctagacaaatgaaacnggcctagacgagcgtaggacgacgtaaccggtnttaggtgttacgtttacgttcggtttcggttttggttcgttaacgggttaccggttaaccggggtaccgggggttaacttaccccgtttcgaacggttcccggg

SEQ ID NO: 327370 - DNA, 682 bp, Homo sapiens
  misc_feature: GZ8MTXP01B737S.10.53.E09.1.454.CMB.2.raw
  modified_base (242)..(242): a, c, t, g, unknown or other
  misc_feature (242)..(242): n is a, c, g, or t
  modified_base (359)..(359): a, c, t, g, unknown or other
  misc_feature (359)..(359): n is a, c, g, or t
  modified_base (374)..(374): a, c, t, g, unknown or other
  misc_feature (374)..(374): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagcgtggtggagtcgtgggggagcgtggtccagccgtgggacgtccctnagactctccttgttacgcctctggtacttcaccttcagtagttacttcctttgctacgtcgggtccgtcaggtcctccgaggccgaagggggctgggaggtgggtgctagttatctntatttgacgtagganaacaaataaataactaacaaggacgtaccgtccgggttcgggacctacttacgacctactacctaacgaaagtaactaattacgaaacgaactacgtacgttacgttactagaactaaagtacggaaactacggtacctaaggaacgtaggaccgtaggaacggaccgtaggtccgttagttgttaacgtttacgtttcgggttttcggtttcgggttacgttacgggttaaccgggttcggggttaaccgggggtaacttacccgttcgacggtccgaacgggtccggggttaaccgtaacccgggg

SEQ ID NO: 327371 - DNA, 583 bp, Homo sapiens
  misc_feature: GZ8MTXP01ELSZN.10.53.E09.1.454.CMB.2.raw
  modified_base (290)..(290): a, c, t, g, unknown or other
  misc_feature (290)..(290): n is a, c, g, or t
  modified_base (321)..(321): a, c, t, g, unknown or other
  misc_feature (321)..(321): n is a, c, g, or t
  modified_base (488)..(488): a, c, t, g, unknown or other
  misc_feature (488)..(488): n is a, c, g, or t
tcagcatagtagtgcacgaccggtgctcgatttagagagagtgtgttgggtttggggagctacaacaggcaggcaggggcagcaagatggtgttgcagacccaggtcttcatttctctgttgctctggatctctggtgcctacggggacatcgtgatgacccagtctccagactccctgcctgtgtctcgtggggcagacgggccaccatcaactgcaagtccagccagtagttgtttaatcagctaccgacaataagaactactagcttaggtaccagacaacgaaacnggacagcctacaagctgctactattttacgngggcacgttaccgaacccggggaattccccccgggggtccctagaaccggtatttccgaaaggttcggcgtacgggcgggtctaggggaccaggtactttcactctcacatcagctacgcctgacgtacggctagaagaggttcgacgggtctaagtttattaccgngttccgaagcctaatattactacgtaaccctgttcacttcgtcgacccgttaggaccttaaggtggacgaacttaacgacgttactaagttcggc

SEQ ID NO: 327372 - DNA, 625 bp, Homo sapiens
  misc_feature: GZ8MTXP01C3Y5M.10.53.E09.1.454.CMB.2.raw
  modified_base (245)..(245): a, c, t, g, unknown or other
  misc_feature (245)..(245): n is a, c, g, or t
  modified_base (265)..(265): a, c, t, g, unknown or other
  misc_feature (265)..(265): n is a, c, g, or t
  modified_base (275)..(275): a, c, t, g, unknown or other
  misc_feature (275)..(275): n is a, c, g, or t
  modified_base (338)..(338): a, c, t, g, unknown or other
  misc_feature (338)..(338): n is a, c, g, or t
  modified_base (365)..(365): a, c, t, g, unknown or other
  misc_feature (365)..(365): n is a, c, g, or t
tcagcatagtagtgcacgaccggtgctcgatttagagagagtgtgttgggtttggggctgggagacgagcccagcactggaagtcgccggtgtttccattcggtgatcatcactgaacacagaggactcaccatggagtttgggctgagcttgggttttcctcgttgctcttttaagaggtgtccagtgtcaggtgcagctggtggagtcgtgggggagcgtggtccagccgtgggacgtccctnagctctcctgtttacgcctntgatcacctnagtagttactccttgctacgtgggtcctcgaggcctcgaggcgaagggggctgggaggtgggngctagttatctactatttgagtggaanactaaaataaataactaacagagtaccgtccggttcggggaccattacccacatacctacaaacgactaaagtttagaacgtaaaccacgtacttcgtttacgacgaacgtaaagtacgaacacgtacgtacggaagacgacgtagaacgggacgtacggtcgtaagttgttacgttacgttggtttcggtttggttacgttcggttaccggttcgggtaacgggtaacttaccgtcgacggtcgttaacgggtccgggg

SEQ ID NO: 327373 - DNA, 649 bp, Homo sapiens
  misc_feature: GZ8MTXP01AUOM8.10.53.E09.1.454.CMB.2.raw
  modified_base (184)..(184): a, c, t, g, unknown or other
  misc_feature (184)..(184): n is a, c, g, or t
  modified_base (253)..(253): a, c, t, g, unknown or other
  misc_feature (253)..(253): n is a, c, g, or t
  modified_base (265)..(265): a, c, t, g, unknown or other
  misc_feature (265)..(265): n is a, c, g, or t
  modified_base (268)..(268): a, c, t, g, unknown or other
  misc_feature (268)..(268): n is a, c, g, or t
  modified_base (271)..(271): a, c, t, g, unknown or other
  misc_feature (271)..(271): n is a, c, g, or t
  modified_base (277)..(277): a, c, t, g, unknown or other
  misc_feature (277)..(277): n is a, c, g, or t
  modified_base (281)..(281): a, c, t, g, unknown or other
  misc_feature (281)..(281): n is a, c, g, or t
  modified_base (283)..(283): a, c, t, g, unknown or other
  misc_feature (283)..(283): n is a, c, g, or t
  modified_base (298)..(298): a, c, t, g, unknown or other
  misc_feature (298)..(298): n is a, c, g, or t
  modified_base (323)..(323): a, c, t, g, unknown or other
  misc_feature (323)..(323): n is a, c, g, or t
  modified_base (336)..(336): a, c, t, g, unknown or other
  misc_feature (336)..(336): n is a, c, g, or t
  modified_base (351)..(351): a, c, t, g, unknown or other
  misc_feature (351)..(351): n is a, c, g, or t
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagtcttgggttttcctcgttgcttcttttaagnggtgtccagtgtcaggtgcagcgtggtggagtcggtgggggagcgtggtccagccgtgggacgtccctnagctctctgttnctntgntcactnagtntntcttgctgtggcctngctcgaggcgagggctggagtgggngctagttactctntagttgagtggaaanaactaataaatactacagtacgtaccgtccgggttcgggacctacttaccacctactacctaacaaacgtactaaagttacgaaacgtaactacgtacgtttacgttacgtaggtaaacctaaagtacgaaaccgacgacgtaggaacgacgtccggtacggtaacggaccgtaacggtcgttaggttacgtttagtttaccgggtttggttttccggtttcgggtttaccgttaacgggtacccgggtttaaccggggtaacgggggttaacttacccgttcggaacggtaacccgg

SEQ ID NO: 327374 - DNA, 618 bp, Homo sapiens
  misc_feature: GZ8MTXP01AT36W.10.53.E09.1.454.CMB.2.raw
  modified_base (245)..(245): a, c, t, g, unknown or other
  misc_feature (245)..(245): n is a, c, g, or t
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagcgtggtttctcgttagctctttaagaggtgtccagtgtcaggtgcagctggtggagtcgtgggggagcgtggtccagccgtgggagtccctnagctctcctgttacgcctcgtggtatccaccttacagtacgttactcctttgcctacgtcggggtccgtcacggctaccggagggcgaagggggtctgggaggtgggggtggctaaggttctcctactatttgagtaggaataaactaataaatacacagtacgtaccgtcggttcgggcctattccacgtactacgtacaaacgtactaagttagaaacaacgtcgtctttaggtttccgtaagaacgtaaacgtaacgaacgacgacgagagacgtgacgacgacgaacgtcgttgtagttacgttacgttcgtttcggtttcggttcggtcggtcggtcgggtacgggtacgttactaaccgcgtaacgg

SEQ ID NO: 327375 - DNA, 602 bp, Homo sapiens
  misc_feature: GZ8MTXP01B0R6F.10.53.E09.1.454.CMB.2.raw
  modified_base (245)..(245): a, c, t, g, unknown or other
  misc_feature (245)..(245): n is a, c, g, or t
  modified_base (259)..(259): a, c, t, g, unknown or other
  misc_feature (259)..(259): n is a, c, g, or t
  modified_base (271)..(271): a, c, t, g, unknown or other
  misc_feature (271)..(271): n is a, c, g, or t
  modified_base (275)..(275): a, c, t, g, unknown or other
  misc_feature (275)..(275): n is a, c, g, or t
  modified_base (294)..(294): a, c, t, g, unknown or other
  misc_feature (294)..(294): n is a, c, g, or t
  modified_base (339)..(339): a, c, t, g, unknown or other
  misc_feature (339)..(339): n is a, c, g, or t
tcagcatagtagtgcacgaccggtgctcgatttagagagagtgtgttgggtttggggctgggagacgagcccagcactggaagtcgccggtgtttccattcggtgatcatcactgaacacagaggactcaccatggagtttgggctgagcttgggttttcctcgttgctcttttaagaggtgtccagtgtcaggtgcagctggtggagtcgtgggggagcgtggtccagccgtgggacgtccctnagctctcctgttanctctgatcactnagtnttatcttgcacgtggtccncaggcctcgaggcgaaggggctgggaggtgggtgctagttatctntatttggatggaataactaaaataaactctacaggacgtaccgtccgggttacggggcctacttaccacactacacaaagactaattagaaacaacacgtcttgttactagactaaagtacgaaaccacgcctagagacgacgtaggacggacgtacggtcgtaagttagttactttacgtttggtttcggtttggttcgttcggttaccggttaacgggtacggggtaacttccgtacgacggtccgttaacgggtccgggg

SEQ ID NO: 327376 - DNA, 644 bp, Homo sapiens
  misc_feature: GZ8MTXP01C2ZAF.10.53.E09.1.454.CMB.2.raw
  modified_base (191)..(191): a, c, t, g, unknown or other
  misc_feature (191)..(191): n is a, c, g, or t
  modified_base (238)..(238): a, c, t, g, unknown or other
  misc_feature (238)..(238): n is a, c, g, or t
  modified_base (257)..(257): a, c, t, g, unknown or other
  misc_feature (257)..(257): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagcttgggttttcctcgttgctcttttaagaggtgtccagtgtcaggtncagctggtggagtcgtgggggagcgtggtccagcctgggagtccctnagactctcctgttagcctntggattcaccttcagtagttatccctttgctacgtgggtcccgtcaggctccgaggcgaaagggggctgggagtggggtgcagttatctcatttgatggaagtacaaataaataactaacaaggacgtacgtcccgggttacggggcccaatttccaaccctatcctaccaaaagactaaatttagaaacgtaacaacgtcgttagtttactacgaacctaaaattacgggaaactaggtaccctaggaacgacgtcgtacggaaacggtacgtaaccgggtctggttagtaacttttaacgttggtttaccggtttggttccgtaggttaccgttcggttacgggggtaacttacgttcgaggcgttacgtcggggccgtaacggg

SEQ ID NO: 327377 - DNA, 617 bp, Homo sapiens
  misc_feature: GZ8MTXP01C54PS.10.53.E09.1.454.CMB.2.raw
  modified_base (242)..(242): a, c, t, g, unknown or other
  misc_feature (242)..(242): n is a, c, g, or t
  modified_base (256)..(256): a, c, t, g, unknown or other
  misc_feature (256)..(256): n is a, c, g, or t
  modified_base (264)..(264): a, c, t, g, unknown or other
  misc_feature (264)..(264): n is a, c, g, or t
  modified_base (452)..(452): a, c, t, g, unknown or other
  misc_feature (452)..(452): n is a, c, g, or t
tcagcatagtagtgcacgaccggtgctcgatttagagagagtgtgttgggtttggggctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggagcgtggtccagcctgggacgtcctnagctctcctgttancctctggntcactcagtagttatctttgcacgtggtccgtcaggctcgaggcgaagggggctggaggtgggtggcagttatctctagtttgatggagaacaaaattaaataactaacagagtaccgtcgggtcggggccgtattaccacactctaccgaaagtacaatttagaaacgacacgcttgttacacgaanaaatgaaacacgccgtaggagacgacgtaggaaggacgtacgggtctaaggttagtttaacgtttccgttggtttttaccggtttcggtttccgttcgttaccgggttaacgggtacgggggtaacttaccgttcggttacgtaaccgttaacggttcccggggg

SEQ ID NO: 327378 - DNA, 625 bp, Homo sapiens
  misc_feature: GZ8MTXP01AX8OO.10.53.E09.1.454.CMB.2.raw
  modified_base (182)..(182): a, c, t, g, unknown or other
  misc_feature (182)..(182): n is a, c, g, or t
  modified_base (247)..(247): a, c, t, g, unknown or other
  misc_feature (247)..(247): n is a, c, g, or t
  modified_base (268)..(268): a, c, t, g, unknown or other
  misc_feature (268)..(268): n is a, c, g, or t
  modified_base (280)..(280): a, c, t, g, unknown or other
  misc_feature (280)..(280): n is a, c, g, or t
  modified_base (378)..(378): a, c, t, g, unknown or other
  misc_feature (378)..(378): n is a, c, g, or t
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagcttgggttttcctcgttgctcttttaagnggtgtccagtgtcaggtgcagctggtggagtcgtgggggagcgtggtccagcctgggagtccctnagactctcctgtttacgcctntggatcaccttnagtagttatcctttgctacgtgggtcctcaggcctccgagggccaagggggctggggagtggggtgctagtttactcctctagtttgacgtggaaaanaaactaataaactactaacgaggtacgtaccgtccgggtacggggacctactaccaacctactacctaaccgaaacgtaactaaagttaacgaaacgtaacgtacgtacttagttacgacgtaactaaagtacgaacgagcgtagagacgtcgtaggacgacgcggtcttagtagttacgttacgttggtttcggtttcggttcgtcggtaccggtcgggtacggggtacttaccgtcgaacggtcg

SEQ ID NO: 327379 - DNA, 703 bp, Homo sapiens
  misc_feature: GZ8MTXP01ER1U5.10.53.E09.1.454.CMB.2.raw
  modified_base (251)..(251): a, c, t, g, unknown or other
  misc_feature (251)..(251): n is a, c, g, or t
  modified_base (270)..(270): a, c, t, g, unknown or other
  misc_feature (270)..(270): n is a, c, g, or t
  modified_base (345)..(345): a, c, t, g, unknown or other
  misc_feature (345)..(345): n is a, c, g, or t
  modified_base (373)..(373): a, c, t, g, unknown or other
  misc_feature (373)..(373): n is a, c, g, or t
  modified_base (390)..(390): a, c, t, g, unknown or other
  misc_feature (390)..(390): n is a, c, g, or t
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagcgtgggttttcctcgttgcttcttttaagaggtgtccagtgtcaggtgcagcgtggtggagtcgtgggggagcgtggtccagccgtgggacgtccctnagctctcctgttacgcctntgatcactcagtagttactcctttgcctacgtcgggtccctcgaggcctcgaggcgaaggggctgggaggtgggngctagttactcctctatttgatggaaanactaagtaaatacctanacggacgtaccgtccgggttacgggaccgtactccaacctactacctaaccgtaaaacggtaaccttaaagtttacggaaaacgtaaaccgtaaccggttactttacgggttttacctaggtaaactaaacgtacggaaaccgtaacgcccgttaggaaggtacggtccgtaggaaccggaaccgaaccgggttcgttaggtttagtttaacgtttaccggtttggttttaccgggttttcggttccgttggtacccgggttaacggggttacgggggtaaccttacccggttaacgttaaccgggtcccggg

SEQ ID NO: 327380 - DNA, 687 bp, Homo sapiens
  misc_feature: GZ8MTXP01A5NZ2.10.53.E09.1.454.CMB.2.raw
  modified_base (241)..(241): a, c, t, g, unknown or other
  misc_feature (241)..(241): n is a, c, g, or t
  modified_base (305)..(305): a, c, t, g, unknown or other
  misc_feature (305)..(305): n is a, c, g, or t
  modified_base (345)..(345): a, c, t, g, unknown or other
  misc_feature (345)..(345): n is a, c, g, or t
  modified_base (362)..(362): a, c, t, g, unknown or other
  misc_feature (362)..(362): n is a, c, g, or t
tcagcatagtagtgcacgaccggtgctcgatttagagagagtgtgttgggtttgggggagacgagcccagcactggaagtcgccggtgtttccattcggtgatcatcactgaacacagaggactcaccatggagtttgggctgagcttgggttttcctcgttgctcttttaagaggtgtccagtgtcaggtgcagctggtggagtcgtgggggagcgtggtccagccgtgggacgtccctnagactctcctgttacgcctctggacttcaccttcagtagttactcctttgctacgtgggtcctnaggctccgaggcaggggctggagtgggtgctagttatctntagtttgacgtgggaanaacaaagttaaactaacctaacgaaggtacgtaacccgttcccgggttacgggggaccctattacccgaaaccctaacttacctaaccgtaaacgtaaacctaaagtttacgaaacgtaaacctaacggtcttacggtttactacgtaacgtaaacgttacggtaaacgacgtaccgtaggaacggacgacgtacggaaggaccgtacgggtacgttgtgttaagtttaacgttcggtttcggttttcggttcgtcgttacggttcgggttacgggggttaacttaccgtcgtacgtacggacggtcgggaaccgtaacccgggg

SEQ ID NO: 327381 - DNA, 783 bp, Homo sapiens
  misc_feature: GZ8MTXP01EN9W4.10.53.E09.1.454.CMB.2.raw
  modified_base (248)..(248): a, c, t, g, unknown or other
  misc_feature (248)..(248): n is a, c, g, or t
  modified_base (286)..(286): a, c, t, g, unknown or other
  misc_feature (286)..(286): n is a, c, g, or t
tcagcatagtagtgcacgaccggtgctcgatttagagagagtgtgttgggtttgggggagacgagcccagcactggaagtcgccggtgtttccattcgttgatcatcactgaacacagaggactcaccatggagtttgggctgagtcttgggtttttcctcgttgcttcttttaagaggtgtccagtgtcaggtgcagcgtggtggagtcggtgggggagcggtggtccagccgtgggacgtcccctnagtctctccttgtttacgcctgtggtacttctaccttnagtagttacttccctttgctacgttcgggtcccgtcgacggcctaccgagggcggaaggggggtcttaggggggacggttggggggtcggtacttaaggtttattccgttagttaagttttggaacggttagggaaacgtaaaacttaaaattaaaaacgtaaccttaaacgaagggtaaccggtaacccgttcccgggttaccgggggaccctagttaccaaaccctacttacctaaaccgaaagtaaacttaaagttaacgaaaacgtaacgtacgtacgttacgttactagtaacgtaaacgttacggaaactacggtaccgtaggaacggacggtacgtacggaacggacgtaaccgggtcgttacggttagttaacgtttacgttttgggttttcggttttcggttacgtacggttaccgggttcgggttacgggggttaacttaccgttcgaacggtccggttacgggtccggggttccggtaacccgggg

SEQ ID NO: 327382 - DNA, 748 bp, Homo sapiens
  misc_feature: GZ8MTXP01CWTC7.10.53.E09.1.454.CMB.2.raw
  modified_base (252)..(252): a, c, t, g, unknown or other
  misc_feature (252)..(252): n is a, c, g, or t
  modified_base (269)..(269): a, c, t, g, unknown or other
  misc_feature (269)..(269): n is a, c, g, or t
  modified_base (273)..(273): a, c, t, g, unknown or other
  misc_feature (273)..(273): n is a, c, g, or t
  modified_base (283)..(283): a, c, t, g, unknown or other
  misc_feature (283)..(283): n is a, c, g, or t
  modified_base (287)..(287): a, c, t, g, unknown or other
  misc_feature (287)..(287): n is a, c, g, or t
  modified_base (310)..(310): a, c, t, g, unknown or other
  misc_feature (310)..(310): n is a, c, g, or t
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtggagtcgtgggggagcgtggtccaggccgtggggacgtccctnagtactctcctgttacncctntgatcacttnagtnttatccttgctacgtgggtcctnaggcctccgaggcgaagggggctgggaggtggggtcgctagtttatccgtactagtttggaatgggaaacaactaataaactactaacgacggtacgtaccgttccgggtacggggtaccgtacttccaacctactacctaaaccgaaaagtaaccttaaagtttaacggaaaacgtaaaccgtaacgttaccgtttacggttttaccgtaacggtaaaccgtaaaacgttaacggaaaaccgtaacggtacccgtaaggtaacggtaacggtaccggttaagggaaaccgggtaaccggtaaccgggtacgttagggtttacgttaaacgttttaccggtttgggttttaccgggttttcgggtttaccgttcgggttaccggttaaccggggttacgggggttaacttacccgttaacgttaaccggtaacccggg

SEQ ID NO: 327383 - DNA, 637 bp, Homo sapiens
  misc_feature: GZ8MTXP01CF179.10.53.E09.1.454.CMB.2.raw
  modified_base (244)..(244): a, c, t, g, unknown or other
  misc_feature (244)..(244): n is a, c, g, or t
  modified_base (264)..(264): a, c, t, g, unknown or other
  misc_feature (264)..(264): n is a, c, g, or t
tcagcatagtagtgcacgaccggtgctcgatttagagagagtgtgttgggtttgggggagacgagcccagcactggaagtcgccggtgtttccattcggtgatcatcactgaacacagaggactcaccatggagtttgggctgagtcttgggttttcctcgttgcttcttttaagaggtgtccagtgtcaggtgcagctggtggagtcgtgggggaggcgtggtccagccgtgggacgtccctnagactctcctgttacgcctntggattcacttcagtagttatcctttgctacgtcgggtccctcgaggcctccgaggtccgaagggggtctgggaggtggggtgctagttactctctagtttgagtggagtaactaaataaataactaacgaaggacgtaacccgttcccgggttacggggcccgtattccaaccctactacctaccaaagtacgtaaattagaaacgaacctacgtacttacgttctagtactaaagtacggaactagcctaggacgagtcgtaggacggacgtacggtcttgtgttaacttacgttggtttcgtttggttctggttaccgttcggttacggggtaactacccgtcgcgtcgttacggtcgggcgtaaccggg

SEQ ID NO: 327384 - DNA, 646 bp, Homo sapiens
  misc_feature: GZ8MTXP01DCHTY.10.53.E09.1.454.CMB.2.raw
  modified_base (261)..(261): a, c, t, g, unknown or other
  misc_feature (261)..(261): n is a, c, g, or t
  modified_base (341)..(341): a, c, t, g, unknown or other
  misc_feature (341)..(341): n is a, c, g, or t
  modified_base (456)..(456): a, c, t, g, unknown or other
  misc_feature (456)..(456): n is a, c, g, or t
tcagcatagtagtgcacgaccggtgctcgatttagagagagtgtgttgggtttgggggagctacaacaggcaggcaggggcagcaagatggtgttgcagacccaggtcttcatttctctgttgctctggatctctggtgccgtacggggacatcgtgatcgacccagtctccagacctccctgcctgtcgtctcgtgggcgaggacgggccacatcaactgacaagtccagccagtagttgttttatcagtcctaccgaanaaataacgaactactagcttaggaaccagacaagaaaccgaggaaccacgtccctactaacgctgactactactttacgngggactacgtaccgtaacccggggacgtccccccgggggtacctaggaccgtatcgaaggtcggcgagggtcgggtacgagggactagtacttccactctacacatcagcacgcngcagctagaagcggtcggtacgtattaagtttactacgtcgtactaacgtaccttaaactaacttaaccttacccgtaaccctacttacctaaacgttccgtttaacccggacccggttaacgggaaacccgttaaagggtaacggaaacgtaaccgttaaaccgaaacgttacgtcggttcggtaaccg

SEQ ID NO: 327385 - DNA, 655 bp, Homo sapiens
  misc_feature: GZ8MTXP01DUETS.10.53.E09.1.454.CMB.2.raw
  modified_base (250)..(250): a, c, t, g, unknown or other
  misc_feature (250)..(250): n is a, c, g, or t
  modified_base (269)..(269): a, c, t, g, unknown or other
  misc_feature (269)..(269): n is a, c, g, or t
  modified_base (284)..(284): a, c, t, g, unknown or other
  misc_feature (284)..(284): n is a, c, g, or t
  modified_base (371)..(371): a, c, t, g, unknown or other
  misc_feature (371)..(371): n is a, c, g, or t
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagtcttgggttttcctcgttgcttcttttaagaggtgtccagtgtcaggtgcagctggtggagtcgtgggggagcgtggtccagcctgggacgtccctnagactctcctgttacgctntggatcacttcagtnttatccttgcacgtcggtctcaggctcgaggcgaaggtgcgtgggaggtgggtcgactacgttatcctagtagtttgagtagggaanaacgtaaataaactactacgagacgtacgtccgtcgggacgtatacactactactaccaaagaactaatagaaacgtaactacgtacgttacggtttacgtaacgtaactaaaacgtagaaaccgtagtaccgtagaacgtacggtacgtacgggaacggtaaccgtaaccggggttcgtttaggttaggtttaactttaacgtttcggttttccggttttaggttcgttacggtaaccggttccgggtacgggggttaaactaacccgtttaacgtaaccggg

SEQ ID NO: 327386 - DNA, 552 bp, Homo sapiens
  misc_feature: GZ8MTXP01E49NJ.10.53.E09.1.454.CMB.2.raw
  modified_base (239)..(239): a, c, t, g, unknown or other
  misc_feature (239)..(239): n is a, c, g, or t
  modified_base (356)..(356): a, c, t, g, unknown or other
  misc_feature (356)..(356): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtggagtcgtgggggagcgtggtccagcctgggagtccctnagactctcctgtttagcctctggattcaccttcagtagttatcctttgcacgtgggtccctcaggcctccgaggcaagggggctgggagtggggtgcagttatctcatttgatgganaacaaataaataactacaagagactccggttcggggccattcacatactacaaagacaaattagaagaacacgtctgttctagacaaataggaacagcctagagagcgtagaggacacggctgtgtaattacttgttcgtttgttctgacgttcggttacggggtaataccttcgagcgacgtcgggccgaacggg

SEQ ID NO: 327387 - DNA, 696 bp, Homo sapiens
  misc_feature: GZ8MTXP01APIUC.10.53.E09.1.454.CMB.2.raw
  modified_base (192)..(192): a, c, t, g, unknown or other
  misc_feature (192)..(192): n is a, c, g, or t
  modified_base (241)..(241): a, c, t, g, unknown or other
  misc_feature (241)..(241): n is a, c, g, or t
  modified_base (260)..(260): a, c, t, g, unknown or other
  misc_feature (260)..(260): n is a, c, g, or t
  modified_base (272)..(272): a, c, t, g, unknown or other
  misc_feature (272)..(272): n is a, c, g, or t
  modified_base (302)..(302): a, c, t, g, unknown or other
  misc_feature (302)..(302): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagcttgggttttcctcgttgcttcttttaagaggtgtccagtgtcaggtncagctggtggagtcgtgggggagcgtggtccagccgtgggacgtccctnagctctcctgttacgcctntggattcacttnagtagttatcctttgctacgtgggtccgtnacggctccgaggcgaagggggctagggaggtggggtagctagtttatctctagtttgaatgggaaataactaaaagttaaactaaaccgttaacgaaggtaccggtacccgtttcccgggttccgggggaccctaatttacccaaaccctacgttaccctaacccgaaaagtaacctaaatttagaaaacgaacctaaccgtctttacgtttacgagtaacctaaacgtacggaaaccgtacgaccctaaggaaaccggtagccgtaggaacggaccgtacgggtacttcggttgtaagtttcgttggtttcggtttgttcgtcggttaaccggtttccggttaacggggtaacttcgttaacgacggtccgttacggtcgggccgtaaccggg

SEQ ID NO: 327388 - DNA, 579 bp, Homo sapiens
  misc_feature: GZ8MTXP01ET071.10.53.E09.1.454.CMB.2.raw
  modified_base (254)..(254): a, c, t, g, unknown or other
  misc_feature (254)..(254): n is a, c, g, or t
  modified_base (325)..(325): a, c, t, g, unknown or other
  misc_feature (325)..(325): n is a, c, g, or t
tcagcatagtagtgcacgaccggtgctcgatttagagagagtgtgttgggtttgggggagctacaacaggcaggcaggggcagcaagatggtgttgcagacccaggtcttcatttctctgttgctctggatctctggtgccgtacggggacatcgtgatcgacccagtctccagactccctgcctgtgtctcgtgggcgagacgggccacatcaactgacaagtccagccagtagttgtttatcagctaccganaataagaactactagcttaggaaccagacaagaaaccaggacacgcctactaagctagctactatttacgngggactactccgtaacccgggaacgtccccccggggtccctaggaccgtattccgaaggtcggcgagggccgggtctaggggacaggtactttccactctacacatcacgcacgcctgcgagcgtagaagacggtggcgtactagtttatacgtgtacagactactattactacgtaaccctattacacttacgttccggccgttacggaaccaaggtggaacgtaactacgaaacgacgggggtcttcggtcg

SEQ ID NO: 327389 - DNA, 763 bp, Homo sapiens
  misc_feature: GZ8MTXP01D978F.10.53.E09.1.454.CMB.2.raw
  modified_base (250)..(250): a, c, t, g, unknown or other
  misc_feature (250)..(250): n is a, c, g, or t
  modified_base (264)..(264): a, c, t, g, unknown or other
  misc_feature (264)..(264): n is a, c, g, or t
  modified_base (339)..(339): a, c, t, g, unknown or other
  misc_feature (339)..(339): n is a, c, g, or t
  modified_base (348)..(348): a, c, t, g, unknown or other
  misc_feature (348)..(348): n is a, c, g, or t
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctgggtggaggtcgtgggggagcgtggtccagccgtgggagtcccnagctctctgttacnctctggtatcaccttcagttattactcctttgctacgtcgggtccgtcgaggctccgaggcgaagggggctgggnggttggggngctagtttactcctactagtttgagttaggaaacgtaactaaagtaaatactaacaacggacgttacccgttcccggggttaccggggcccttaagttcccaaccgtataccctaacccaaaaggtacctaaagtttacggaaaacgaaaccgtaccgttacgtttacggtttacgtaacgtaaccgtaaaagttacggaaaccgacgtacccgttaggaaaccgggtagttaccggtacgggtaaacgggaacccgtaaaccggggtcgtttaggttttaacggtttaaacgtttccggttttaacgggtttttcgggtttttacggtttccggtttaacgggtaaacccggtttccgggggtttaaccgggggtaacctttaacccggttaaccgttaacggggtaaccccgg

SEQ ID NO: 327390 - DNA, 644 bp, Homo sapiens
  misc_feature: GZ8MTXP01B5RJ2.10.53.E09.1.454.CMB.2.raw
  modified_base (346)..(346): a, c, t, g, unknown or other
  misc_feature (346)..(346): n is a, c, g, or t
  modified_base (437)..(437): a, c, t, g, unknown or other
  misc_feature (437)..(437): n is a, c, g, or t
  modified_base (482)..(482): a, c, t, g, unknown or other
  misc_feature (482)..(482): n is a, c, g, or t
tcagcatagtagtgcacgaccggtgctcgatttagagagagtgtgttgggtttgggggagctacaacaggcaggcaggggcagcaagatggtgttgcagacccaggtcttcatttctctgttgctctggatctctggtgccgtacggggacatcgtgatcgacccagtctccagactccctgcctgtgtctcgtgggcgaggacgggccacatcaactgacaagtccagccagtagttgttttactcagcctaccgaactaaagtaaacgtaactacgttagcttaggtaaccagacaacgaaaccgaggacacgccctacgtaagcctagctactacgtttacgngggacctacgtacccgtaacccggggacgtccccccggggtccaggacccgtagtcgaaggtcggcgacgggtcgggtcagggactacgtnttaccgacttcacaccatccgagccacgcctagcgagctagaagngggtcgtcggtacttagtttaactacgttgacgtacgtactaacgttattaaccgtaccgttaacccctattaccgtaccgttacgttacccggtccggttaacggggaaaccttaaagggttggaactaacttaaaccggaacgttacgtggttcgtaacg

SEQ ID NO: 327391 - DNA, 753 bp, Homo sapiens
  misc_feature: GZ8MTXP01CGAMQ.10.53.E09.1.454.CMB.2.raw
  modified_base (247)..(247): a, c, t, g, unknown or other
  misc_feature (247)..(247): n is a, c, g, or t
  modified_base (259)..(259): a, c, t, g, unknown or other
  misc_feature (259)..(259): n is a, c, g, or t
  modified_base (335)..(335): a, c, t, g, unknown or other
  misc_feature (335)..(335): n is a, c, g, or t
tcagcatagtagtgcacgaccggtgctcgatttagagagagtgtgttgggttttcctcgttgctcttttaagaggtgtccagtgtcaggtgcagctgggtggagtcgtggggggaggcgtggtccagcctgggaggtccctcagactctcctgtttagcctctggattcaccttcagtagttatcctttgcacgtgggtccgtcaggctccaggcgaaggggctgggagtgggtggctagttatctnatttgatggaanaacaaataaatactacagagactcggtcgggcatcaccatctaccaaagactaattagaagaacacgcttgtttcngacaaatgaaacagcctagagacgctggaacggacacggtcttggttgttatttacgttggtttcgtttggttcgtgtacgttcgggtcgggggtaatcggtccttcgacggtccgtacgggtcgggggacccgacggggtacccgtaccccggttcgggtccccgtaccccggggttcccgttacccgtcccgtacccggtacccccgtaccccgaaaccccggtaaaccggggtcccccgtaccgtttccccgggttaccccctttccccccgtccgggtaaccccctacccccgtttacccctaccccggaaaacggtcccggtcccgttaaccccgttccggggttccgggggaacccacccggaaccgggccccgggtccccggttcgggggtcccgttaaccggtccccggg

SEQ ID NO: 327392 - DNA, 598 bp, Homo sapiens
  misc_feature: GZ8MTXP01BF4MD.10.53.E09.1.454.CMB.2.raw
  modified_base (248)..(248): a, c, t, g, unknown or other
  misc_feature (248)..(248): n is a, c, g, or t
  modified_base (262)..(262): a, c, t, g, unknown or other
  misc_feature (262)..(262): n is a, c, g, or t
  modified_base (266)..(266): a, c, t, g, unknown or other
  misc_feature (266)..(266): n is a, c, g, or t
  modified_base (277)..(277): a, c, t, g, unknown or other
  misc_feature (277)..(277): n is a, c, g, or t
  modified_base (284)..(284): a, c, t, g, unknown or other
  misc_feature (284)..(284): n is a, c, g, or t
  modified_base (345)..(345): a, c, t, g, unknown or other
  misc_feature (345)..(345): n is a, c, g, or t
  modified_base (357)..(357): a, c, t, g, unknown or other
  misc_feature (357)..(357): n is a, c, g, or t
  modified_base (371)..(371): a, c, t, g, unknown or other
  misc_feature (371)..(371): n is a, c, g, or t
  modified_base (479)..(479): a, c, t, g, unknown or other
  misc_feature (479)..(479): n is a, c, g, or t
  modified_base (504)..(504): a, c, t, g, unknown or other
  misc_feature (504)..(504): n is a, c, g, or t
tcagcatagtagtgcacgaccggtgctcgatttagagagagtgtgttgggtttggggagctctgggagacgagcccagcactggaagtcgccggtgtttccattcggtgatcatcactgaacacagagactcaccatggagttgggctgagctgggttttcctcgttgctcttttaagaggtgtccagtgtcaggtgcagcgtggtggagtcgtgggggagcgtggtccaggccgtgggacgtccctnagctctctgtttancctntgatcaccttnagtattntcctttgcacgtggtcctcgaggctccgaggcgaggggctgggagtggtgcagttctcctntattgatggaanaacaataaatctanagagaccttcgggtcgggctatctacactactacaaagactaattagaaacgaactacgtacttacgttcgtacgtaacgtaaatacgtaaacacgtcctaggaacgngtaccgtaggacggaacgaaccggngttgtacgttagttaacgttgttttccggtttggttcgtaacggtaccggtaacgggttacgggggtacttacccgttcgttaacggtaaccgg

SEQ ID NO: 327393 - DNA, 565 bp, Homo sapiens
  misc_feature: GZ8MTXP01EMSZF.10.53.E09.1.454.CMB.2.raw
  modified_base (255)..(255): a, c, t, g, unknown or other
  misc_feature (255)..(255): n is a, c, g, or t
  modified_base (271)..(271): a, c, t, g, unknown or other
  misc_feature (271)..(271): n is a, c, g, or t
  modified_base (358)..(358): a, c, t, g, unknown or other
  misc_feature (358)..(358): n is a, c, g, or t
  modified_base (371)..(371): a, c, t, g, unknown or other
  misc_feature (371)..(371): n is a, c, g, or t
  modified_base (431)..(431): a, c, t, g, unknown or other
  misc_feature (431)..(431): n is a, c, g, or t
  modified_base (438)..(438): a, c, t, g, unknown or other
  misc_feature (438)..(438): n is a, c, g, or t
  modified_base (464)..(464): a, c, t, g, unknown or other
  misc_feature (464)..(464): n is a, c, g, or t
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctgggtggaggtcgtggggggagcggtggtccaggccgtgggacgtccctnagctctctgttagctntgatcacttcagtagttatcctttgctacgtcgggtcctcaggcctccgaggcgaagggggtctgggaggtgggtgctagttctctntattgatggaaanaactaagtaaatactacagagtacgtcggtcgggctatcacatcacaaagactaatgaanacacgtntgttctgacaatgaactcgctagagngtcgtagacgcgaagtcgttagtaacttagttacgttcgtttcgtttcggttctggttcgttcgggtacggggtacttaccgttaacgttaacgtaaccgg

SEQ ID NO: 327394 - DNA, 604 bp, Homo sapiens
  misc_feature: GZ8MTXP01CD8HV.10.53.E09.1.454.CMB.2.raw
  modified_base (303)..(303): a, c, t, g, unknown or other
  misc_feature (303)..(303): n is a, c, g, or t
  modified_base (452)..(452): a, c, t, g, unknown or other
  misc_feature (452)..(452): n is a, c, g, or t
tcagcatagtagtgcacgaccggtgctcgatttagagagagtgtgttggggtttggggagacgagcccagcactggaagtcgccggtgtttccattcggtgatcatcactgaacacagaggactcaccatggagtttttggctgagctggggttttccttgttgctatttcaaaaggtgtccactgtgaggttcaactggtggagacgtggaggaggctggatcagccgtgggggtccctgagactctcctgtgcagcctcgtgggtcagcatcagtaacgactacatcgaccgtgggccccncaggcctccgaggggaacggggctgggagtgggtctgagttatagaaacgagatggacaactacaattaattattcgtacgtacgttaccggtacggaacgggtcccggttacaccctctacaggacacacttaccaaactacattctnactctacgacatgaccaagaactctagacgtacgaccgaacgaaccgaccggccctaacttaagtttagttcggtacgaccgtacgacttacgttcggacccttaacggcttaacgtaacgttccgggacggggaacccgaaggggtccccg

SEQ ID NO: 327395 - DNA, 780 bp, Homo sapiens
  misc_feature: GZ8MTXP01D9MN1.10.53.E09.1.454.CMB.2.raw
tcagcatagtagtgcacgaccggtgctcgatttagagagagtgtgttgggtttgggggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtggagtcgtgggggaggcgtggtccagccgtgggacgtccctcgagaccttctccttgtttacgcccttcgtggtattccaccttcagttagttactcctttgctacgtgggtcccgtcgaggcctccgaggcgaaagggggtctaggggaggttgggggtcggtactaggtttactcgttactagttttgacgttagggaaagtaaacctaaaattaaaacgtaaaccctaacgaagggtaacggtacccggttaccgggtttaccgggggaccccttaattaccccaaaccctaacttacccttaaacccgaaaaacggtaaacttaaacggtttaaacggaaaaacggtaaaccgtaaccgttcgttacgtttaccgtaaggtaaactaaaacgttacgggaaaacgtacggtaccttaaggaacgtaacggcgttaggaaacgggtaccgtaccggtgttagttggttaaactttcgttgggtttaccggttttggtcgttacggttacggttccgggttacgggggttaaccttaccgttaacgcggtacgcgggttccggggccgtaaccgggg

SEQ ID NO: 327396 - DNA, 603 bp, Homo sapiens
  misc_feature: GZ8MTXP01EKIPO.10.53.E09.1.454.CMB.2.raw
  modified_base (277)..(277): a, c, t, g, unknown or other
  misc_feature (277)..(277): n is a, c, g, or t
  modified_base (349)..(349): a, c, t, g, unknown or other
  misc_feature (349)..(349): n is a, c, g, or t
  modified_base (352)..(352): a, c, t, g, unknown or other
  misc_feature (352)..(352): n is a, c, g, or t
  modified_base (367)..(367): a, c, t, g, unknown or other
  misc_feature (367)..(367): n is a, c, g, or t
tcagcatagtagtgcacgaccggtgctcgatttagagagagtgtgttgggtttggggctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtggagtcgtggggggagcgtggtccagccgtgggacgtccctcagtactctcctgttagcctctgattcactnagtagttatccttgctacgtgggtcctcaggctccgagggcaagggggctggggagtggggtagctagttanctntatttgatggacaanaaaaataaatctaacagacaccgttccggtcggggcctattcactatctacaaagactaaattagaaacgaacacgtcttgttactagaacaaatacggaaacacgaccgtagaagacgacgtaggacggaccgacggtgtaagttaggttatttacgttggtttcgtttcggttgttcggttaccgtcggggttacgggggtaacttaccgttcaacggtccgaacggtcggggg

SEQ ID NO: 327397 - DNA, 564 bp, Homo sapiens
  misc_feature: GZ8MTXP01DTJCM.10.53.E09.1.454.CMB.2.raw
  modified_base (320)..(320): a, c, t, g, unknown or other
  misc_feature (320)..(320): n is a, c, g, or t
  modified_base (437)..(437): a, c, t, g, unknown or other
  misc_feature (437)..(437): n is a, c, g, or t
  modified_base (447)..(447): a, c, t, g, unknown or other
  misc_feature (447)..(447): n is a, c, g, or t
  modified_base (461)..(461): a, c, t, g, unknown or other
  misc_feature (461)..(461): n is a, c, g, or t
  modified_base (465)..(465): a, c, t, g, unknown or other
  misc_feature (465)..(465): n is a, c, g, or t
tcagcatagtagtgcacgaccggtgctcgatttagagagagtgtggttggggtttgggggagctacaacaggcaggcaggggcagcaagatggtgttgcagacccaggtcttcatttctctgttgctctggatctctggtgcctacggggacatcgtgatgacccagtctccagactccctgcctgtgtctcgtggggcgagacgggccaccatcaactgacaagtccagccagtagttgtttatcagctaccgaacaataagaactactagcttaggaccagacaagaaacaggacagcctacaagctgctcatttacngggcacgtacgacccggggaatcccccgggggtcctagaccgtatccaaggtcggcgaggcggggttcaggggacagtactttcactctacacatcagcagcctgcaggctagaagngtcggcggtntaaggtttatacgngtanaagctaacttattaactaccgtaaccctattacacttacgttccggcccgttaggggaaccaaagtgggaaataactaacgaaacgactggttggaacc

SEQ ID NO: 327398 - DNA, 595 bp, Homo sapiens
  misc_feature: GZ8MTXP01EWBAA.10.53.E09.1.454.CMB.2.raw
  modified_base (561)..(561): a, c, t, g, unknown or other
  misc_feature (561)..(561): n is a, c, g, or t
tcagcatagtagtgcacgaccggtgctcgatttagagagagtgtgttgggttttcctcgttgctcttttaagaggtgtccagtgtcaggtgcagctggtggagtctggggggaggcgtggtccagcctgggaggtccctcagactctcctgtttagcctctggattcaccttcagtagttatcctttgcactgggtccgtcaggctccaggcaaggggctggagtgggtggcagttatctcatttgatggagacaataaatactacagagactccgtcgggccattcaccatctaccaaagacaaatttgaagaacacgctgtttctgacaaatgaacagcctgagagctagaggacacggactgtgtattactgttcgtttggttctgtaccgtcggtacggggaactaccgttcagcgacgtggggcctagggccgacccgtcggtcctaccgtccgtccttcgaccgccctcccaccgaacggcccacgtccggtcccttccccgtcgcccaaccccgtcccttaccgaacgacgcccacgttccgttcgggggaccnccgaggcccggcccgtcgggcctcggccgtcggg

SEQ ID NO: 327399 - DNA, 806 bp, Homo sapiens
  misc_feature: GZ8MTXP01ARTLW.10.53.E09.1.454.CMB.2.raw
tcagcatagtagtgcacgaccggtgctcgatttagagagagtgtgttgggtttggggctgggagacgagcccagcactggaagtcgccggtgtttccattcggtgatcatcactgaacacagaggactcaccatggagtttgggctgagcttgggttttcctcgttgcttcttttaaggaggtgtccagtgtcaggtgcagctggtggagtcgtgggggagcgtggtccaggccgtggggacgtccctgagtaccttctccttgtttacgccttcgtggtacttcctaccttcgaagttacgttactcccgtttgcctacggtcgggtccctacgacggcctaccgagggcggaaagggggtctaggggaggttgggggtcgacttaggttactcgtacgtaagtttggagtacgggaataaactaaaaaattaaacgtaaccgtaacgaacggtacgggtaccccgtttacccggggttaccgggggacccttaacttaccctaacccgtaacgttaccctaaacccgtaaaacggtaacctttaaaacgtttaacggaaaacgtaaacccgtaaccgggttactttaacggtttaccgtaacgtaaacgtaaaacgttacgaaaccgtaacggtacccgtaaggacggtaaggtaccgtaagggacggaccgtaacggtcgttaaggtttacgttagtttacgtttcgggttttcggtttcggttaccgttcggttaccggttcccgggggttacggggtaaaccttccggttacgacggtcccggttaaccgggtcccggggg

SEQ ID NO: 327400 - DNA, 603 bp, Homo sapiens
  misc_feature: GZ8MTXP01BD0FD.10.53.E09.1.454.CMB.2.raw
  modified_base (260)..(260): a, c, t, g, unknown or other
  misc_feature (260)..(260): n is a, c, g, or t
  modified_base (297)..(297): a, c, t, g, unknown or other
  misc_feature (297)..(297): n is a, c, g, or t
  modified_base (328)..(328): a, c, t, g, unknown or other
  misc_feature (328)..(328): n is a, c, g, or t
  modified_base (383)..(383): a, c, t, g, unknown or other
  misc_feature (383)..(383): n is a, c, g, or t
  modified_base (460)..(460): a, c, t, g, unknown or other
  misc_feature (460)..(460): n is a, c, g, or t
tcagcatagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagacctccctgcctgtgtctcgtggggcgaggacgggccaccatacaactgacaagtccagccagtagttgttttactcagctaccgaanaaataagaactacttagcttaggaccagcaagaaacnggacagcctacaagctgctctaagtttacgngggactacgtccgtaacccggggaacttcccccgggggtaccctaggaacccgtnttccgaagtcggcgaggtccggggtcagggacaggtactttcacttcacacatcagcacgtctgacaggctagaagngtcggtcggtcttaagtttactacgtgtacaacgtctaacttattactaaccgtaaccctattaccacttaccgttccggccgttacgggaaccttaagggtaagacgtaacgtaacgaaacgttacgttcgaacgggtaacc

SEQ ID NO: 327401 - DNA, 796 bp, Homo sapiens
  misc_feature: GZ8MTXP01EZYA5.10.53.E09.1.454.CMB.2.raw
tcagcatagtagtgcacgaccggtgctcgatttagagagagtgtgttgggtttggggctgggagacgagcccagcactggaagtcgccggtgtttccattcggtgatcatcactgaacacagaggactcaccatggagtttgggctgagctgggttttcctcgttgcttcttttaagaggtgtccagtgtcaggtgcagcgtggtggagtcgtgggggagcgtcggtccagccgtgggacgtccctcgagtacctctccttgtttacgcctcgtggtattcctacctcaggttagttacttccgtttggaccgtaccgttggggttccccgtcgacgggtcctaccgaagggaccgaaaggggggtcttaggggacgggttgggggtacggtacgtaaggttacttcgttacgttaagttttgggaagttaacgggggtaaataaaaccgtaaaaaaaatttaaaaaaccgtaacgtttaaaccgaaacggggtaacgggtaaccccgtttcccgggggtttaacccgggggaccttaaacgtttacccaaacccgtaacgttaacccgtaaaaccgtaaaacggtaacgtttaaaacgtttaacggtaaaacgtaaaccgtaacgttaccttgttacttaacggactaaagtaacgaacgaacgtaccgtagaacgagtcgtacggacggacgtaccggtgtaagttcgttaattacgtttcgttacgtttcggttcgttcgttacggttcggtacggggttaactaccgttagcgtaaccgcggggtaaccggg

SEQ ID NO: 327402 - DNA, 529 bp, Homo sapiens
  misc_feature: GZ8MTXP02J1W2B.10.53.E09.1.454.CMB.2.raw
  modified_base (339)..(339): a, c, t, g, unknown or other
  misc_feature (339)..(339): n is a, c, g, or t
  modified_base (353)..(353): a, c, t, g, unknown or other
  misc_feature (353)..(353): n is a, c, g, or t
  modified_base (370)..(370): a, c, t, g, unknown or other
  misc_feature (370)..(370): n is a, c, g, or t
tcagcatagtagtgcacgaccggtgctcgatttagagagagtgtgttgggtttggggctgggagacgagcccagcactggaagtcgccggtgtttccattcggtgatcatcactgaacacagaggactcaccatggagtttgggctgagcgtgggttttcctcgttgctcttttaagaggtgtccagtgtcaggtgcagctggtggagtctgggggagcgtggtccagcctgggaggtccctcagactctcctgttagcctctggattcaccttcagtagttatcctttgcactgggtcctcaggctccaggcaaggggctgggagtgggtgcagttanctcatttgatgganacaataaatctacaganactccggtcggggccattcaccatctaccaaagacattagaagaacacgtctgttactgacaaatgaacagcctagagagctgagacgacgcgtcgtgtatactgttcgtttcgttcgtgtcgtcggtcgggtacgtactacgtacgacgacgtcgggg

SEQ ID NO: 327403 - DNA, 520 bp, Homo sapiens
  misc_feature: GZ8MTXP02HUNRP.10.53.E09.1.454.CMB.2.raw
  modified_base (365)..(365): a, c, t, g, unknown or other
  misc_feature (365)..(365): n is a, c, g, or t
  modified_base (461)..(461): a, c, t, g, unknown or other
  misc_feature (461)..(461): n is a, c, g, or t
  modified_base (475)..(475): a, c, t, g, unknown or other
  misc_feature (475)..(475): n is a, c, g, or t
  modified_base (478)..(478): a, c, t, g, unknown or other
  misc_feature (478)..(478): n is a, c, g, or t
  modified_base (481)..(481): a, c, t, g, unknown or other
  misc_feature (481)..(481): n is a, c, g, or t
  modified_base (485)..(485): a, c, t, g, unknown or other
  misc_feature (485)..(485): n is a, c, g, or t
  modified_base (487)..(487): a, c, t, g, unknown or other
  misc_feature (487)..(487): n is a, c, g, or t
  modified_base (489)..(489): a, c, t, g, unknown or other
  misc_feature (489)..(489): n is a, c, g, or t
  modified_base (491)..(491): a, c, t, g, unknown or other
  misc_feature (491)..(491): n is a, c, g, or t
tcagcatagtagtgcacgaccggtgctcgatttagagagagtgtgttgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcactgggtccgtcaggctccaggcaaggggctggagtgggtggcagttatctcatttgatggagacaaataaatactacagagactccgttcgggccgattcaccatctccaaaagacaatttgaagaacaacgctgtttctgacaaatgaaacagcctgagagctgagacaggctgngtattactgttcgtttgtctgactcgtacggggatacttcagcactggggcagggcaccctggtcaccgtctcctcacgcctccaccacgccgacncgtctccctcgccnccnccncacncncncncgcggcgaacgcgcgccgcgcgcgcgtcg

SEQ ID NO: 327404 - DNA, 514 bp, Homo sapiens
  misc_feature: GZ8MTXP02IUPTP.10.53.E09.1.454.CMB.2.raw
  modified_base (312)..(312): a, c, t, g, unknown or other
  misc_feature (312)..(312): n is a, c, g, or t
  modified_base (490)..(490): a, c, t, g, unknown or other
  misc_feature (490)..(490): n is a, c, g, or t
tcagcatagtagtgcacgaccggtgctcgatttagagagagtgtgttgggtttggggagctacaacaggcaggcaggggcagcaagatggtgttgcagacccaggtcttcatttctctgttgctctggatctctggtgcctacggggacatcgtgatgacccagtctccagactccctgcctgtgtctctgggcgagagggccaccatcaactgcaagtccagccagagttgtttatcagctccgaacaataagaactactagcttggtaccagcaagaaaccaggacagcctccaagctgctctatttacngggcatccgtaaccgggatccccggggtcctgaccgattcagtggcaggcgggtctgggacagatttccactctcaccatcagcacgcctgcaggctagaagatgcgcagtttatactgtcagcattatatacgtacccattcaactacttcggccctagggacctaaaggtggaaanaactacgaaaacgtacgtgtacgc

SEQ ID NO: 327405 - DNA, 556 bp, Homo sapiens
  misc_feature: GZ8MTXP02IE8B6.10.53.E09.1.454.CMB.2.raw
  modified_base (244)..(244): a, c, t, g, unknown or other
  misc_feature (244)..(244): n is a, c, g, or t
  modified_base (256)..(256): a, c, t, g, unknown or other
  misc_feature (256)..(256): n is a, c, g, or t
  modified_base (259)..(259): a, c, t, g, unknown or other
  misc_feature (259)..(259): n is a, c, g, or t
  modified_base (261)..(261): a, c, t, g, unknown or other
  misc_feature (261)..(261): n is a, c, g, or t
  modified_base (264)..(264): a, c, t, g, unknown or other
  misc_feature (264)..(264): n is a, c, g, or t
  modified_base (267)..(267): a, c, t, g, unknown or other
  misc_feature (267)..(267): n is a, c, g, or t
  modified_base (270)..(270): a, c, t, g, unknown or other
  misc_feature (270)..(270): n is a, c, g, or t
  modified_base (272)..(272): a, c, t, g, unknown or other
  misc_feature (272)..(272): n is a, c, g, or t
  modified_base (276)..(276): a, c, t, g, unknown or other
  misc_feature (276)..(276): n is a, c, g, or t
  modified_base (278)..(278): a, c, t, g, unknown or other
  misc_feature (278)..(278): n is a, c, g, or t
  modified_base (287)..(287): a, c, t, g, unknown or other
  misc_feature (287)..(287): n is a, c, g, or t
  modified_base (290)..(290): a, c, t, g, unknown or other
  misc_feature (290)..(290): n is a, c, g, or t
  modified_base (307)..(307): a, c, t, g, unknown or other
  misc_feature (307)..(307): n is a, c, g, or t
  modified_base (313)..(313): a, c, t, g, unknown or other
  misc_feature (313)..(313): n is a, c, g, or t
  modified_base (321)..(321): a, c, t, g, unknown or other
  misc_feature (321)..(321): n is a, c, g, or t
  modified_base (339)..(339): a, c, t, g, unknown or other
  misc_feature (339)..(339): n is a, c, g, or t
  modified_base (376)..(376): a, c, t, g, unknown or other
  misc_feature (376)..(376): n is a, c, g, or t
  modified_base (390)..(390): a, c, t, g, unknown or other
  misc_feature (390)..(390): n is a, c, g, or t
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagcgtggtttccgtcgtagctctttaagaggtgtcagtgtcaggtgcagctggtggagtcgtgggggagcgtggtccagcctgggagtccctnagctctctgttnctngntcnctnatntntctncngtggtctcngcncgaggcgagggtctggngtgggngctagttntcctatagttgagtgganaactataaatacacgagacgtcgtccggtcgggactntcacatacacaaanactaattagaacgacacgtacttgttactagactaagtacgaacgtacgtacgtagacgacgtacgtagacggacgtacgtacgtagtacgttacgttacgttcgtttcgtttcggttcgttcgtacggttacgggttacgggtaacgtaccgttacgtacgtacg

SEQ ID NO: 327406 - DNA, 503 bp, Homo sapiens
  misc_feature: GZ8MTXP02HDJ54.10.53.E09.1.454.CMB.2.raw
tcagcatagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctgcctgtgtctctgggcgagagggccaccatcaactgcaagtccagccagagttgtttatcagctccgacaataagaactactagcttggtaccagcagaaaccaggacagcctctaagctgctcatttactgggcatcgtacccgggatccccggggtcctgaccgattcagtgcagcgggtctgggacagatttcactctcacatcagcagcctgcaggctagaagatgcgctagtttatactgtcagcactatatacgtacccattcactagttccggcctacgggaaccaaagtggaatactacaaaacgactgtacgtcg

SEQ ID NO: 327407 - DNA, 653 bp, Homo sapiens
  misc_feature: GZ8MTXP02H7886.10.53.E09.1.454.CMB.2.raw
  modified_base (243)..(243): a, c, t, g, unknown or other
  misc_feature (243)..(243): n is a, c, g, or t
  modified_base (364)..(364): a, c, t, g, unknown or other
  misc_feature (364)..(364): n is a, c, g, or t
  modified_base (381)..(381): a, c, t, g, unknown or other
  misc_feature (381)..(381): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctgggtggagtcgtgggggaggcgtggtccaggccgtgggacggtccctnagactctccttgtttagccctctggattcaccttcagttagttatcctttgctacgtgggtcctcaggcctccgaggcaaggggctgggaggtgggtgctagttatctcatttgatggaanacaaataaatactaacnggacgtaactcccgggttcgggggacctacgttacacccactacctaccaaaagactaaattagaaagaacctacgtcttacgtttctagactaaagtacgaaacacgaccgtagaggagacgaggaacgggaacgtacggcgttaggtacgtttaattacgtttggtttaccggttttagggtttccgtacggtaccgttacgggttaccgggggtaaactttacccgttacgtacggtaccgtaccggttacgggggtacccgaccgggg

SEQ ID NO: 327408 - DNA, 563 bp, Homo sapiens
  misc_feature: GZ8MTXP02JDWKI.10.53.E09.1.454.CMB.2.raw
  modified_base (333)..(333): a, c, t, g, unknown or other
  misc_feature (333)..(333): n is a, c, g, or t
  modified_base (432)..(432): a, c, t, g, unknown or other
  misc_feature (432)..(432): n is a, c, g, or t
tcagcatagtagtgcacgaccggtgctcgatttagagagagtgtgttgggtttgggggagacgagcccagcactggaagtcgccggtgtttccattcggtgatcatcactgaacacagaggactcaccatggagtttgggctgagcgtggtttcgcgttaggctctttaagaggtgtccagtgtcaggtgcagctggtggagtctgggggagcgtggtccagcctgggagtccctcagactctcctgttagcctctggattcaccttcagtagttatcctttgcactgggtccgtcaggctccaggcaaggggctggagtggggtgcagttanctcatttgatggagacaataaatactacagagacgtccgtcggggccgacttcacactctaccaaacgaacaatttagaagaacaacgcttgttctganaatagacagctagagagcgagaggacgacgcgtgtagttacgttacgttcgtttcggtttggttcgttacgtacgtcggtacggggtaacgttaccgttacgtacgtacgtacggtacgggtacggtacgg

SEQ ID NO: 327409 - DNA, 504 bp, Homo sapiens
  misc_feature: GZ8MTXP02JDRPP.10.53.E09.1.454.CMB.2.raw
  modified_base (281)..(281): a, c, t, g, unknown or other
  misc_feature (281)..(281): n is a, c, g, or t
  modified_base (308)..(308): a, c, t, g, unknown or other
  misc_feature (308)..(308): n is a, c, g, or t
  modified_base (355)..(355): a, c, t, g, unknown or other
  misc_feature (355)..(355): n is a, c, g, or t
  modified_base (364)..(364): a, c, t, g, unknown or other
  misc_feature (364)..(364): n is a, c, g, or t
tcagcatagtagtgcacgaccggtgctcgatttagagagagtgtgttgggtttggggagctacaacaggcaggcaggggcagcaagatggtgttgcagacccaggtcttcatttctctgttgctctggatctctggtgcctacggggacatcgtgatgacccagtctccagactccctgcctgtgtctctgggcgagagggccaccatcaactgcaagtccagccagagtgtttatcagctccgacaataagaactactagcttggtaccagcagaaaccnggacagcctcctaagctgctcattacnggcatcgaccggatccccggggtcctgaccatcagtgcagcgggtcngggacagtnttcactctacacatcagcacgctgcaggctagaagatgcggctagtttactacgtgtacagctactattatacgtacccattcactacttccggacccgtagggaaccaaagtggaagactacaaacgaactggtacggc

SEQ ID NO: 327410 - DNA, 532 bp, Homo sapiens
  misc_feature: GZ8MTXP02JQOUO.10.53.E09.1.454.CMB.2.raw
  modified_base (453)..(453): a, c, t, g, unknown or other
  misc_feature (453)..(453): n is a, c, g, or t
tcagcatagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctgcctgtgtctctgggcgagagggccaccatcaactgcaagtccagccagagtgtttatcagctccgacaataagaactactagcttggtaccagacagaaaccaggacagccctacctaagctgctcatttactgggcatcctaacccggggatcccccggggtccctgaccgattcagtggcaggcgggtctggggacagtactttcactctacaccatcagcagcctgcaggctagaagatggcgctagtttatatgtcagcacttattaanacgtacccattccactacttccggaccctacgggaaccaaaaggtcggaacgtactaccgaaaacgacttggacggtcg

SEQ ID NO: 327411 - DNA, 546 bp, Homo sapiens
  misc_feature: GZ8MTXP02FUSFG.10.53.E09.1.454.CMB.2.raw
  modified_base (246)..(246): a, c, t, g, unknown or other
  misc_feature (246)..(246): n is a, c, g, or t
  modified_base (344)..(344): a, c, t, g, unknown or other
  misc_feature (344)..(344): n is a, c, g, or t
  modified_base (358)..(358): a, c, t, g, unknown or other
  misc_feature (358)..(358): n is a, c, g, or t
  modified_base (376)..(376): a, c, t, g, unknown or other
  misc_feature (376)..(376): n is a, c, g, or t
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggagcgtggtccagcctgggagtccctnagactctcctgtttagcctctggattcaccttcagtagttatcctttgcactgggtccgtcaggctccaggcaaggggctgggagtgggtgcagttanctcatttgatgganacataaatactaacaganacgtccgggtcggggccgtattcacctatctaccaaagactaaattagaagaacacgctgttctgacaaatacgaacacgacctagagagctagaggacgacggcgtgtagtattacgttgttcgtttggttctgtacgtcggtacggggtactaccgttacgacgtacg

SEQ ID NO: 327412 - DNA, 544 bp, Homo sapiens
  misc_feature: GZ8MTXP02G12FZ.10.53.E09.1.454.CMB.2.raw
  modified_base (349)..(349): a, c, t, g, unknown or other
  misc_feature (349)..(349): n is a, c, g, or t
  modified_base (360)..(360): a, c, t, g, unknown or other
  misc_feature (360)..(360): n is a, c, g, or t
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggagcgtggtccagcctgggaggtccctcagactctcctgtttagcctctggattcaccttcagtagttatcctttgcactgggtccgtcaggctccaggcaaggggctggagtggggtgcagttatcctnatttgatgganaacataaatactacagagactccggttcggggccgattcaccatctaccaaagacaattagaaagaacacgactgtttctgacaaatgaaacacgcctagagagcgtagaggacacggctgtgttattacttgttcgtttcggttctgtacgttcggtacgggggtaactaccgttcgagtccg

SEQ ID NO: 327413 - DNA, 563 bp, Homo sapiens
  misc_feature: GZ8MTXP02G197P.10.53.E09.1.454.CMB.2.raw
  modified_base (239)..(239): a, c, t, g, unknown or other
  misc_feature (239)..(239): n is a, c, g, or t
  modified_base (339)..(339): a, c, t, g, unknown or other
  misc_feature (339)..(339): n is a, c, g, or t
  modified_base (342)..(342): a, c, t, g, unknown or other
  misc_feature (342)..(342): n is a, c, g, or t
  modified_base (353)..(353): a, c, t, g, unknown or other
  misc_feature (353)..(353): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggagcgtggtccagccgtgggaggtccctnagactctcctgttagcctctggattcaccttcagtagttatcctttgcctacgtgggtcctcaggcctccgaggcaaggggctggagtgggtgctagttnctnatttgatgganacaaataatactacagactactccggttcgggaccattccaccatcctaccaaagactaattagaacaacacgctgttactagacaaatagaacagcctagagacgctagagacacggctgtacgtattacgttgtttcgtttaggttctcggtacgttcgggtacggggtaacttccgtacgtacgacgtacgtcggggaccgtacggg

SEQ ID NO: 327414 - DNA, 637 bp, Homo sapiens
  misc_feature: GZ8MTXP02JU6HW.10.53.E09.1.454.CMB.2.raw
  modified_base (238)..(238): a, c, t, g, unknown or other
  misc_feature (238)..(238): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggaggcgtggtccagcctgggagtccctnagactctcctgtttagcctctggattcaccttcagttagttatcctttgctacgtgggtcctcaggctccaggcaaggggctgggagtggggtggctagttatctcatttggatggaagtacaaattaaaactactaacagacgtaaccgttcccgggtttacgggggccctaatttcccaaccctaacttacctaacccaaaagtaacctaaagtttagaaagaaaccacgtacttacgtttacctagactaaatacgaaacagacctaggacgagccgtaggacggacgacggtcgtgtagttagttacgttggtttcgtttggttcgtcgtaccgtacgggttaccgggggtaacttaccgttacgacggtcgtacggtcggggaccgtaacgggg

SEQ ID NO: 327415 - DNA, 558 bp, Homo sapiens
  misc_feature: GZ8MTXP02I3F1Z.10.53.E09.1.454.CMB.2.raw
  modified_base (238)..(238): a, c, t, g, unknown or other
  misc_feature (238)..(238): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtctgggggaggcgtggtccagcctgggaggtccctnagactctcctgttagcctctggattcaccttcagtagttatcctttgcactgggtccgtcaggctccaggcaaggggctggagtgggtggcagttatctcatttgatggagacaataaatactaacagagactccggttcggggccgattcaccatctaccaaagacaattagaaagacacgctgttctgacaaatagaacagcctagagagctagaggacgacggctgtagttacttacgttaggtttcgtttggttcgttcgtacgttcggtacgggggtaactaccgttacgacgacgacggtcggggaccgacggg

SEQ ID NO: 327416 - DNA, 555 bp, Homo sapiens
  misc_feature: GZ8MTXP02HWUHZ.10.53.E09.1.454.CMB.2.raw
  modified_base (243)..(243): a, c, t, g, unknown or other
  misc_feature (243)..(243): n is a, c, g, or t
  modified_base (342)..(342): a, c, t, g, unknown or other
  misc_feature (342)..(342): n is a, c, g, or t
  modified_base (356)..(356): a, c, t, g, unknown or other
  misc_feature (356)..(356): n is a, c, g, or t
  modified_base (369)..(369): a, c, t, g, unknown or other
  misc_feature (369)..(369): n is a, c, g, or t
tcagcatagtagtgcacgaccggtgctcgatttagagagagtgtgttgggtttggggctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctgggtggagtcgtgggggagcgtggtccagcctgggagtccctnagactctcctgttacgcctctggtattcaccttcagtagttatcctttgcactgggtccgtcaggctccgaggcaaggggctggagtgggtgcagttanctcatttgatgganacaataaatctanagtagacctccgggttcggggcctattcaccatctaccaaagaactaatttagaagaacacgctgtttctgacaaatagaaacagacctagacgagctagaggacgacgcgtagtgtattacttgttcgtttggttcttgtacgtcggtacgggggtaacttaccgttcgacgtcgtacgtcgggg

SEQ ID NO: 327417 - DNA, 561 bp, Homo sapiens
  misc_feature: GZ8MTXP02HM5NT.10.53.E09.1.454.CMB.2.raw
  modified_base (242)..(242): a, c, t, g, unknown or other
  misc_feature (242)..(242): n is a, c, g, or t
  modified_base (255)..(255): a, c, t, g, unknown or other
  misc_feature (255)..(255): n is a, c, g, or t
  modified_base (259)..(259): a, c, t, g, unknown or other
  misc_feature (259)..(259): n is a, c, g, or t
  modified_base (268)..(268): a, c, t, g, unknown or other
  misc_feature (268)..(268): n is a, c, g, or t
  modified_base (291)..(291): a, c, t, g, unknown or other
  misc_feature (291)..(291): n is a, c, g, or t
tcagcatagtagtgcacgaccggtgctcgatttagagagagtgtgttgggttgggagctctgggagacgagcccagcactggaagtcgccggtgtttccattcggtgatcatcactgaacacagaggactcaccatggagtttgggctgagcgtggtttcgcgttaggctctttaagaggtgtccagtgtcaggtgcagctggtggagtctgggggagcgtggtccagcctgggagtccctnagctctctgttancctntgatcactnagtatatcttgcacgtggtcctnaggctcgaggcgaaggggctggaggtgggtggcgtagtatcctctattgtagtaggagaacataaataactacagagtacgtacgtcgggacgactacacactactacaaacgaactaagttagaagacgacgacgtacgttagttcgtacgactaacgtaagaacgacgacgacgagagacgtagacggacgacgacgtacgtagttacgttacgttacgttcgtttcggttcgtcgtacgtacggtacgggtacgtacgttacgtacg

SEQ ID NO: 327418 - DNA, 581 bp, Homo sapiens
  misc_feature: GZ8MTXP02JHYNH.10.53.E09.1.454.CMB.2.raw
  modified_base (237)..(237): a, c, t, g, unknown or other
  misc_feature (237)..(237): n is a, c, g, or t
  modified_base (256)..(256): a, c, t, g, unknown or other
  misc_feature (256)..(256): n is a, c, g, or t
  modified_base (299)..(299): a, c, t, g, unknown or other
  misc_feature (299)..(299): n is a, c, g, or t
  modified_base (363)..(363): a, c, t, g, unknown or other
  misc_feature (363)..(363): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggagcgtggttcagcctgggagtccctnagactctcctgttagcctntggattcaccttcagtagttatcctttgctacgtgggtccgtnaggcctccgaggcgaaggggctgggagtgggtgcagttatctcatttgatggagacaaataaanacttaacaggacgtaccgtccggttcgggggccaatttccaaccctactacctaccaaagaactaatttagaacgaacacgactgttctagacaaatagaaacagacctagagagcgtagaggacacggactgtagttacttacgttgtttcggtttcgttcgtcgtacgtcggtacggggtaactaccgtacgtacgcgacgtcgggaccgtacggg

SEQ ID NO: 327419 - DNA, 571 bp, Homo sapiens
  misc_feature: GZ8MTXP02GV16H.10.53.E09.1.454.CMB.2.raw
  modified_base (356)..(356): a, c, t, g, unknown or other
  misc_feature (356)..(356): n is a, c, g, or t
  modified_base (374)..(374): a, c, t, g, unknown or other
  misc_feature (374)..(374): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggaggcgtggtccagccgtgggagtccctcagactctcctgtttacgcctctggattcaccttcagttagttatcctttgctactgggtcctcaggctccgaggcaaggggctggagtggggtgctagttatctctatttgatgganaactaaataaatactacngacgtctccggtcggggcctattcaccatctaccaaagacaattagaaagaacacgtactgtttactagacaaatacgaacagcctagacgaagcgtaggacggacgacggcgtgtagtacttacgttgtttcgtttggttctcgtacgtcggtacggggtaactacgtacgtacgcgacggtcgggaccgtacggg

SEQ ID NO: 327420 - DNA, 515 bp, Homo sapiens
  misc_feature: GZ8MTXP02HDRCD.10.53.E09.1.454.CMB.2.raw
  modified_base (242)..(242): a, c, t, g, unknown or other
  misc_feature (242)..(242): n is a, c, g, or t
  modified_base (273)..(273): a, c, t, g, unknown or other
  misc_feature (273)..(273): n is a, c, g, or t
  modified_base (334)..(334): a, c, t, g, unknown or other
  misc_feature (334)..(334): n is a, c, g, or t
  modified_base (337)..(337): a, c, t, g, unknown or other
  misc_feature (337)..(337): n is a, c, g, or t
  modified_base (348)..(348): a, c, t, g, unknown or other
  misc_feature (348)..(348): n is a, c, g, or t
  modified_base (350)..(350): a, c, t, g, unknown or other
  misc_feature (350)..(350): n is a, c, g, or t
  modified_base (359)..(359): a, c, t, g, unknown or other
  misc_feature (359)..(359): n is a, c, g, or t
  modified_base (390)..(390): a, c, t, g, unknown or other
  misc_feature (390)..(390): n is a, c, g, or t
  modified_base (399)..(399): a, c, t, g, unknown or other
  misc_feature (399)..(399): n is a, c, g, or t
  modified_base (405)..(405): a, c, t, g, unknown or other
  misc_feature (405)..(405): n is a, c, g, or t
  modified_base (408)..(408): a, c, t, g, unknown or other
  misc_feature (408)..(408): n is a, c, g, or t
  modified_base (411)..(411): a, c, t, g, unknown or other
  misc_feature (411)..(411): n is a, c, g, or t
  modified_base (420)..(420): a, c, t, g, unknown or other
  misc_feature (420)..(420): n is a, c, g, or t
tcagcatagtagtgcacgaccggtgctcgatttagagagagtgtgttgggtttggggctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggagcgtggtccagcctgggagtccctnagactctcctgttagcctctggatcaccttnagtattatccttgcactgggtcctcaggctccaggcaaggggctggagtgggtgcagttanctnattgatggaananaataatcanagacgacgtcgtcggactatcacatcacaanatatagaanaacacnctnttnagacaatanaacacgacagagagcgagagacgacgctgtagtattacgtgtttcgttcgtcgtgtacgtcggtacgggtaactacgtacgacgacgacggtcgg

SEQ ID NO: 327421 - DNA, 646 bp, Homo sapiens
  misc_feature: GZ8MTXP02JSNB7.10.53.E09.1.454.CMB.2.raw
  modified_base (207)..(207): a, c, t, g, unknown or other
  misc_feature (207)..(207): n is a, c, g, or t
  modified_base (214)..(214): a, c, t, g, unknown or other
  misc_feature (214)..(214): n is a, c, g, or t
  modified_base (389)..(389): a, c, t, g, unknown or other
  misc_feature (389)..(389): n is a, c, g, or t
tcagcatagtagtgcacgaccggtgctcgatttagagagagtgtgttgggtttggggctgggagacgagcccagcactggaagtcgccggtgtttccattcggtgatcatcactgaacacagaggactcaccatggagtttgggctgagcgtggtttcgcgtaggctctttaagaggtgtccagtgtcaggtgcagctggtggagtntgggggnggcgtggtcgagcgtgggacggtcctcagactctctgttacgtcctcgtgtatctaccttctagtagttacttccttcgtcgtacgtcggtccgtcgtacggcgtccgacggacggaacgggcggtggtagggtggggtggtcgtagttagtctctacgttgtagtaggtagaanaaataaatactaacgaagacgtacgtccggttacgggtacgtactactacctactactacaaacgtaactaaagttaagtaaacgaaacgacgtacgttacgttacgtacgtaacgtaaacgtaagaacgacgacgtacgagacgacgtacggacggacgacgtacgtacgtagttagttacgttcgtttcgtttcggttcgttacgtacggtaacggtacgggtaacgttaccgtacgtacgtacgtacggtacgg

SEQ ID NO: 327422 - DNA, 583 bp, Homo sapiens
  misc_feature: GZ8MTXP02HNJ42.10.53.E09.1.454.CMB.2.raw
  modified_base (290)..(290): a, c, t, g, unknown or other
  misc_feature (290)..(290): n is a, c, g, or t
  modified_base (319)..(319): a, c, t, g, unknown or other
  misc_feature (319)..(319): n is a, c, g, or t
tcagcatagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctgcctgtgtctcgtgggcgagagggccaccatcaactgcaagtccagccagtagttgttttatcagctccgaacaataagaactacttagcttggtaccagacaagaaaccnggacagcctcctaagctgctcatttacgngggcagtccgtaacccggggatcccccggggtccctgaccgtattcgaggtggccgaggtcgggtctggggactagtactttccactctccaccagtcagcacgcctgcgaggctagaacgagtggacggtacttagtttacttacgtgtacagtctaacttaattacgtaacctaccctaattccaacctacgttacccgggcccgtacgggtaaaccctaaaggtcgaagtaactacgaaaacgtacgtaggtacggtaccg

SEQ ID NO: 327423 - DNA, 566 bp, Homo sapiens
  misc_feature: GZ8MTXP02HE9WX.10.53.E09.1.454.CMB.2.raw
  modified_base (340)..(340): a, c, t, g, unknown or other
  misc_feature (340)..(340): n is a, c, g, or t
  modified_base (434)..(434): a, c, t, g, unknown or other
  misc_feature (434)..(434): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggagcgtggtccagccgtgggaggtccctcagactctcctgttagcctctggattcaccttcagtagttatcctttgctacgtgggtcctcaggcctccaggcaaggggctggagtgggtgcagttatctnatttgatggagacaataaatactacagagactccggttcggggcctattccaccatctaccaaagactaatttagaaagaacacgtctgttacngacaaatgaacagcctagagagcgtagaggacacggctgtgttacttacgttgtttcgtttggttctgtaccgtcggtacgggggtaacttaccgttacgacggtacgtaccggtcggggaccgtaccgggg

SEQ ID NO: 327424 - DNA, 635 bp, Homo sapiens
  misc_feature: GZ8MTXP02II7NN.10.53.E09.1.454.CMB.2.raw
  modified_base (238)..(238): a, c, t, g, unknown or other
  misc_feature (238)..(238): n is a, c, g, or t
  modified_base (351)..(351): a, c, t, g, unknown or other
  misc_feature (351)..(351): n is a, c, g, or t
  modified_base (365)..(365): a, c, t, g, unknown or other
  misc_feature (365)..(365): n is a, c, g, or t
tcagcatagtagtgcacgaccggtgctcgatttagagagagtgtgttgggtttgggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggagcgtggtccagccgtggagtccctnagactctctgttagcctctggattcaccttcagttagttactcctttgctacgtcgggtcctcaggctccgaggccgaagggggctgggaggtcggggtggctagttactctntatttgagtggaanaactaaataaatactaacagagtaccgtccggttcggggcctattccaccatacctacaaagactaattagaaacgaacacgtctcgttacctagaactaaatagtaaacacgtacctaggaagacgacgtaggaacggacgacggtcgtagttagtttaacttaccgtttggttttaccggttttggttccgttacggtaccgttaccgggtacgggggtaaacttaccgttaccgacgtaccgtacggttcggggtacccgaccgggg

SEQ ID NO: 327425 - DNA, 563 bp, Homo sapiens
  misc_feature: GZ8MTXP02FUNK7.10.53.E09.1.454.CMB.2.raw
  modified_base (251)..(251): a, c, t, g, unknown or other
  misc_feature (251)..(251): n is a, c, g, or t
  modified_base (372)..(372): a, c, t, g, unknown or other
  misc_feature (372)..(372): n is a, c, g, or t
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagctgggttttcctcgttgcttcttttaagaggtgtccagtgtcaggtgcagctgggtggagtcgtgggggaggcgtggtccagcctggggaggtccctnagactctcctgtttagcctctggattcaccttcagttagttatcctttgcctactgggtccgtcaggctccgaggcgaaggggctgggaggtgggtggctagttatcctcatttgatgganaacataaatactacagagtactccgggtcgggccgatcacatctacaaagactaattagaagaacacgtctgttctagacaaatacgaacacgactagagagctagacgacgacggctagtacgttattacgttgtttcgtttggttcgtggtacgtcgggtacggggtaacttaccgttacgacgtaccg

SEQ ID NO: 327426 - DNA, 561 bp, Homo sapiens
  misc_feature: GZ8MTXP02GMUEF.10.53.E09.1.454.CMB.2.raw
  modified_base (247)..(247): a, c, t, g, unknown or other
  misc_feature (247)..(247): n is a, c, g, or t
  modified_base (266)..(266): a, c, t, g, unknown or other
  misc_feature (266)..(266): n is a, c, g, or t
  modified_base (344)..(344): a, c, t, g, unknown or other
  misc_feature (344)..(344): n is a, c, g, or t
  modified_base (348)..(348): a, c, t, g, unknown or other
  misc_feature (348)..(348): n is a, c, g, or t
  modified_base (359)..(359): a, c, t, g, unknown or other
  misc_feature (359)..(359): n is a, c, g, or t
  modified_base (367)..(367): a, c, t, g, unknown or other
  misc_feature (367)..(367): n is a, c, g, or t
  modified_base (376)..(376): a, c, t, g, unknown or other
  misc_feature (376)..(376): n is a, c, g, or t
  modified_base (416)..(416): a, c, t, g, unknown or other
  misc_feature (416)..(416): n is a, c, g, or t
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggaggcgtggtccagcctgggagtccctnagactctcctgttagcctntggattcacttcagtagttatcctttgcacgtgggtccgtcaggctccgaggcaaggggctggagtgggtgcagttancctnatttgatgganacataaanactacaganacgtcggtcgggcatcacatctacaaagactaattagaanaacacgtactgtttactagacaaagtacgaaacacgcctagagagctaggaggacgacggacgtggttagttacgttacgttgtttcgtttggttcgtaaggtacgttacgggtacgggggtaacttaccgttcgtacgtaccgg

SEQ ID NO: 327427 - DNA, 657 bp, Homo sapiens
  misc_feature: GZ8MTXP02HW2XL.10.53.E09.1.454.CMB.2.raw
  modified_base (199)..(199): a, c, t, g, unknown or other
  misc_feature (199)..(199): n is a, c, g, or t
  modified_base (653)..(657): a, c, t, g, unknown or other
  misc_feature (653)..(657): n is a, c, g, or t
tcagcatagtagtgcacgaccggtgctcgatttagagagagtgtgttgggtttgggctgggagacgagcccagcactggaagtcgccggtgtttccattcggtgatcatcactgaacacagaggactcaccatggagtttgggctgagcggtcggtttcgcgtaggcgtctttaagtaggtgtcagtgtcaggtgcagngtggtggagtcggtggggaggcggtggtcgacgcgtcgggtacggtccgtcgacgactcttccgttcgttacgtcctcgtcgtactctaccttctagttagttacttcgttcgtcgtacgtcggtcgtcgtacggtcgtcgacggacggacgggcggtggtagggtgggtggtcgtagttacgtcgtcgtagttagtagtaggaagtaacgtaaattaaactactaacgaacgtacgtacgtaccggtcggtaccgtactacctacctactactaacgtaaacgtaacgtaacgttaacgtaaacgtaaacgtacgtacgttacgttacgttacgtaacgtaaacgtaacgtaacgtacgtacgtacgtagacgtacgtacggaacggacgtacggtacgttacgttacgtttacgtttacgttacggtttacggtttcggtttacgttacgtnnnnn

SEQ ID NO: 327428 - DNA, 634 bp, Homo sapiens
  misc_feature: GZ8MTXP02JFRW9.10.53.E09.1.454.CMB.2.raw
  modified_base (313)..(313): a, c, t, g, unknown or other
  misc_feature (313)..(313): n is a, c, g, or t
tcagcatagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctgcctgtgtctcgtgggcgagagggccaccatcaactgcaagtccagccagagttgtttatcagctccgacaataagaactactagcttggtaccagcaagaaaccaggacagcctacaagctgctcatttacgnggcactccgtaacccggggatcccccggggtccctgacccgtattcgaggtcggcgaggcggggtcgtggggactagtactttcactctaccacatcagcacgcctgcacggctaggaagtagtcggcggtacttaacggtttaacttaccgttaggtacctaagtactaaacttaacgtttaaacttaaccgttaaccccctatttaaccgaaccttaaacgtttcccgggtaccccgttacggggtaaaccccgtaaaagggttaacgggaaacgtaaacgttaaccgaaaaacggtaaccgttacggtacggtaaccg

SEQ ID NO: 327429 - DNA, 592 bp, Homo sapiens
  misc_feature: GZ8MTXP02IATL7.10.53.E09.1.454.CMB.2.raw
  modified_base (250)..(250): a, c, t, g, unknown or other
  misc_feature (250)..(250): n is a, c, g, or t
  modified_base (269)..(269): a, c, t, g, unknown or other
  misc_feature (269)..(269): n is a, c, g, or t
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagctgggttttcctcgttgcttcttttaagaggtgtccagtgtcaggtgcagctggtggagtcgtgggggaggcgtggtccagccgtggggagtccctnagactctcctgttagcctntggattcaccttcagtagttatcctttgcctacgtcgggtccgtcaggctcccgaggccgaaggggctgggaggtggggtggactagttatcctctatttgatggaagactaataaaatactaacagagacgtccggttacgggccgatcacctatcctaccaaagactaatttagaaagaacacgcttgtttactgtacaaatagaaacagacctagagagacgtagaggacgacggcttggtacgttagttacgttcgtttcgttttcggttcgttcggtacgtacgggttacgggggtaacttaccgttcgtacggtccg

SEQ ID NO: 327430 - DNA, 562 bp, Homo sapiens
  misc_feature: GZ8MTXP02JS756.10.53.E09.1.454.CMB.2.raw
  modified_base (328)..(328): a, c, t, g, unknown or other
  misc_feature (328)..(328): n is a, c, g, or t
  modified_base (451)..(451): a, c, t, g, unknown or other
  misc_feature (451)..(451): n is a, c, g, or t
tcagcatagtagtgcacgaccggtgctcgatttagagagagtgtgttgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcactgggtccgtcaggctccaggcaaggggctggagtggggtggcagttatctcatttgatggagacaataaatactacagagactccgttcggggccattcaccatctaccaaagacaatttgaagaacacgctgtttcngacaaatgaaacagcctgagacgctgagacacggctgtgtattactgtttcgttgttctgactcggtcggggaataccttcagcacgtcggggccagggcacccgtggtccaccgtctcctcncgccctccaccgaacgggcccacgtccgtccttcccccgcggccctacccctcctaccaacgacgccacccgtcgtcggggcaacgacgccggccgtggcctcgccgtcgg

SEQ ID NO: 327431 - DNA, 556 bp, Homo sapiens
  misc_feature: GZ8MTXP02F9FHD.10.53.E09.1.454.CMB.2.raw
  modified_base (318)..(318): a, c, t, g, unknown or other
  misc_feature (318)..(318): n is a, c, g, or t
  modified_base (381)..(381): a, c, t, g, unknown or other
  misc_feature (381)..(381): n is a, c, g, or t
  modified_base (434)..(434): a, c, t, g, unknown or other
  misc_feature (434)..(434): n is a, c, g, or t
tcagcatagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctgcctgtgtctcgtgggcgagagggccaccatcaactgcaagtccagccagagttgtttatcagctaccgacaataagaactacttagcttggtaccagcaagaaaccaggacagcctacctaagctgctctatttacgngggcatccgtaacccggggatcccccggggtccctgaccgattcgaggtggcaggcggggtcnggggactagtatttccactctaccaccatcagcacgctgcaggctagaaacgntggcggtacttaggtttatacgtgtacagtacaacttattactaacgtacccctattccactacgttccgaccgtacgggaaccaaaggtcgaagtactaccgaaaacgtacgtgtacggtc

SEQ ID NO: 327432 - DNA, 581 bp, Homo sapiens
  misc_feature: GZ8MTXP02IUIDN.10.53.E09.1.454.CMB.2.raw
  modified_base (156)..(156): a, c, t, g, unknown or other
  misc_feature (156)..(156): n is a, c, g, or t
  modified_base (240)..(240): a, c, t, g, unknown or other
  misc_feature (240)..(240): n is a, c, g, or t
  modified_base (437)..(437): a, c, t, g, unknown or other
  misc_feature (437)..(437): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagcgtggttttccncgttagctctttaagaggtgtccagtgtcaggtgcagctggtggagtcgtgggggaggcgtggtccagcctggggacgtccctnagactctcctgttagcctctggattcaccttcagtagttatcctttgcacgtgggtccctcaggctccgaggcaaggggctgggaggtggggtggctaggtttatctctaatttgatgggagactaaaataaatactacagagaccgtccggttccgggggcctatttccactatctaccaaagacaatttagaaanaacacgcttagttctagacaaatagaacgagtactagaggagcgtaggacggacgacggctgtagttaattcgttgtttcgtttggttcgttgtacgtcggtcggggtaactaccgttacacgtcgacggtcgggtaccgacgg

SEQ ID NO: 327433 - DNA, 567 bp, Homo sapiens
  misc_feature: GZ8MTXP02GX7RI.10.53.E09.1.454.CMB.2.raw
  modified_base (241)..(241): a, c, t, g, unknown or other
  misc_feature (241)..(241): n is a, c, g, or t
  modified_base (347)..(347): a, c, t, g, unknown or other
  misc_feature (347)..(347): n is a, c, g, or t
  modified_base (357)..(357): a, c, t, g, unknown or other
  misc_feature (357)..(357): n is a, c, g, or t
tcagcatagtagtgcacgaccggtgctcgatttagagagagtgtgttgggtttgggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggaggcgtggtccagcctggggaggtccctnagactctcctgtttagcctctggattcaccttcagtagttatcctttgctacgtgggtccgtcaggctccgaggcaaggggctgggagtgggtgctagttatctantttgatgganacaaataaatactacagagactccggttcggggcctattccaccatctaccaaagacaatttagaaagaacacgctgttactgacaaatgaacagacctagagagctagaggacacggctagtagttattacgttgttcgtttggttctcggtacgtcggtacgggggtaacttaccgttacgacgtcgtacggtcggggaccgacgggg

SEQ ID NO: 327434 - DNA, 547 bp, Homo sapiens
  misc_feature: GZ8MTXP02GBZVL.10.53.E09.1.454.CMB.2.raw
  modified_base (316)..(316): a, c, t, g, unknown or other
  misc_feature (316)..(316): n is a, c, g, or t
tcagcatagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctgcctgtgtctcgtgggcgagagggccaccatcaactgcaagtccagccagagttgttttatcagctccgacaataagaactacttagcttggtaccagcaagaaaccaggacagcctacctaagctgctcatttacngggcatccgtaacccgggatcccccggggtcctgaccgtattcgagtggcaggcgggtctggggacagtattcactctcacatcagcacgcctgcaggctaggaagagtggcggtactagtttacttacgtgtcagactactatactaacgtacccctattaccactacgttccggacccgtacgggaacctaaaggtggaacgtaactacaaaacgtacgtaggtacggc

SEQ ID NO: 327435 - DNA, 593 bp, Homo sapiens
  misc_feature: GZ8MTXP02IPRN7.10.53.E09.1.454.CMB.2.raw
  modified_base (321)..(321): a, c, t, g, unknown or other
  misc_feature (321)..(321): n is a, c, g, or t
tcagcatagtagtgcacgaccggtgctcgatttagagagagtgtgttgggtttgggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggaggcgtggtccagcctggggaggtccctcagactctcctgttagcctctggattcacttcagtagctacggcatgcacgtcgggtcccaccaaactccgaggcaagggnttgggagtgggtgctagtttgttcatctggagggctagtgttcaagttggtatgctggaccgccggtaggaacggggcctattccacctatctccaagacgaaccaactaccgaaacgaacaacaatagttatttcggacctagaacacgacctaagtcctagaacggacgtacgggtatacgtaacgtacgtaggtaacgggaaaggggacgggggaaccgagggcggtagtaaccgaacggtacttaccgttgacgttcggcgggtaccg

SEQ ID NO: 327436 - DNA, 609 bp, Homo sapiens
  misc_feature: GZ8MTXP02JTXLX.10.53.E09.1.454.CMB.2.raw
  modified_base (244)..(244): a, c, t, g, unknown or other
  misc_feature (244)..(244): n is a, c, g, or t
tcagcatagtagtgcacgaccggtgctcgatttagagagagtgtgttgggtttggggctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggagcgtggtccagccgtgggaggtccctnagactctcctgttacgcctctggattcaccttcagtagttatcctttgcctacgtgggtccgtcaggctccgaggcaaggggctgggaggtggggtggctagttatcgtcagtttgatgggaagaacaaattaaatactaacaggacgtaccgtccgggttcgggggacctattccaaccagtaccctacaaaacgtactaaatttacggaaagaactacgtcttagtttcctagacctaaagtgaaacacgcctagacgagcgtaggacggacgacggacttggtagttattacgttgtttcgtttcgttcgtcgtacgttcgggtacggggtaacttaccgttacgacgtcgtacggtcgggg

SEQ ID NO: 327437 - DNA, 601 bp, Homo sapiens
  misc_feature: GZ8MTXP02IQCHT.10.53.E09.1.454.CMB.2.raw
  modified_base (248)..(248): a, c, t, g, unknown or other
  misc_feature (248)..(248): n is a, c, g, or t
  modified_base (266)..(266): a, c, t, g, unknown or other
  misc_feature (266)..(266): n is a, c, g, or t
  modified_base (356)..(356): a, c, t, g, unknown or other
  misc_feature (356)..(356): n is a, c, g, or t
  modified_base (367)..(367): a, c, t, g, unknown or other
  misc_feature (367)..(367): n is a, c, g, or t
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggagcgtggtccagccgtgggacgtccctnagactctctgttagcctntggattcacttcagtagttatccttgctacgtcgggtccgtcaggtcctccgaggcgaaggggtctgggagtggggtgctagttatcctnatttgatgganaacaataaatactacagacgtactccgggtcgggccgtatacaccactactacaaagtactaaattacgaaagaacacgtcttagtttctagtactaaagtacgaaacacgccgtagagacgcgtaggaacggaccgacggtcgttaggttacgttaagtttacgtttcggtttcgttttggttcgttaacggtacggtacgggttacggggtaacttaccgttacgacgtccg

SEQ ID NO: 327438 - DNA, 540 bp, Homo sapiens
  misc_feature: GZ8MTXP02HKSWN.10.53.E09.1.454.CMB.2.raw
  modified_base (246)..(246): a, c, t, g, unknown or other
  misc_feature (246)..(246): n is a, c, g, or t
  modified_base (306)..(306): a, c, t, g, unknown or other
  misc_feature (306)..(306): n is a, c, g, or t
  modified_base (355)..(355): a, c, t, g, unknown or other
  misc_feature (355)..(355): n is a, c, g, or t
  modified_base (367)..(367): a, c, t, g, unknown or other
  misc_feature (367)..(367): n is a, c, g, or t
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggagcgtggtccagcctgggagtccctnagactctcctgtttagcctctggattcaccttcagtagttatcctttgctatgggtcctnaggctccaggcaaggggctggagtgggtgtagtatctctattgatgganacaatatactanagagactcggtcgggcatcacatctacaaagactaattagaagaacacgctagtttctagactaaatagaacagcctagagagctaggagacgaacggctgtagttacttacgttgtttcgtttgttcgtgtaacgtcggtacgggggtaactaccgttacacgtacgtacgg

SEQ ID NO: 327439 - DNA, 567 bp, Homo sapiens
  misc_feature: GZ8MTXP02GWSK4.10.53.E09.1.454.CMB.2.raw
  modified_base (327)..(327): a, c, t, g, unknown or other
  misc_feature (327)..(327): n is a, c, g, or t
  modified_base (517)..(517): a, c, t, g, unknown or other
  misc_feature (517)..(517): n is a, c, g, or t
tcagcatagtagtgcacgaccggtgctcgatttagagagagtgtgttgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcactgggtccgtcaggctccaggcaaggggctgggagtgggtggcagttatctcatttgatggagacaataaatactacagagactccgttcggggccattcaccatctccaaagacaatttgaagaacacgctgtttcngacaaatgaaacagcctaggagacgctgaggacacggctgtgtattactgtttcgtttgtctgactcgtcggggaatacttcagcgacgtcggggccagggcacccgtggtccaccgtctcctcacgtccctaccaccgaacgggcccagtccggttccttccccgtcgcccaccctcctaccaacgacnccaccgtcgtcgggggaccaacgcggccggcccgtgggcctcgccgtcgg

SEQ ID NO: 327440 - DNA, 557 bp, Homo sapiens
  misc_feature: GZ8MTXP02JYFTW.10.53.E09.1.454.CMB.2.raw
  modified_base (238)..(238): a, c, t, g, unknown or other
  misc_feature (238)..(238): n is a, c, g, or t
  modified_base (336)..(336): a, c, t, g, unknown or other
  misc_feature (336)..(336): n is a, c, g, or t
tcagcatagtagtgcacgaccggtgctcgatttagagagagtgtgttgggtttgggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggagcgtggtccagcctgggagtccctnagactctcctgtttagcctctggattcaccttcagtagttatcctttgcactgggtcctcaggctccgaggcaaggggctgggagtgggtgcagttanctcatttgatggagacaaataaatactacagagactccggttcggggcctagttccaccatctaccaaagactaattgaagaacacgactgttctagtacaaatgaacagacctagagagctagaggacacggctagtgttattacgttgttcgtttggttctacgtacgttcggtacggggtaactacccgttacgacgcgacgttcggggaccacgggg

SEQ ID NO: 327441 - DNA, 580 bp, Homo sapiens
  misc_feature: GZ8MTXP02HL469.10.53.E09.1.454.CMB.2.raw
  modified_base (236)..(236): a, c, t, g, unknown or other
  misc_feature (236)..(236): n is a, c, g, or t
  modified_base (255)..(255): a, c, t, g, unknown or other
  misc_feature (255)..(255): n is a, c, g, or t
  modified_base (337)..(337): a, c, t, g, unknown or other
  misc_feature (337)..(337): n is a, c, g, or t
  modified_base (340)..(340): a, c, t, g, unknown or other
  misc_feature (340)..(340): n is a, c, g, or t
  modified_base (351)..(351): a, c, t, g, unknown or other
  misc_feature (351)..(351): n is a, c, g, or t
  modified_base (363)..(363): a, c, t, g, unknown or other
  misc_feature (363)..(363): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtctgggggagcgtggtccagcctgggagtccctnagactctcctgttagcctntggattcaccttcagttagttatcctttgctacgtgggtcctcaggctccgaggcaaggggctgggagtgggtgctagttanctnatttgatgganacaataatctangagactccggttcggggcctattccaccatctacaaagacaattagaaacgaacacgcttgttactgactaaatgaacacgacctagagacgctaggacggtacgacggtactacgtagttacttacgttggtttcggtttaggttcgtacggtacgtacggtacgggggtaacttaccgttacgacggtacgtacggtcgggggtaccgtacgggg

SEQ ID NO: 327442 - DNA, 587 bp, Homo sapiens
  misc_feature: GZ8MTXP02HOS8C.10.53.E09.1.454.CMB.2.raw
  modified_base (239)..(239): a, c, t, g, unknown or other
  misc_feature (239)..(239): n is a, c, g, or t
  modified_base (257)..(257): a, c, t, g, unknown or other
  misc_feature (257)..(257): n is a, c, g, or t
  modified_base (341)..(341): a, c, t, g, unknown or other
  misc_feature (341)..(341): n is a, c, g, or t
  modified_base (355)..(355): a, c, t, g, unknown or other
  misc_feature (355)..(355): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggaggcgtggtccagcctgggaggtccctnagctctcctgttagcctntggattcaccttcagtagttatcctttgcacgtgggtcctcaggctccgaggcaagggggctgggaggtggggtggctagttanctcatttgatgganacaaataaatactacagacgactccggttcgggggcctattccacctatttaccaaagtactaatttagaaagaacacgtctgtttcagactaaagtgaaacacgtcctagagagtcgtaggacggacacggctgtagttattacgtgtttcggtttggttcttcggacgttcggtcgggggtaacttaaccgttacgacgtccgtacggtcgggggaccgtacgggtcccg

SEQ ID NO: 327443 - DNA, 547 bp, Homo sapiens
  misc_feature: GZ8MTXP02JS724.10.53.E09.1.454.CMB.2.raw
  modified_base (314)..(314): a, c, t, g, unknown or other
  misc_feature (314)..(314): n is a, c, g, or t
tcagcatagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagacctccctgcctgtgtctctgggcgagagggccaccatcaactgcaagtccagccagagttgtttatcagctccgacaataagaactactagcttggaccagcaagaaaccaggacagccctacaagctgctctatttacgnggcatccgtacccggggatcccccggggtccctagaccgtattcaggtggcaggcgggtctggggacagtatttcactctcaccatcagcacgcctgcaggctagaagatggcgtactagtttatactgtacagctattataatacgtacccctattaccactacgttccggacccgtacgggaaccaaaggtcggaacgtaacgtaccgaaaacgtacgtacggtacgtacg

SEQ ID NO: 327444 - DNA, 594 bp, Homo sapiens
  misc_feature: GZ8MTXP02IW27D.10.53.E09.1.454.CMB.2.raw
  modified_base (238)..(238): a, c, t, g, unknown or other
  misc_feature (238)..(238): n is a, c, g, or t
  modified_base (255)..(255): a, c, t, g, unknown or other
  misc_feature (255)..(255): n is a, c, g, or t
  modified_base (361)..(361): a, c, t, g, unknown or other
  misc_feature (361)..(361): n is a, c, g, or t
  modified_base (407)..(407): a, c, t, g, unknown or other
  misc_feature (407)..(407): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggagcgtggtccagccgtgggagtccctnagctctctgttagcctntggattcaccttcagtagttatcctttgcactgggtcctcaggctccgaggcaaggggctgggagtgggtgcagttatctcatttgatggagacaaataatactanagagactccgtcgggccattcaccatctacaaagactaattagaanaacacgtacttgtttactcgtacaaatacgaaactagacctagaacgagcgtaggaacggacaacgggctagtagttactttacgttcggtttacggtttcggtttcgttacgtacggttcgggtacgggggttaaacttaccgttacgtacggtaaccggtacggggtaccggaacggggtccccg

SEQ ID NO: 327445 - DNA, 540 bp, Homo sapiens
  misc_feature: GZ8MTXP02FS2W6.10.53.E09.1.454.CMB.2.raw
  modified_base (310)..(310): a, c, t, g, unknown or other
  misc_feature (310)..(310): n is a, c, g, or t
tcagcatagtagtgcacgaccggtgctcgatttagagagagtgtgttgggtttggggagctacaacaggcaggcaggggcagcaagatggtgttgcagacccaggtcttcatttctctgttgctctggatctctggtgcctacggggacatcgtgatgacccagtctccagactccctgcctgtgtctctgggcgagagggccaccatcaactgcaagtccagccagagtgttttatcagctccgacaataagaactacttagcttggtaccagcagaaaccaggacagcctctaagctgctcatttacngggcatcgtacccgggatccccggggtccctgaccgtattcagtggcagcgggtctgggacagtatttcactctcacatcagcacgcctgcaggctagaagatgcgactagtttatacgtgtcagcactattatacgtaccctattacactacgttaccggcccgttacggggaaccctaaaaggtcgggaaagtacgtaaccgaaaacggtaaccgtaggtcggtaccg

SEQ ID NO: 327446 - DNA, 587 bp, Homo sapiens
  misc_feature: GZ8MTXP02I637R.10.53.E09.1.454.CMB.2.raw
  modified_base (237)..(237): a, c, t, g, unknown or other
  misc_feature (237)..(237): n is a, c, g, or t
  modified_base (351)..(351): a, c, t, g, unknown or other
  misc_feature (351)..(351): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggagcgtggtccagcctgggagtccctnagactctcctgttagcctctggattcacttcagtagttatcctttgctactgggtcccgtcaggctccgaggcaaggggctgggagtggggtgcagttatctcatttgatgganaacaaataaatactacagacgactccggttcggggcctattccaccatctacaaagaactaattagaacgaacacgtctagttactagactaaatacgaacacgacctagaagacgcgtaggaggacgacggtactagtagttacgttacgttcgtttcggtttggttcgttcgtacgttcgggtacgggggtaacttaccgttacgtacgtacgtacggtcggggtaccgacggg

SEQ ID NO: 327447 - DNA, 590 bp, Homo sapiens
  misc_feature: GZ8MTXP02JIV1Z.10.53.E09.1.454.CMB.2.raw
  modified_base (183)..(183): a, c, t, g, unknown or other
  misc_feature (183)..(183): n is a, c, g, or t
  modified_base (250)..(250): a, c, t, g, unknown or other
  misc_feature (250)..(250): n is a, c, g, or t
  modified_base (350)..(350): a, c, t, g, unknown or other
  misc_feature (350)..(350): n is a, c, g, or t
  modified_base (360)..(360): a, c, t, g, unknown or other
  misc_feature (360)..(360): n is a, c, g, or t
  modified_base (448)..(448): a, c, t, g, unknown or other
  misc_feature (448)..(448): n is a, c, g, or t
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagcttgggttttcctcgttgcttcttttaagnggtgtccagtgtcaggtgcagctggtggagtcgtgggggagcgtggtccagccgtgggacgtccctnagctctcctgtttacgcctctggattcaccttcagttagttactcctttgcctacgttcgggtccgtcaggctccgaggcgaaggggctgggagtggggngctagtttancctctagtttgagtggaagaacaataaatactaacgagacgtaccgttccgggttacggggaccgtatccacctactactaccgaaanactaaattagaagaacacgtcttgtttactagactaaatacgaacagacctagagagacgagacgacgacggcgtgtcgttaattacgttgttcgtttgttcgtgtacgttcggtacggggtaactaccgttacgacgtacg

SEQ ID NO: 327448 - DNA, 592 bp, Homo sapiens
  misc_feature: GZ8MTXP02G0X6P.10.53.E09.1.454.CMB.2.raw
  modified_base (249)..(249): a, c, t, g, unknown or other
  misc_feature (249)..(249): n is a, c, g, or t
  modified_base (356)..(356): a, c, t, g, unknown or other
  misc_feature (356)..(356): n is a, c, g, or t
  modified_base (368)..(368): a, c, t, g, unknown or other
  misc_feature (368)..(368): n is a, c, g, or t
  modified_base (384)..(384): a, c, t, g, unknown or other
  misc_feature (384)..(384): n is a, c, g, or t
  modified_base (439)..(439): a, c, t, g, unknown or other
  misc_feature (439)..(439): n is a, c, g, or t
tcagcatagtagtgcacgaccggtgctcgatttagagagagtgtgttgggtttggggagctctgggagacgagcccagcactggaagtcgccggtgtttccattcggtgatcatcactgaacatagaggactcaccatggagtttgggctgagctgggttttcctcgttgctcttttaagaggtgtccagtgtcaggtgcagctgggtggagtcgtgggggaggcgtggtccagcctggggagtccctnagactctcctgttagcctctggattcaccttcagtagttacttcctttgcacgtgggtcctcgaggcctccgaggcgaaggggctgggagtggggtgcagttatctnatttgatggaanaactaataaatactanagacgtacgtccggtacgggacctatacacactacaacaaagactaattagaaanaacacgtacttagttactagaactaaatacgaaacgacgactagagacgacgtaggaacgacgacggtcgtagttacgttacgttacgttcgtttacggtttcgttcgtaacgtacgttacgggtacggggtaacttaccgttacgacgtacg

SEQ ID NO: 327449 - DNA, 586 bp, Homo sapiens
  misc_feature: GZ8MTXP02FZQI3.10.53.E09.1.454.CMB.2.raw
  modified_base (238)..(238): a, c, t, g, unknown or other
  misc_feature (238)..(238): n is a, c, g, or t
  modified_base (257)..(257): a, c, t, g, unknown or other
  misc_feature (257)..(257): n is a, c, g, or t
  modified_base (299)..(299): a, c, t, g, unknown or other
  misc_feature (299)..(299): n is a, c, g, or t
  modified_base (338)..(338): a, c, t, g, unknown or other
  misc_feature (338)..(338): n is a, c, g, or t
  modified_base (341)..(341): a, c, t, g, unknown or other
  misc_feature (341)..(341): n is a, c, g, or t
  modified_base (353)..(353): a, c, t, g, unknown or other
  misc_feature (353)..(353): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagcttgggttttcctcgttgctcttttaagaggtgtccagtgtcaggtgcagctggtggagtcgtgggggagcgtggtccagcctgggagtccctnagactctcctgttagcctntggattcaccttcagtagttatcctttgctacgtgggtcctnaggcctccgaggcaaggggctgggagtgggtgcagttanctntatttgatgganaacaaataaatactacagacgacgtccggttcggggacctattccaaccatacctaccaaagaactaaatttagaaacgaacaacgtcttgttactagaacaaaatagaaacagacctagagagctaggaggaacgacggcgtgttgtaatttacgttgtttcgtttggttcttgtacgttcgggtacggggtaaacttaccgtacgacgtcgacggtcggggacctaacggg

SEQ ID NO: 327450 - DNA, 550 bp, Homo sapiens
  misc_feature: GZ8MTXP02HAKN4.10.53.E09.1.454.CMB.2.raw
  modified_base (237)..(237): a, c, t, g, unknown or other
  misc_feature (237)..(237): n is a, c, g, or t
  modified_base (334)..(334): a, c, t, g, unknown or other
  misc_feature (334)..(334): n is a, c, g, or t
  modified_base (337)..(337): a, c, t, g, unknown or other
  misc_feature (337)..(337): n is a, c, g, or t
  modified_base (348)..(348): a, c, t, g, unknown or other
  misc_feature (348)..(348): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggagcgtggtccagcctgggagtccctnagactctcctgtttagcctctggattcaccttcagtagttatcctttgctactgggtcctcaggctccaggcaaggggctggagtgggtgcagttanctnatttgatgganacaataaatactacagagactccggttcggggcctattcaccatctaccaaagacaatttagaagaacacgacttgttactgacaaatgaacagacctagagagctagaggacacggctgtagtatacttgttcgtttaggtctcgacgtcggtacgggggaacttaccgttacgacgtacgtacgtcggggaccgacgggg

SEQ ID NO: 327451 - DNA, 563 bp, Homo sapiens
  misc_feature: GZ8MTXP02G6527.10.53.E09.1.454.CMB.2.raw
  modified_base (236)..(236): a, c, t, g, unknown or other
  misc_feature (236)..(236): n is a, c, g, or t
  modified_base (332)..(332): a, c, t, g, unknown or other
  misc_feature (332)..(332): n is a, c, g, or t
  modified_base (346)..(346): a, c, t, g, unknown or other
  misc_feature (346)..(346): n is a, c, g, or t
  modified_base (348)..(348): a, c, t, g, unknown or other
  misc_feature (348)..(348): n is a, c, g, or t
  modified_base (358)..(358): a, c, t, g, unknown or other
  misc_feature (358)..(358): n is a, c, g, or t
  modified_base (361)..(361): a, c, t, g, unknown or other
  misc_feature (361)..(361): n is a, c, g, or t
  modified_base (386)..(386): a, c, t, g, unknown or other
  misc_feature (386)..(386): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagctgggttttcctcgttgctctttaagaggtgtccagtgtcaggtgcagctggtggagtcgtgggggagcgtggtccagcctgggagtccctnagactctctgttagcctctggattcaccttcagtagttatcctttgcactgggtcctcaggctccaggcaaggggctggagtggggtggcagttanctcatttgatggananaataatacanganactcgtcgggcatcacatcacaaanacaattagaagaacacgtcttgttactagactaaatagaacagacctagagagacgtaggacggacgacggtatgttagttaacgttacgttgtttcgtttggttacgtcgtacgttcgggtacggggtaaacgttaccgttacgtacggtaccgtacggtcgggggtaccgacggg

SEQ ID NO: 327452 - DNA, 611 bp, Homo sapiens
  misc_feature: GZ8MTXP02IQZFL.10.53.E09.1.454.CMB.2.raw
  modified_base (347)..(347): a, c, t, g, unknown or other
  misc_feature (347)..(347): n is a, c, g, or t
  modified_base (359)..(359): a, c, t, g, unknown or other
  misc_feature (359)..(359): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggaggcgtggtccagcctggggacgtccctcagactctcctgttagcctctggattcaccttcagtagttatcctttgctacgtgggtccgtcaggctccgaggcaaggggctgggaggtggggtggctagttatctntatttgatgganaactaaataaatactaacaggtagaccgttcccgggttccgggggcccgtatttccaacctactactaccaaagaactaaatttagaaacgaacacgtacttgttactgacaaatagaacagacctagagagcgtaggacggacgacggtcgtagtgttatttacgttgtttcggtttggttcgtcggtacgttcgggttacgggggtaacttaccgttacgacggtcgtacggtacggggaccgtacgggg

SEQ ID NO: 327453 - DNA, 568 bp, Homo sapiens
  misc_feature: GZ8MTXP02G5E9G.10.53.E09.1.454.CMB.2.raw
  modified_base (246)..(246): a, c, t, g, unknown or other
  misc_feature (246)..(246): n is a, c, g, or t
  modified_base (311)..(311): a, c, t, g, unknown or other
  misc_feature (311)..(311): n is a, c, g, or t
  modified_base (352)..(352): a, c, t, g, unknown or other
  misc_feature (352)..(352): n is a, c, g, or t
  modified_base (355)..(355): a, c, t, g, unknown or other
  misc_feature (355)..(355): n is a, c, g, or t
  modified_base (367)..(367): a, c, t, g, unknown or other
  misc_feature (367)..(367): n is a, c, g, or t
  modified_base (447)..(447): a, c, t, g, unknown or other
  misc_feature (447)..(447): n is a, c, g, or t
  modified_base (457)..(457): a, c, t, g, unknown or other
  misc_feature (457)..(457): n is a, c, g, or t
tcagcatagtagtgcacgaccggtgctcgatttagagagagtgtgttgggtttggggctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggaggcgtggtccagccgtgggaggtcccctnagactctcctgttacgcctctggattccaccttcagttagttactcctttgctacgtgggtcctnaggcctccgaggcgaaggggctgggagtgggtgctagttanctnatttgatggaanacaaataaatctaacagacgaccgttccggtcggggcctattccacctatcctaacaaagactaattagaaacgaacacncttagttacngaactaaatagaacacgacctagaagagcgtaggacggacacggctgtagttacttacgttggttcgtttgtctgtactcgggtacgggaactctcgacgccgacgggccg

SEQ ID NO: 327454 - DNA, 720 bp, Homo sapiens
  misc_feature: GZ8MTXP02H5FSZ.10.53.E09.1.454.CMB.2.raw
  modified_base (249)..(249): a, c, t, g, unknown or other
  misc_feature (249)..(249): n is a, c, g, or t
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagctgggttttcctcgttgcttcttttaagaggtgtccagtgtcaggtgcagctggtggagtcgtgggggagcgtggtccagccgtgggacgtccctnagtactctcctgttacgcctcgtggacttccaccttcagttagttacttcctttgcctacgtcggggtcccgtcgaggcctcgaggcgaaggggctgggaggtgggtgctagttatcctatagtttgagttggaagaactaaattaaaacgtactaacgaaggtaacgtaccggttccggttacgggacccgtaacttccaaccctaacttacctaaccgtaaaacgtaaacctaaagtttaacgaaacgtaacctaaccgtactttacgtttaccgtaggtaacctaaaagtacgaaaacgacgtaacccgtaggaacggtaagaccggtaagggaacggaaaccggtacgggtacgtttaggttacgtttaagtttaaccggtttacggttttaccggttttggtttaccgttcggttaccggttacggggttaccgggggtaactttacccgttacgtacggtaccgg

SEQ ID NO: 327455 - DNA, 682 bp, Homo sapiens
  misc_feature: GZ8MTXP02IGNGB.10.53.E09.1.454.CMB.2.raw
  modified_base (249)..(249): a, c, t, g, unknown or other
  misc_feature (249)..(249): n is a, c, g, or t
  modified_base (268)..(268): a, c, t, g, unknown or other
  misc_feature (268)..(268): n is a, c, g, or t
  modified_base (355)..(355): a, c, t, g, unknown or other
  misc_feature (355)..(355): n is a, c, g, or t
  modified_base (370)..(370): a, c, t, g, unknown or other
  misc_feature (370)..(370): n is a, c, g, or t
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagcgtgggtttcctcgtgctctttaagaggtgtccagtgtcaggtgcagctggtggagtcgtgggggaggcgtggtccaggccgtggggacgtccctnagactctcctgttagcctntgatcaccttcagtagttatcctttgcacgtgggtcctcaggctccgaggccgaaggggctgggaggtgggtgctaggttatccctntagttgagtggaaanaactaataaactactaacgagtaacgtccgtaccgggttcgggaccgtactaccacctactacctaaccgtaaacgtaactaaagttaacgaaacgtaaacgtacgtacgttacgttacgtacgtaacgtaaaacgtacgaaacgtaacgtaccgtaaggaacgtaacgacgtacggaacggtaacgtacggtacgttaggttacgtttaacgtttaacggtttcggttttacggtttacggttaccgttaacggttaccggttaccgggggtaaccggggtaaaccgtttacccgttacggacggtaccgg

SEQ ID NO: 327456 - DNA, 553 bp, Homo sapiens
  misc_feature: GZ8MTXP02GVJEI.10.53.E09.1.454.CMB.2.raw
  modified_base (247)..(247): a, c, t, g, unknown or other
  misc_feature (247)..(247): n is a, c, g, or t
  modified_base (346)..(346): a, c, t, g, unknown or other
  misc_feature (346)..(346): n is a, c, g, or t
  modified_base (350)..(350): a, c, t, g, unknown or other
  misc_feature (350)..(350): n is a, c, g, or t
  modified_base (361)..(361): a, c, t, g, unknown or other
  misc_feature (361)..(361): n is a, c, g, or t
tcagcatagtagtgcacgaccggtgctcgatttagagagagtgtgttgggtttggggagctctgggagactagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggagcgtggtccagcctgggaggtccctnagactctcctgttagcctctggattcaccttcagtagttatcctttgctactgggtccgtcaggctccaggcaaggggctgggagtggggtgcagttancctnatttgatgganacataaatactacagagactcggtcgggcgatcacatctacaaagacaattagaagaacacgtcttgtttctagacaaatagaacacgccgtagagagcgtagacggacgacggtctagtagttatttacgttgtttcgtttggtttctggtacgttacggtacgggggtaacttaccgttacgacgtaccg

SEQ ID NO: 327457 - DNA, 627 bp, Homo sapiens
  misc_feature: GZ8MTXP02FW1FN.10.53.E09.1.454.CMB.2.raw
  modified_base (190)..(190): a, c, t, g, unknown or other
  misc_feature (190)..(190): n is a, c, g, or t
  modified_base (238)..(238): a, c, t, g, unknown or other
  misc_feature (238)..(238): n is a, c, g, or t
  modified_base (256)..(256): a, c, t, g, unknown or other
  misc_feature (256)..(256): n is a, c, g, or t
  modified_base (295)..(295): a, c, t, g, unknown or other
  misc_feature (295)..(295): n is a, c, g, or t
  modified_base (353)..(353): a, c, t, g, unknown or other
  misc_feature (353)..(353): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagctgggttttcctcgttgctcttttaagaggtgtccagtgtcaggtncagctggtggagtcgtgggggagcgtggtccagcctgggacgtccctnagctctcctgttagcctntggattcacttcagtagttatcctttgcactgggtcctnaggctccgaggcaaggggctgggagtggggtgctaggttatcgtctatttgatggganaactaataaaatactaacgagagaaccgttccggttcgggggcctaatttccaaccatcctacccaaagaacctaaagtttagaaacgaacgacgtcttacgtttactacgaacaaaagtacgaaactagaccctagagacgcgtagacggacgaccggtgtgttagttacgttacgtttggtttacggtttcggttcgttacgtaaccggtcggttacgggggtaaacttacccgtacgtacggtccgtacggtcggggtaccgtaaccgggg

SEQ ID NO: 327458 - DNA, 628 bp, Homo sapiens
  misc_feature: GZ8MTXP02GLKUV.10.53.E09.1.454.CMB.2.raw
  modified_base (239)..(239): a, c, t, g, unknown or other
  misc_feature (239)..(239): n is a, c, g, or t
  modified_base (353)..(353): a, c, t, g, unknown or other
  misc_feature (353)..(353): n is a, c, g, or t
  modified_base (368)..(368): a, c, t, g, unknown or other
  misc_feature (368)..(368): n is a, c, g, or t
  modified_base (388)..(388): a, c, t, g, unknown or other
  misc_feature (388)..(388): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggagcgtggtccagccgtgggaggtccctnagactctcctgttacgcctctggattcaccttcagtagttatcctttgctacgtcgggtccgtcagggcctccgaggcgaaggggctgggaggtggggtggctaggtttatctntatttgagtaggaanaactaaaataaatacctaanagacgtactccggttcggggacctattccaaccatactaccaaagaactaaattagaaacgaacacgtacttgttacctagtaactaaaatacgaaacgacgtaccgtagagacgtacgtaggaacggacgacggacgtagtagttattacgttgtttcggttcggtttcgtacgtaccgttcggtacgggggtaaacttacccgttacgacggtcgtacggtacggggaccgaaccggg

SEQ ID NO: 327459 - DNA, 546 bp, Homo sapiens
  misc_feature: GZ8MTXP02JP920.10.53.E09.1.454.CMB.2.raw
  modified_base (237)..(237): a, c, t, g, unknown or other
  misc_feature (237)..(237): n is a, c, g, or t
  modified_base (258)..(258): a, c, t, g, unknown or other
  misc_feature (258)..(258): n is a, c, g, or t
  modified_base (338)..(338): a, c, t, g, unknown or other
  misc_feature (338)..(338): n is a, c, g, or t
  modified_base (365)..(365): a, c, t, g, unknown or other
  misc_feature (365)..(365): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggagcgtggtccagcctgggaggtcccncagactctcctgtttagcctntggattcaccttcagtagttatccctttgctactgggtccgtcaggctccgaggcaaggggctggagtgggtgcagttanctcatttgatggagacaataatactanagagactccgttcgggggccattcaccatctaccaaagacaattagaagacacgctgttctgacaaatagaacacgacgtagagagcgtaggagacgacggctgtgtacttacttgttcgtttggttctcgacgtcggtacgggggtaactaccgtacgtacgcgtacgtcgggcgacggg

SEQ ID NO: 327460 - DNA, 601 bp, Homo sapiens
  misc_feature: GZ8MTXP02GBS6J.10.53.E09.1.454.CMB.2.raw
  modified_base (155)..(155): a, c, t, g, unknown or other
  misc_feature (155)..(155): n is a, c, g, or t
  modified_base (239)..(239): a, c, t, g, unknown or other
  misc_feature (239)..(239): n is a, c, g, or t
  modified_base (345)..(345): a, c, t, g, unknown or other
  misc_feature (345)..(345): n is a, c, g, or t
  modified_base (348)..(348): a, c, t, g, unknown or other
  misc_feature (348)..(348): n is a, c, g, or t
  modified_base (362)..(362): a, c, t, g, unknown or other
  misc_feature (362)..(362): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagcgtggtttccncgttagctctttaagaggtgtccagtgtcaggtgcagctgggtggagtcgtgggggagcgtggtccagcctgggaggtcccctnagactctcctgttagcctctggattcacttcagtagttatcctttgctacgtgggtccgtcagggcctccgaggccgaaggggctgggaggtggggtggcagttanctnatttgactaggaanacaaataaactactaacaggacgtaccgtccgggttcgggggacctatttccacccattccaacccaaagtaactaagtttagaaaacgacgacgtcgttagtttaccagtaactaaagtacgaacacggctaggagagcgagaggacgacggtacgtgtagtacttacgttgtttcgttggttcgtacgtacgtcggtacgggtaacgtacgtacgtacgacgacgtcggcgtaccgg

SEQ ID NO: 327461 - DNA, 823 bp, Homo sapiens
  misc_feature: GZ8MTXP02IAM7C.10.53.E09.1.454.CMB.2.raw
  modified_base (249)..(249): a, c, t, g, unknown or other
  misc_feature (249)..(249): n is a, c, g, or t
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagcgtgggttttcctcgttgcttcttttaagaggtgtccagtgtcaggtgcagctggtggagtcgtgggggagcgtggtccagcctgggacgtccctnagactctcctgttacgcctctggacttcaccttcagtagttatcctttgcctacgttcgggtcccgtcgacggtcctaccgagggccgaaagggggtccgtaggggtaggtggggtcggaccgtaaggtttacgtccttacgtaagttttggaagttaggggaacgtaaaactaaattaaaactttacctaaaccgaaggtaacgtaacccggttccccggggtttaccgggggtacccgtaacgtttacccgaaccctaacttacccgtaacccgtaaaaacgtaaaccgttaaagttttaacggaaaaccggtaaaccgtaaccggtaccgtttacggtttttaccgtacggttaacctaaaagttacggtaaaccgtaacggacccgttaaggaacggtaaaggttccgtaagggtaaacgggaaacccggtacgggtaccgttaggtttaacggtttaagttttaacggtttcgggttttcgtttttacggggtttcgttaacgggttacccggttaccgggggtttacgggggtaaacctttacccggtttaccggtaacgtacccggg

SEQ ID NO: 327462 - DNA, 559 bp, Homo sapiens
  misc_feature: GZ8MTXP02JC8LN.10.53.E09.1.454.CMB.2.raw
  modified_base (238)..(238): a, c, t, g, unknown or other
  misc_feature (238)..(238): n is a, c, g, or t
  modified_base (347)..(347): a, c, t, g, unknown or other
  misc_feature (347)..(347): n is a, c, g, or t
  modified_base (413)..(413): a, c, t, g, unknown or other
  misc_feature (413)..(413): n is a, c, g, or t
  modified_base (470)..(470): a, c, t, g, unknown or other
  misc_feature (470)..(470): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggagcgtggtccagccgtgggagtccctnagactctcctgttagcctctggattcacttcagtattatcctttgcactgggtcctcaggctccaggcaaggggctggagtgggtgctagttatctctatttgatgganacaaataaatactacagagactccggtcggggcctattccactatctaccaaagactaattagaanaacacgcttagttctagtacaaatcgaaacagcctagagagctagacggacacggtntagtagttacttacgttgtttcgttgttcgtacgtacggttcggtacgggtaactaccgttacgacgtacgtacggtcgggaccgacgg

SEQ ID NO: 327463 - DNA, 648 bp, Homo sapiens
  misc_feature: GZ8MTXP02IXPDF.10.53.E09.1.454.CMB.2.raw
  modified_base (345)..(345): a, c, t, g, unknown or other
  misc_feature (345)..(345): n is a, c, g, or t
  modified_base (348)..(348): a, c, t, g, unknown or other
  misc_feature (348)..(348): n is a, c, g, or t
  modified_base (377)..(377): a, c, t, g, unknown or other
  misc_feature (377)..(377): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagcttgggttttcctcgttgctcttttaagaggtgtccagtgtcaggtgcagctggtggagtcgtgggggaggcgtggtccagccgtgggacgtccctcagctctcctgttacgcctctggattcaccttcagttagttatcctttgcacgtcgggtcctcaggctccgaggcgaaggggctgggaggtggggtgctagttanctntatttgactggataacaaataaatactanagagaccgttccggtcgggggacctattccacctatacctaccaaaagaactaaattagaaacgaacacgtcttagttactagaaccaaaagttacgaaactacgacctaggaacgagtaccgtaggaacggtacgaccgggtactggttagttactttacggtttcggtttacggtttcggtttcgtacggtaccggttacggggttaaccgggggtaacttaccgttacggtacggtaccgtaaccggtcgggggacccggtaccgggg

SEQ ID NO: 327464 - DNA, 587 bp, Homo sapiens
  misc_feature: GZ8MTXP02JYLRR.10.53.E09.1.454.CMB.2.raw
  modified_base (239)..(239): a, c, t, g, unknown or other
  misc_feature (239)..(239): n is a, c, g, or t
  modified_base (352)..(352): a, c, t, g, unknown or other
  misc_feature (352)..(352): n is a, c, g, or t
  modified_base (362)..(362): a, c, t, g, unknown or other
  misc_feature (362)..(362): n is a, c, g, or t
  modified_base (367)..(367): a, c, t, g, unknown or other
  misc_feature (367)..(367): n is a, c, g, or t
  modified_base (456)..(456): a, c, t, g, unknown or other
  misc_feature (456)..(456): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctgggtggagtcgtgggggagcgtggtccagcctgggaggtccctnagactctcctgttagcctctggattcaccttcagtagttatcctttgctactgggtcctcaggctccgaggcaaggggctggagtggggtgctagttatctcatttgatgganactaaataanactanagagtactccggttcgggctatcaccatctaccaaagactaatttagaagaacacgtctgttacctagacaaatagaacacgctagganagacgtaggaacggaacgacgggtctgtacgttagtttaacgttggtttcggttttggttcgttacggtaccgttcggggtacgggggtaacttaccgttacgacggtcaccggtcgggggaccaacgggg

SEQ ID NO: 327465 - DNA, 613 bp, Homo sapiens
  misc_feature: GZ8MTXP02HWHB3.10.53.E09.1.454.CMB.2.raw
  modified_base (331)..(331): a, c, t, g, unknown or other
  misc_feature (331)..(331): n is a, c, g, or t
  modified_base (464)..(464): a, c, t, g, unknown or other
  misc_feature (464)..(464): n is a, c, g, or t
tcagcatagtagtgcacgaccggtgctcgatttagagagagtgtgttgggttgggggagctacaacaggcaggcaggggcagcaagatggtgttgcagacccaggtcttcatttctctgttgctctggatctctggtgccgtacggggacatcgtgatgacccagtctccagacctccctgcctgtgtctcgtgggcgagacgggccaccatcaactgacaagtccagccagtagttgtttatcagtcctaccgaacaaataacgaacttacttagcttacggaccagacaagaaaccaggacagccctactaagctgctactatttacgnggcacgtccgtaacccgggaacgtcccccggggtccctagacccgtattcgaggtcggcgagggcgggtcgtacggggactaggtactttccacttctaccaccatccagcacgcctgaccgagctagaacgngtcggcgtacttagtttactacgtcgtacacgctaacttattaacgtacccgttaccctatttaccaacgtacgttacccggacccgttaacgggaaacctaaaggtaacggaactaacgtaaccgaaaacgtacgtacggtacgaccg

SEQ ID NO: 327466 - DNA, 630 bp, Homo sapiens
  misc_feature: GZ8MTXP02GSAJ7.10.53.E09.1.454.CMB.2.raw
  modified_base (240)..(240): a, c, t, g, unknown or other
  misc_feature (240)..(240): n is a, c, g, or t
  modified_base (359)..(359): a, c, t, g, unknown or other
  misc_feature (359)..(359): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagctgggttttcctcgttgcttcttttaagaggtgtccagtgtcaggtgcagctggtggagtcgtgggggagcgtggtccagccgtgggacgtccctnagactctcctgttagcctctggattcaccttcagtagttatcctttgctacgtgggtccgtcaggcctccgaggcaaggggctgggaggtggggtggctagttatctcatttgatgganacaaataatactacagagactccggttacggggcctattccacctatctaccaaagactaattagaaagtaaccacgtcttcgttactagactaaatacgaacacgtacctaggaagagacgtaggaacggacgaacggtcttcggtagttaacgtttacgtttggttttccggttttggtttaccgttcggtaccgttacgggggttaccgggggtaaacttacccgtttacgacggtacccgtacggttcgggggacccgtaccggggg

SEQ ID NO: 327467 - DNA, 627 bp, Homo sapiens
  misc_feature: GZ8MTXP02ISNIG.10.53.E09.1.454.CMB.2.raw
  modified_base (238)..(238): a, c, t, g, unknown or other
  misc_feature (238)..(238): n is a, c, g, or t
  modified_base (256)..(256): a, c, t, g, unknown or other
  misc_feature (256)..(256): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggagcgtggtccagccgtgggagtccctnagactctctgttagcctntggatcaccttcagtagttatcctttgctacgtgggtccgtcaggctccgaggcaaggggctgggaggtgggtggctagttatctctagtttgatggaataacaaattaaactactaacaggtacgtaccgttccgggttccgggggacctatttcccgaactactactacctaaaagaactaaagtttagaaacgaacacgtcttgttactagtactaaatagaaacagacctaggacgagcgtaggacggaacgacggtacgtgttacgttacgttacgtttcgtttacggttttcggttcgttacggtacgttccgggttacggggtaacttaccgttcgtacgcgtacggtcggggaccgtacgggg

SEQ ID NO: 327468 - DNA, 569 bp, Homo sapiens
  misc_feature: GZ8MTXP02H7SK8.10.53.E09.1.454.CMB.2.raw
  modified_base (246)..(246): a, c, t, g, unknown or other
  misc_feature (246)..(246): n is a, c, g, or t
  modified_base (266)..(266): a, c, t, g, unknown or other
  misc_feature (266)..(266): n is a, c, g, or t
  modified_base (353)..(353): a, c, t, g, unknown or other
  misc_feature (353)..(353): n is a, c, g, or t
  modified_base (474)..(474): a, c, t, g, unknown or other
  misc_feature (474)..(474): n is a, c, g, or t
tcagcatagtagtgcacgaccggtgctcgatttagagagagtgtgttgggtttgggagctctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggagcgtggtccagccgtgggagtccctnagactctcctgttacgcctntgattcaccttcagtattatcctttgcacgtggtccgtcaggcctccgaggcgaaaggggctggagtggggtggcaggttatccgtntagtttgagtggaagaactaataaaatataacagacgacctccgttacgggcctacgtcaccactacaccaaagaactaattagaaacgacaacgtactgtttactgtacaaatacgaaanacgactagagagctagacggaacacggcgtgtagtattacgttgttcgtttgttcgtgtacgtacggtacggggtaactaccgttacgacgtacg

SEQ ID NO: 327469 - DNA, 576 bp, Homo sapiens
  misc_feature: GZ8MTXP02GSQ50.10.53.E09.1.454.CMB.2.raw
  modified_base (245)..(245): a, c, t, g, unknown or other
  misc_feature (245)..(245): n is a, c, g, or t
  modified_base (349)..(349): a, c, t, g, unknown or other
  misc_feature (349)..(349): n is a, c, g, or t
  modified_base (353)..(353): a, c, t, g, unknown or other
  misc_feature (353)..(353): n is a, c, g, or t
  modified_base (364)..(364): a, c, t, g, unknown or other
  misc_feature (364)..(364): n is a, c, g, or t
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagcgtgggtttcctcgttgctctttaagaggtgtccagtgtcaggtgcagctggtggagtcgtgggggagcgtggtccagcctgggagtccctnagctctcctgtttacgcctctggacttcaccttcagtagttatcctttgcctacgtgggtcctcgaggctccgaggcgaaggggctgggagtgggtgcagttancctnatttgatgganaacataaatctacagagactcgggtcgggcatcacactctaccaaagactaattagaaagtacacgtacttgttctagacaatacgaacacgacctagagagccgtagaacggacgaacggtctggttagttacgttaccgttggtttccgtttggttacgtcggttaccgttcggggttacgggggtaacttaccggttactaacgtccgg

SEQ ID NO: 327470 - DNA, 569 bp, Homo sapiens
  misc_feature: GZ8MTXP02GUS3P.10.53.E09.1.454.CMB.2.raw
  modified_base (239)..(239): a, c, t, g, unknown or other
  misc_feature (239)..(239): n is a, c, g, or t
  modified_base (340)..(340): a, c, t, g, unknown or other
  misc_feature (340)..(340): n is a, c, g, or t
  modified_base (351)..(351): a, c, t, g, unknown or other
  misc_feature (351)..(351): n is a, c, g, or t
tcagcatagtagtgcacgaccggtgctcgatttagagagagtgtgttgggtttgggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggagcgtggtccagccgtgggagtccctnagactctcctgtttagcctctggattcaccttcagtagttatcctttgctactgggtccgtcaggctccaggcaaggggctggagtgggtgcagttatctnatttgatgganacaataaatactacagagactccggttcggggccatcaccatctacaaagacaattagaagacacgctagttctgacaaatagaacagcctaggagagcgtagacggacgacggactggtagttaatttacgttggtttcgtttcggttcgtgtaacgttcgggttacgggggtaaacttaccgtttacgacgacctaccggtcggggaccgacgggg

SEQ ID NO: 327471 - DNA, 634 bp, Homo sapiens
  misc_feature: GZ8MTXP02I62BL.10.53.E09.1.454.CMB.2.raw
  modified_base (268)..(268): a, c, t, g, unknown or other
  misc_feature (268)..(268): n is a, c, g, or t
  modified_base (300)..(300): a, c, t, g, unknown or other
  misc_feature (300)..(300): n is a, c, g, or t
  modified_base (376)..(376): a, c, t, g, unknown or other
  misc_feature (376)..(376): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagcgtggtttcgcgtagctctttaagaggtgtccagtgtcaggtgcagctggtggagtcgtgggggagcgtggtccagcctgggagtccctcagactctcctgtttacgcctctggattcaccttnagtagttctcttgctacgtcggtcctgacgcncgaggcgaggggctggaggtgggtgactagttactcgtatatttgagtaggaactaaataaattaaactactaacngtacgtaccgttccgggtcgggactactaccactactcaacgaaagtacgtaagttaacgaaacgtaaccgtacgttcgttacgttacgtagtaactaaacgtaacgaacgtacgtacgtacgacgacgacgtaggacggacgacggtacgtagttagttacgttacgtttcgtttcggtttcggttcgttacgtacggtacgggttacgggtaacgttacgttaccgtacggtacgtacggtacgggtacggtacgg

SEQ ID NO: 327472 - DNA, 699 bp, Homo sapiens
  misc_feature: GZ8MTXP02JQRXZ.10.53.E09.1.454.CMB.2.raw
  modified_base (191)..(191): a, c, t, g, unknown or other
  misc_feature (191)..(191): n is a, c, g, or t
  modified_base (240)..(240): a, c, t, g, unknown or other
  misc_feature (240)..(240): n is a, c, g, or t
  modified_base (257)..(257): a, c, t, g, unknown or other
  misc_feature (257)..(257): n is a, c, g, or t
  modified_base (341)..(341): a, c, t, g, unknown or other
  misc_feature (341)..(341): n is a, c, g, or t
  modified_base (354)..(354): a, c, t, g, unknown or other
  misc_feature (354)..(354): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagctgggttttcctcgttgcttcttttaagaggtgtccagtgtcaggtncagctggtggagtcgtgggggagcgtggtccagccgtgggacgtccctnagactctctgttagctntgatcacttcagtagttatcctttgctacgtgggtcctcaggcctccgaggcgaaggggctgggagtggggtgctagttatctnatttgagtggaanaacaaataaatactaacagaacgtaccgttcccgggttacgggggaccctatttcccaaccctactacccttaaaccgaaaacgaaccttaaaagtttacgaaaaacgtaaaccgtaaccggttctttacggtttaccgtacggtaaacctaaaagttacgaaaccgagtaccctagggaacgaacggtaccgtaggaacgggacctaacgggtcgttaggttacgttaacgtttacgtttcgggttttacggttttcgggttccgttacggtaacccggttcggggtacggggtaaaccttaccgttacgacgtccgtaaccggtcggggacccgtaaccgggg

SEQ ID NO: 327473 - DNA, 604 bp, Homo sapiens
  misc_feature: GZ8MTXP02IGL4Q.10.53.E09.1.454.CMB.2.raw
  modified_base (240)..(240): a, c, t, g, unknown or other
  misc_feature (240)..(240): n is a, c, g, or t
  modified_base (259)..(259): a, c, t, g, unknown or other
  misc_feature (259)..(259): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctgggtggagtcgtgggggagcgtggtccaggcctggggagtccctnagctctccttgttagcctntggattcacttcagtagttatcctttgctacgtgggtcctcaggctccgaggcgaaaggggctggaggtggggtggctaggttatcgtctatttgatggagacaaataaatactaacagacgtactccggttaccggggccgtattcaaccactactaccaaacgactaattagaagaacacgtctagttctagtacaaagttacgaactagaccgtagagtacgacgtaggacggacgacggtcgtagttcgttaatttacgttggtttcgtttcggttcgttcgtacgttcggtacgggggtaacttaccgttacgtacgacgtacggtcgggacgacccggg

SEQ ID NO: 327474 - DNA, 559 bp, Homo sapiens
  misc_feature: GZ8MTXP02GHP30.10.53.E09.1.454.CMB.2.raw
  modified_base (258)..(258): a, c, t, g, unknown or other
  misc_feature (258)..(258): n is a, c, g, or t
  modified_base (339)..(339): a, c, t, g, unknown or other
  misc_feature (339)..(339): n is a, c, g, or t
  modified_base (342)..(342): a, c, t, g, unknown or other
  misc_feature (342)..(342): n is a, c, g, or t
  modified_base (353)..(353): a, c, t, g, unknown or other
  misc_feature (353)..(353): n is a, c, g, or t
  modified_base (363)..(363): a, c, t, g, unknown or other
  misc_feature (363)..(363): n is a, c, g, or t
tcagcatagtagtgcacgaccggtgctcgatttagagagagtgtgttgggtttgggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggaggcgtggtccagcctgggagtccctcagactctcctgttagcctntggattcacttcagtattatcctttgctacgtgggtccgtcaggctccgaggcgaaggggctgggagtggggtgcagttanctnatttgatgganacaaataaanactacagagactcggtcgggcctatcaccatctaccaaagacaattagaaagaacacgtcttgttacagaacaaatgaaacagacctagagaagctaggaggaacacggactgtgttaattcgttggtttcgtttaggttctgtaccgtcggtacggggtaatccttacgacgccgtacggtcggggaccacgggg

SEQ ID NO: 327475 - DNA, 626 bp, Homo sapiens
  misc_feature: GZ8MTXP02JQ6O3.10.53.E09.1.454.CMB.2.raw
  modified_base (243)..(243): a, c, t, g, unknown or other
  misc_feature (243)..(243): n is a, c, g, or t
tcagcatagtagtgcacgaccggtgctcgatttagagagagtgtgttgggtttggggctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggagcgtggtccagccgtgggagtccctnagactctcctgttagcctctggattcaccttcagtagttatcctttgcacgtgggtccgtcaggctccgaggcaaggggctgggaggtggggtgctagttatctctatttgataggaagaacaaattaaatctaacagtaacgtaccgtccgggttcggggacctattaccgaacctatacctaccaaaagtactaaatttacgaaacgtaaacacgtcttagtttactagtactaaaatagaaacacggtacctagaagagacgtaggaacggtacgaacggtctacggttagttaatttaccgttggtttcggtttcggttacgtggtaccgttcgggttacggggtaacttacccgttacgacgtacgtaacggtccggg

SEQ ID NO: 327476 - DNA, 577 bp, Homo sapiens
  misc_feature: GZ8MTXP02GOA84.10.53.E09.1.454.CMB.2.raw
  modified_base (247)..(247): a, c, t, g, unknown or other
  misc_feature (247)..(247): n is a, c, g, or t
  modified_base (264)..(264): a, c, t, g, unknown or other
  misc_feature (264)..(264): n is a, c, g, or t
  modified_base (276)..(276): a, c, t, g, unknown or other
  misc_feature (276)..(276): n is a, c, g, or t
  modified_base (304)..(304): a, c, t, g, unknown or other
  misc_feature (304)..(304): n is a, c, g, or t
  modified_base (342)..(342): a, c, t, g, unknown or other
  misc_feature (342)..(342): n is a, c, g, or t
  modified_base (356)..(356): a, c, t, g, unknown or other
  misc_feature (356)..(356): n is a, c, g, or t
  modified_base (365)..(365): a, c, t, g, unknown or other
  misc_feature (365)..(365): n is a, c, g, or t
  modified_base (369)..(369): a, c, t, g, unknown or other
  misc_feature (369)..(369): n is a, c, g, or t
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggagcgtggtccagccgtgggagtccctnagctctctgttagcctntgattcaccttnagtagttatccttgctacgtgggtcctnaggctccgaggcgaaggggctggagtgggtgcagttcnctctattgatgganaacataaanctanagatactcggtcggcatcacatcacaaagactaattagaaagacacgtactgttactagacaaatagaacacgtccgtagaagacgacgtagaacggtacgaacgggtcgttagtacgttacgtttaacgttcgttttaccggtttggtttaccgttaacggtaccgttacggggtaccgggggtaacttaccgttacgacgtaccgg

SEQ ID NO: 327477 - DNA, 618 bp, Homo sapiens
  misc_feature: GZ8MTXP02GQYJZ.10.53.E09.1.454.CMB.2.raw
  modified_base (238)..(238): a, c, t, g, unknown or other
  misc_feature (238)..(238): n is a, c, g, or t
  modified_base (256)..(256): a, c, t, g, unknown or other
  misc_feature (256)..(256): n is a, c, g, or t
tcagcatagtagtgcacgaccggtgctcgatttagagagagtgtgttgggtttgggggagacgagcccagcactggaagtcgccggtgtttccattcggtgatcatcactgaacacagaggactcaccatggagtttgggctgagcgtgggtttcctcgttgctctttaagaggtgtccagtgtcaggtgcagctggtggagtcgtgggggagcgtggtccagccgtgggagtccctnagctctcctgttagcctntggattcacttcagtattatccctttgctacgtgggtcctcaggcctccgaggcgaaggggctggaggtgggtgactagtttatctctagtttgagtgggaataacaaataaatacctaagagacgtaccgtcccgggttcgggggaccctaatttccaaccctaactacctaaccaaaacgaactaatttaagaaagaaccaacgtcttagtttacagactaaactagaacagaccgtagaagacgcgtaggacgacgacggtactgtagttacgttacgttggtttcggttggttacgtacgtacggttcgggttacgggtaacgttaccgtacgtacgcgtacggtcgggaccgtacgg

SEQ ID NO: 327478 - DNA, 809 bp, Homo sapiens
  misc_feature: GZ8MTXP02JXDEI.10.53.E09.1.454.CMB.2.raw
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggagcgtggtccaggccgtggggacggtccctcgagacctctccttgtttacgccctctggactttccaccttcagttagttactcctttgcctacgtgggtcccgtcaggcctccgaggcgaaggggtctggggaggtggggtggctaggtttatcgttactagttttggaacgttaggggaaagtaacctaaaaattaaaacgtaccgttaaaccgagggtaaaccggtaacccgttcccccggggtttacgggggacccctaagtttacccgaaccctaacttacccgtaaacccgtaaaaacgtaacctaaaagtttaacgaaaacgtaaacctacggttaccgttagttttacctacgaaacgtaaaacgttaagaaaacccgtaacgtacccgtaagggtaaacggaacggtacggttacgggaaacgggtaaccgtaacccggggtgtttacgggttaagttttaacgtttaaccggtttcgggttttaacggtttttcggtttaccgttacggtaccggtttaccggggttacgggggtaaactttacccgttacggacgtaccgacgggttccggggaccggtaacccggg

SEQ ID NO: 327479 - DNA, 573 bp, Homo sapiens
  misc_feature: GZ8MTXP02I0205.10.53.E09.1.454.CMB.2.raw
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtctgggggagcgtggtccagcctgggagtccctcagactctcctgttagcctctggattcaccttcagttagttactcctttgcacgtgggtcccgtcaggcctccgaggcaaggggctgggaggttggggtgcaggtttatcctcatttgatggagacataaatactacagagactccggttcgggccgattccacatactaccaaaagactaaatttagaaagaaacacgacttgtttactagacaaatgaaacagcctagagagcgtagaaggacgaacggctaggtgttattacgttgtttacggtttggtttcgtcgtacgttccgggttacggggtaacttaccgttacgacgtcg

SEQ ID NO: 327480 - DNA, 558 bp, Homo sapiens
  misc_feature: GZ8MTXP02F59BZ.10.53.E09.1.454.CMB.2.raw
  modified_base (239)..(239): a, c, t, g, unknown or other
  misc_feature (239)..(239): n is a, c, g, or t
  modified_base (258)..(258): a, c, t, g, unknown or other
  misc_feature (258)..(258): n is a, c, g, or t
  modified_base (300)..(300): a, c, t, g, unknown or other
  misc_feature (300)..(300): n is a, c, g, or t
  modified_base (342)..(342): a, c, t, g, unknown or other
  misc_feature (342)..(342): n is a, c, g, or t
  modified_base (345)..(345): a, c, t, g, unknown or other
  misc_feature (345)..(345): n is a, c, g, or t
  modified_base (356)..(356): a, c, t, g, unknown or other
  misc_feature (356)..(356): n is a, c, g, or t
  modified_base (370)..(370): a, c, t, g, unknown or other
  misc_feature (370)..(370): n is a, c, g, or t
  modified_base (413)..(413): a, c, t, g, unknown or other
  misc_feature (413)..(413): n is a, c, g, or t
  modified_base (426)..(426): a, c, t, g, unknown or other
  misc_feature (426)..(426): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagcttgggttttcctcgttgctcttttaagaggtgtccagtgtcaggtgcagctggtggagtcgtgggggagcgtggtccaggcctgggagtccctnagactctcctgttagcctntggattcaccttcagtagttatcctttgctacgtgggtcctnaggcctccgaggcaaggggctagggagtgggtggctagttanctnatttgatgganacaaataatactangagactcggtcgggcattcactatctacaaagacaattgaaanacacgctgttacngacaaatgaacagcctagacagtcgagaggacgacggctgtatattacgtgtttcggttgttaccgtagtaccgttcggggtacggggtaaacttaccgttacgacgtcgtacggtcggggacccgaacggg

SEQ ID NO: 327481 - DNA, 686 bp, Homo sapiens
  misc_feature: GZ8MTXP02IOHQH.10.53.E09.1.454.CMB.2.raw
  modified_base (240)..(240): a, c, t, g, unknown or other
  misc_feature (240)..(240): n is a, c, g, or t
  modified_base (259)..(259): a, c, t, g, unknown or other
  misc_feature (259)..(259): n is a, c, g, or t
  modified_base (271)..(271): a, c, t, g, unknown or other
  misc_feature (271)..(271): n is a, c, g, or t
  modified_base (363)..(363): a, c, t, g, unknown or other
  misc_feature (363)..(363): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtggagtcgtgggggagcgtggtccagccgtgggacgtcccnagactctctgttacgcctntgattcaccttnagttattctcctttgctacgtcgggtcctcaggcctccgaggcgaaggggctgggaggtggggtgctagttatctatagtttgagtaggaanaactaaaattaaactactaacagtacgtaccgttccgggttaccgggggacctatttacccaacctactacctaaaccaaaagtaactaaagtttagaaaacgtaactacgtacttacgttactagtaactaaagtacgaaaacgtacgtacctaggaacgacgtaccgtaggaacggacgtaacggtcgttaggttacgtttacgtttacgtttacggttttcggttttacggttcgttacggtaccggtttacgggttaccgggggtaaacttaccgttaccgtacgtaccggtaccggtacgggggtacctaaacccggg

SEQ ID NO: 327482 - DNA, 572 bp, Homo sapiens
  misc_feature: GZ8MTXP02JT9TD.10.53.E09.1.454.CMB.2.raw
  modified_base (248)..(248): a, c, t, g, unknown or other
  misc_feature (248)..(248): n is a, c, g, or t
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtggagtcgtgggggagcgtggtccagcctgggagtccctnagctctcctgttacgcctctggattcaccttcagtagttatcctttgctacgtgggtccgtcaggctccgaggcaaggggctggagtgggtgctagttatcctcatttgatggaagaacataaactactaacagagtacctccgggttcggggccgtattccaccatacctaccaaagactaatttagaaacgaacacgtcttgtttcagacaaatacgaaacacgccgtagagacgcgtagacggacacggctgtacgttattacgttgtttcgtttcggttcgtcgtacgtcgggtacggggtactaccgttacgacgtacg

SEQ ID NO: 327483 - DNA, 752 bp, Homo sapiens
  misc_feature: GZ8MTXP02HFQ1L.10.53.E09.1.454.CMB.2.raw
  modified_base (251)..(251): a, c, t, g, unknown or other
  misc_feature (251)..(251): n is a, c, g, or t
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagctgggttttcctcgttgcttcttttaagaggtgtccagtgtcaggtgcagctgggtggagtcgtgggggagcgtggtccaggccgtgggacgtccctnagctctcctgtttacgcctctggattccacttcagtagttactcctttgctacgttcggggtcctcgaggcctacccgaggtaccgaaagggggtcctggggagttggggttggctaaggtttatccctacgtagttttaggaattcggggaaactaaactaattaaaacttaaccgtaaacgaaggtaaccggtaccgtttccccgggggtttacggggggacccttaagtttacccgaaacctacgttacccttaacccgaaaacggtaacctaaagttttaacggaaaacgtaaaccgtaccggtacgtttacgtttttaccgacggtaaacctaaaagttacggaaaccgaacgtccgtaagacggacgtaccggtaggaaacgaccggtaacggtcgttaggttagtttacgtttaccgttggtttacggttttcggttacgttcggtaacggttccgggggttaacgggtaacttacccgttacgacggtaccgg

SEQ ID NO: 327484 - DNA, 546 bp, Homo sapiens
  misc_feature: GZ8MTXP02JF6UY.10.53.E09.1.454.CMB.2.raw
  modified_base (237)..(237): a, c, t, g, unknown or other
  misc_feature (237)..(237): n is a, c, g, or t
  modified_base (257)..(257): a, c, t, g, unknown or other
  misc_feature (257)..(257): n is a, c, g, or t
  modified_base (327)..(327): a, c, t, g, unknown or other
  misc_feature (327)..(327): n is a, c, g, or t
  modified_base (336)..(336): a, c, t, g, unknown or other
  misc_feature (336)..(336): n is a, c, g, or t
  modified_base (350)..(350): a, c, t, g, unknown or other
  misc_feature (350)..(350): n is a, c, g, or t
  modified_base (365)..(365): a, c, t, g, unknown or other
  misc_feature (365)..(365): n is a, c, g, or t
  modified_base (408)..(408): a, c, t, g, unknown or other
  misc_feature (408)..(408): n is a, c, g, or t
tcagcatagtagtgcacgaccggtgctcgatttagagagagtgtgttgggtttgggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtctgggggagcgtggtccagcctgggagtccctnagactctcctgtttagcctntggattcaccttcagtagttatcctttgcactgggtccgtcaggctccaggcaaggggctggaggtgggngcagtttanctcatttgatgganacaataaatactacngagactccgttcggggccattcacatctacaagacattagaanacacgctgttactgacaaatagaacagcctagagagacgtggagacgacggtactgtagtattacgttagtttcgtttggttcgtcgtacgtcggtacgggggaactaccgttacacgcgacgtcggggaccgacggg

SEQ ID NO: 327485 - DNA, 534 bp, Homo sapiens
  misc_feature: GZ8MTXP02JSD4P.10.53.E09.1.454.CMB.2.raw
  modified_base (246)..(246): a, c, t, g, unknown or other
  misc_feature (246)..(246): n is a, c, g, or t
  modified_base (309)..(309): a, c, t, g, unknown or other
  misc_feature (309)..(309): n is a, c, g, or t
  modified_base (377)..(377): a, c, t, g, unknown or other
  misc_feature (377)..(377): n is a, c, g, or t
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggagcgtggtccagcctgggagtccctnagctctcctgtttagcctctggattcaccttcagttagttatccctttgctactgggtccgtnaggctccgaggcaaggggctggagtgggtgcagttatcctcatttgatggagacataaatctacaganacgtccgtcgggccgattcaccatctaccaaagacaatttagaaagaacacgactgtttctgacaaatagaaaccagcctagagagcgtagagacacggctgtctagttactgttcgtttgttctgcgtacggtcggggtactaccgttcacgtacg

SEQ ID NO: 327486 - DNA, 560 bp, Homo sapiens
  misc_feature: GZ8MTXP02JD9FW.10.53.E09.1.454.CMB.2.raw
  modified_base (237)..(237): a, c, t, g, unknown or other
  misc_feature (237)..(237): n is a, c, g, or t
  modified_base (256)..(256): a, c, t, g, unknown or other
  misc_feature (256)..(256): n is a, c, g, or t
  modified_base (268)..(268): a, c, t, g, unknown or other
  misc_feature (268)..(268): n is a, c, g, or t
  modified_base (356)..(356): a, c, t, g, unknown or other
  misc_feature (356)..(356): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggagcgtggtccagcctgggagtccctnagactctcctgttagcctntgattcaccttnagtagttatcctttgcacgtgggtcctcaggctccaggcaaggggctgggaggtggggtggctagtttactctctatttgatgggaanacaaataaatactaacagagtactccggttcgggggcctattccactatctaccaaagactaattagaagaacacgctgttctgacaaatagaacagacctagagagctaggaggacgacggctgtagtattacgtgtttcgttggttcgtgtacgtcggtacggggaattaccgttacacgacgacggtcggggccgtacggg

SEQ ID NO: 327487 - DNA, 593 bp, Homo sapiens
  misc_feature: GZ8MTXP02JZ1Z9.10.53.E09.1.454.CMB.2.raw
  modified_base (249)..(249): a, c, t, g, unknown or other
  misc_feature (249)..(249): n is a, c, g, or t
  modified_base (268)..(268): a, c, t, g, unknown or other
  misc_feature (268)..(268): n is a, c, g, or t
  modified_base (281)..(281): a, c, t, g, unknown or other
  misc_feature (281)..(281): n is a, c, g, or t
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtggagtcgtgggggagcgtggtccagcctgggacgtccctnagactctcctgttagcctntggattcaccttnagtagttatcctttgcacgtgggtcctcaggcctccgaggcaaggggctgggaggtgggtggctagttatccctctattttgagttggaagaacataaaatactaacgagagtaccgttccgggttcggggcccgtattccaccatcctaccaaagactaatttagaaagaacacgtacttcgtttactgtactaaatagaaacagcctagagagcgtagacggacgacgggtctggtagttattacgttcgtttcggtttggttcgtcggtacgtacgggtacgggggtaacttaccgttacgacgtaccg

SEQ ID NO: 327488 - DNA, 624 bp, Homo sapiens
  misc_feature: GZ8MTXP02JLKEX.10.53.E09.1.454.CMB.2.raw
tcagcatagtagtgcacgaccggtgctcgatttagagagagtgtgttgggtttgggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggaggcgtggtccagcctgggaggtccctcagactctcctgttagcctctggattcaccttcagtagttatcctttgcactgggtcctcaggctccgaggcaaggggctggaggtgggtgctagttatctcatttgatggagaacaataaagtactacagagtacctccggttacgggggcctattccaccactactaccaaagactaaagtttagaaagaaccacgtacttgtttactagtacaaattacgaaacacgacctagaagaagcctaggacggacgaacggtcgtaggtagtttaacgtttacgtttggtttaccggttttgggtttccgtaggttaaccgttcgggtaccgggggtaaacttacccgttacgtacgaccgtacggtcgggggtaccgaaccgggg

SEQ ID NO: 327489 - DNA, 537 bp, Homo sapiens
  misc_feature: GZ8MTXP02J2CZY.10.53.E09.1.454.CMB.2.raw
  modified_base (195)..(195): a, c, t, g, unknown or other
  misc_feature (195)..(195): n is a, c, g, or t
  modified_base (242)..(242): a, c, t, g, unknown or other
  misc_feature (242)..(242): n is a, c, g, or t
  modified_base (340)..(340): a, c, t, g, unknown or other
  misc_feature (340)..(340): n is a, c, g, or t
  modified_base (343)..(343): a, c, t, g, unknown or other
  misc_feature (343)..(343): n is a, c, g, or t
  modified_base (353)..(353): a, c, t, g, unknown or other
  misc_feature (353)..(353): n is a, c, g, or t
  modified_base (369)..(369): a, c, t, g, unknown or other
  misc_feature (369)..(369): n is a, c, g, or t
tcagcatagtagtgcacgaccggtgctcgatttagagagagtgtgttgggtttggggctgggagacgagcccagcactggaagtcgccggtgtttccattcggtgatcatcactgaacacagaggactcaccatggagtttgggctgagctgggttttcctcgttgctcttttaagaggtgtccagtgtcaggtncagctggtggagtcgtgggggagcgtggtccagcctgggagtccctnagactctcctgtttacgcctctggattcaccttcagtagttatcctttgcacgtgggtcctcaggctccgaggcaaggggctggagtggtgcagttanctnattgatgganacaataaatcacaganactccggtcgggacatcacactctaccaaagacaagtttagaaacgtaacgacgtactgtttactagacaatagaacagacctgacgagctagaggacacgctgtgtattacgttgttcggttgtcgtgtacgtcggtacgggtactccgttacacgtcgacgtcggg

SEQ ID NO: 327490 - DNA, 611 bp, Homo sapiens
  misc_feature: GZ8MTXP02IFOBH.10.53.E09.1.454.CMB.2.raw
  modified_base (367)..(367): a, c, t, g, unknown or other
  misc_feature (367)..(367): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctgggtggagtcgtgggggaggcgtggtccagccgtggggacggtccctcagctctccttgttagcctctggattcaccttcagttagttactcctttgcctacgtgggtcccgtcaggcctccgaggcgaaggggctggaggtggggtggctagttatctctatttgatgganacaaataaatactacagacgacgttccgggttcggggccgtattccaacctatactaccaaagaactaattagaaacgaacacgtcttagttctgactaaatagaacgacgtacctagacgtagcgtaggacggaacgacggtacgtgtagttactttacgttcggtttcggtttggttcgtcggtaccgttcggtacgggggtaactaccgttacgacggcgtaccggtcggggacgaccggg

SEQ ID NO: 327491 - DNA, 639 bp, Homo sapiens
  misc_feature: GZ8MTXP02F55TH.10.53.E09.1.454.CMB.2.raw
  modified_base (333)..(333): a, c, t, g, unknown or other
  misc_feature (333)..(333): n is a, c, g, or t
  modified_base (346)..(346): a, c, t, g, unknown or other
  misc_feature (346)..(346): n is a, c, g, or t
tcagcatagtagtgcacgaccggtgctcgatttagagagagtgtgttgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcactgggtccgtcaggctccaggcaaggggctggagtgggtggcagttatctctatttgatggagacaaataaatactaacagagactccggttcgggccattcaccatctaccaaagacaaatttgaaagaacacgtctgtttcngacaaatgaaacngcctgagacgctagagacacgctgtgtattacgttgtttcgtttggttctgtacgtcggtacgggggtaactaccgttagacgcgtacggtcggggaccgacggggccaccccgtcggtaccaccccggttcctcccgtaccgaccgtaccccgtacccgaacccgaaccggggtcccctaacgttcccgggttcccttcccccgtacgggcccctaaccccgtccctaccgaacgtaccgacctaccgtcggcggggaccaacgacggccggcccgtggcctcgccgtacgg

SEQ ID NO: 327492 - DNA, 552 bp, Homo sapiens
  misc_feature: GZ8MTXP02JK9VK.10.53.E09.1.454.CMB.2.raw
  modified_base (236)..(236): a, c, t, g, unknown or other
  misc_feature (236)..(236): n is a, c, g, or t
  modified_base (353)..(353): a, c, t, g, unknown or other
  misc_feature (353)..(353): n is a, c, g, or t
  modified_base (368)..(368): a, c, t, g, unknown or other
  misc_feature (368)..(368): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggagcgtggtccagcctgggagtcccnagactctcctgtttacgcctctggattcaccttcagtagttatccctttgcactggggtcctcaggctccgaggcaaggggctgggagtggggtggcagttatctcatttgatgganacaataaatactacngagactccggttcggggccattccacatctaccaaagacaatttagaagaacacgactgttctagacaaatagaacagcctagagagctgacggacacggcgtagtgtattacttgttcgtttggttcgtgtacgtcggtacgggggtaactacgttacacgtccgacgtcggggaccgacggg

SEQ ID NO: 327493 - DNA, 599 bp, Homo sapiens
  misc_feature: GZ8MTXP02H2HWR.10.53.E09.1.454.CMB.2.raw
  modified_base (251)..(251): a, c, t, g, unknown or other
  misc_feature (251)..(251): n is a, c, g, or t
  modified_base (315)..(315): a, c, t, g, unknown or other
  misc_feature (315)..(315): n is a, c, g, or t
  modified_base (357)..(357): a, c, t, g, unknown or other
  misc_feature (357)..(357): n is a, c, g, or t
  modified_base (361)..(361): a, c, t, g, unknown or other
  misc_feature (361)..(361): n is a, c, g, or t
  modified_base (372)..(372): a, c, t, g, unknown or other
  misc_feature (372)..(372): n is a, c, g, or t
  modified_base (443)..(443): a, c, t, g, unknown or other
  misc_feature (443)..(443): n is a, c, g, or t
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtggagtcgtgggggagcgtggtccaggccgtggggagtccctnagctctcctgttacgcctctggattcaccttcagtagttactcctttgctacgtcgggtccgtnacggcctccgaggcgaaggggctgggagtggggtgcagttancctnatttgatgganacataaatactacagacgacgtccggttcggggccgtattcaccatcctaccaaaagtacaatttagaaanaacacgcttgtttactagtacaaagtagaacacgacctagagagtcgtaggaacggacgacggtcttaggttagttaacgtttacgttcggttttcgtttggttacgttcggtaccgttacgggtacgggggtaacttaccgtttcgaacgtccgg

SEQ ID NO: 327494 - DNA, 563 bp, Homo sapiens
  misc_feature: GZ8MTXP02F3H6K.10.53.E09.1.454.CMB.2.raw
  modified_base (249)..(249): a, c, t, g, unknown or other
  misc_feature (249)..(249): n is a, c, g, or t
  modified_base (314)..(314): a, c, t, g, unknown or other
  misc_feature (314)..(314): n is a, c, g, or t
  modified_base (351)..(351): a, c, t, g, unknown or other
  misc_feature (351)..(351): n is a, c, g, or t
  modified_base (354)..(354): a, c, t, g, unknown or other
  misc_feature (354)..(354): n is a, c, g, or t
  modified_base (364)..(364): a, c, t, g, unknown or other
  misc_feature (364)..(364): n is a, c, g, or t
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggaggcgtggtccagccgtgggacgtccctnagactctcctgtttagcctctggattcaccttcagttagttactcctttgctacgtgggtccgtnaggctccgaggcaaggggctggagtgggtgcagttanctnattgatgganacataaatactacagagactccggtcgggcgtattcacatctacaaagactaaatttagaaagaaacacgtacttgtttctacgacaaatacgaaacacgactagagagcgtagagacacggtctagtgttacttacttcgtttcgtttggttcgtaagtacgttacggtacgggggtaacttaccgttacgacgtacg

SEQ ID NO: 327495 - DNA, 689 bp, Homo sapiens
  misc_feature: GZ8MTXP02FPHSE.10.53.E09.1.454.CMB.2.raw
  modified_base (248)..(248): a, c, t, g, unknown or other
  misc_feature (248)..(248): n is a, c, g, or t
  modified_base (266)..(266): a, c, t, g, unknown or other
  misc_feature (266)..(266): n is a, c, g, or t
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggaggcgtggtccagccgtgggagtccctnagctctcctgttagcctntggattcaccttcagttagttactcctttgcctacgttggggtccgtcaggtcctccgagggccgaaggggctgggaggtgggtgctagttatcctctatttgatggaactaacaataaatactaacaggtacgtaccgttccgggttcggggaccgtagttacccaaccctacttacctaacccgaaaacgaaccttaaaagtttaacggaaaacgtaaaccgtaccgtacgtttacgttttaccgtagtaaccgtaaaattacgaaaaccacggtacctaggaacgaacggtcgtagggacggtacgaaccggtcgttaggttagttaacgtttacgtttcggttttacggttttcggtttcgttaacggtaccggtttaccggggttacgggggttaaccttaccgttacgacgtaccgg

SEQ ID NO: 327496 - DNA, 688 bp, Homo sapiens
  misc_feature: GZ8MTXP02IIW1I.10.53.E09.1.454.CMB.2.raw
  modified_base (161)..(161): a, c, t, g, unknown or other
  misc_feature (161)..(161): n is a, c, g, or t
  modified_base (177)..(177): a, c, t, g, unknown or other
  misc_feature (177)..(177): n is a, c, g, or t
  modified_base (244)..(244): a, c, t, g, unknown or other
  misc_feature (244)..(244): n is a, c, g, or t
tcagcatagtagtgcacgaccggtgctcgatttagagagagtgtgttgggtttggggctgggagacgagcccagcactggaagtcgccggtgtttccattcggtgatcatcactgaacacagaggactcaccatggagtttgggctgagctgggttttccncgttgctcttttaagnggtgtccagtgtcaggtgcagctggtggagtcgtgggggagcgtggtccaggcctgggacgtccctnagactctccttgtttacgcctctggacttcacctttcagttattatccctttgctacgtggggtcctcagggcctccgaggccgaaggggctgggaggtggggtgctaggttatcgtctagttttagagttacgggaagaactaaaactaaattaccgtacaacggtaaggacccttcccggggttacgggggacctaacttaccgaaccaacttacctaaccgaaaaacggtaacttaaaagtttacgaaaacgaaaccgtacggtaccttaggttttacctacggaaacaaaacgttcgaaacgaacgtcccgtaggaaacgcgacgtcggaaggaccacgggtcttagttaggttactttaactttcggtttcggtttggttacgtacgtacggtcggtacgggggtaaacttaccgttacgacgtcgaacggtccggggg

SEQ ID NO: 327497 - DNA, 776 bp, Homo sapiens
  misc_feature: GZ8MTXP02IAY3X.10.53.E09.1.454.CMB.2.raw
  modified_base (250)..(250): a, c, t, g, unknown or other
  misc_feature (250)..(250): n is a, c, g, or t
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtggagtcgtgggggagcgtggtccagccgtgggacgtccctnagctctccttgttacgcctctggacttcaccttcagtagttactcctttgcctacgtcggggtcccgtgacggtcctccgagggaccgaaagggggctaggggtaggtggggttaggttaagtttactcgttacctaagtttttggaattggggaaataaacctaaaatttaaaactaccgttaaacgaacggtaacgtaacccggttcccgggggtttacgggacccgtaaccgtttaccaaccctaactaccctaaacccgaaaacgtaaacctaaacgttttaagaaaacgaaaccgtaccgtacgtttacgttttacgtacgtaaactaaaagttaacgaaacgaacgtaccgtaaggaacggacggacgttaagggaacgggtaaccggaaccgggtacgttacggtttaggttaacttttacggttacggttttacggtttttacggtttcgttacggttaaccggttacgggttaaccgggggtaacttaacccgttacggtacggtacgtaaccgggg

SEQ ID NO: 327498 - DNA, 607 bp, Homo sapiens
  misc_feature: GZ8MTXP02JSQMM.10.53.E09.1.454.CMB.2.raw
  modified_base (248)..(248): a, c, t, g, unknown or other
  misc_feature (248)..(248): n is a, c, g, or t
  modified_base (357)..(357): a, c, t, g, unknown or other
  misc_feature (357)..(357): n is a, c, g, or t
  modified_base (376)..(376): a, c, t, g, unknown or other
  misc_feature (376)..(376): n is a, c, g, or t
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggagcgtggtccagccgtgggacgtccctnagacctctcctgttagcctctggattcaccttcagttagttactcctttgctacgtgggtcctcgaggctccgaggcgaaggggctagggaggtggggtgctaggtttncctctatttgagttggaanaactaataaactactacagacgaccgttccgggtcggggaccgtattaccaccactaccgtacccaaaagactaaatttagaaacgtaacacgtactgtttactgaacaaagtagaactacgcctagagacgcgtagaggacgacggtctaggtacgttagtttacgttgtttcggtttcgttcgtgtacgttacgggtaccgggggtaacttaccgttacgacgtaccgg

SEQ ID NO: 327499 - DNA, 583 bp, Homo sapiens
  misc_feature: GZ8MTXP02H5DDS.10.53.E09.1.454.CMB.2.raw
  modified_base (337)..(337): a, c, t, g, unknown or other
  misc_feature (337)..(337): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggagcgtggtccagccgtgggacgtccctcagactctctgttagcctctggattcaccttcagttagttatcctttgcacgtgggtcctcaggctccaggcaaggggctggagtgggtggctagttanctcagtttgatggagacaaataaatactacagacgactcccggttcggggcccgtattcaccgactctaccaaagactaaattagaaagaacgaacgcttagttctagacaaatgaaacagacctagagaagcgtagagacgacggctagtagtacttacgttgttcgttttcggtcttacggtacgttcgggtacgggggtaactaccgttacgtacgccgtaccgtcggggaccgaacccgggg

SEQ ID NO: 327500 - DNA, 522 bp, Homo sapiens
  misc_feature: GZ8MTXP02GRLIB.10.53.E09.1.454.CMB.2.raw
  modified_base (248)..(248): a, c, t, g, unknown or other
  misc_feature (248)..(248): n is a, c, g, or t
  modified_base (267)..(267): a, c, t, g, unknown or other
  misc_feature (267)..(267): n is a, c, g, or t
  modified_base (343)..(343): a, c, t, g, unknown or other
  misc_feature (343)..(343): n is a, c, g, or t
  modified_base (358)..(358): a, c, t, g, unknown or other
  misc_feature (358)..(358): n is a, c, g, or t
  modified_base (464)..(464): a, c, t, g, unknown or other
  misc_feature (464)..(464): n is a, c, g, or t
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtctgggggagcgtggtccaggcctggggagtcccctnagactctcctgttagcctntggattcaccttcagtagttatcctttgcactgggtcctcaggctccaggcaaggggctggagtgggtgcagttancctcatttgatgganacataatactacagagactccggttcgggccgatcacatctaccaaagacaattagaagacacgctgttctgacaaatgaacagcctagagagcagagacgacggntgtagtattactgttcgttggttctgacgtcggtacggggtactaccgttcgacgtcg

SEQ ID NO: 327501 - DNA, 612 bp, Homo sapiens
  misc_feature: GZ8MTXP02GCBC8.10.53.E09.1.454.CMB.2.raw
  modified_base (250)..(250): a, c, t, g, unknown or other
  misc_feature (250)..(250): n is a, c, g, or t
  modified_base (364)..(364): a, c, t, g, unknown or other
  misc_feature (364)..(364): n is a, c, g, or t
  modified_base (381)..(381): a, c, t, g, unknown or other
  misc_feature (381)..(381): n is a, c, g, or t
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtggagtcgtgggggagcgtggtccagccgtgggacgtccctnagacctctcctgtttacgcctctggattcaccttcagttagttacttccctttgcctacgttcgggtccgtcgaggcctccgaggcgaaggggctgggaggtgggtgctagttntctctatttgatggaanactaataaatacagagacgtacgttccgggttcgggaccgtacttaccgaacctacttactaaccaaaagtacctaaatttaagaaacgaaactacgtactttgtttctagtaacaaatacgaaacacgaccgtagagagcgacgaggacgacggtgtagttacgttattacgttgtttcgtttggttctcgtacgtacgggtacggggtaactaccgttacgacgtccgg

SEQ ID NO: 327502 - DNA, 708 bp, Homo sapiens
  misc_feature: GZ8MTXP02JQHEP.10.53.E09.1.454.CMB.2.raw
  modified_base (240)..(240): a, c, t, g, unknown or other
  misc_feature (240)..(240): n is a, c, g, or t
  modified_base (258)..(258): a, c, t, g, unknown or other
  misc_feature (258)..(258): n is a, c, g, or t
  modified_base (270)..(270): a, c, t, g, unknown or other
  misc_feature (270)..(270): n is a, c, g, or t
  modified_base (354)..(354): a, c, t, g, unknown or other
  misc_feature (354)..(354): n is a, c, g, or t
tcagcatagtagtgcacgaccggtgctcgatttagagagagtgtgttgggtttgggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggagcgtggtccagcctggggacgtccctnagactctctgttagcctntggatcaccttnagtattatcctttgctacgtgggtcctcaggctccgaggcaaggggctgggagtgggtgctagttatctctattgagtcggaanaactaaattaaatacctaacaggtacgtaaccgttcccggggttacgggggaccctaatttacccaaaccctaactaccctaaaccgaaaacgtaacctaaagtttaagaaaacgtaaccgacggttacttacgtttacgtacgtaaactaaaagtacgaaaacgcgtaccgtaggaacgacgacgtaggaacggaacgaccggtcgttaggtacggtttaaactttacgtttcggttttcgggtttttacggttaccgttcggttacccgggttaccggggttaaccgggggttaaacttacccgtttacggaacggtcccgtaacgggtccggggtacccggtaacccgggg

SEQ ID NO: 327503 - DNA, 610 bp, Homo sapiens
  misc_feature: GZ8MTXP02HOKKR.10.53.E09.1.454.CMB.2.raw
  modified_base (240)..(240): a, c, t, g, unknown or other
  misc_feature (240)..(240): n is a, c, g, or t
  modified_base (344)..(344): a, c, t, g, unknown or other
  misc_feature (344)..(344): n is a, c, g, or t
  modified_base (356)..(356): a, c, t, g, unknown or other
  misc_feature (356)..(356): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggaggcgtggtccagccgtgggacgtccctnagctctccttgttagcctctggattcaccttcagtattatcctttgctacgtgggtcctcaggcctccgaggcaagggggctgggagtgggtgctagttatctnatttgatggaanacaaataaatactacagagtacttcccggttcgggggcctattccaccactcctaaccaaagaactaatttagaaacgaacacgtcttcgttactagactaaatacgaaacgacgtacctaggaagacgcgtaggaacggacgacggtcgtagttagttatttacgtttgtttcgtttcggtttactcgtacgttcgggtacgggggtaacttaccgttacgtacgtacgtacggtcggggtaccgtaccgggg

SEQ ID NO: 327504 - DNA, 560 bp, Homo sapiens
  misc_feature: GZ8MTXP02GGNDN.10.53.E09.1.454.CMB.2.raw
  modified_base (246)..(246): a, c, t, g, unknown or other
  misc_feature (246)..(246): n is a, c, g, or t
  modified_base (363)..(363): a, c, t, g, unknown or other
  misc_feature (363)..(363): n is a, c, g, or t
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggagcgtggtccagcctgggagtccctnagactctcctgtttagcctctggattcaccttcagttagttatcctttgcacgttgggtcctcaggctccgaggcaaggggctgggagtggggtgcagttatcctcatttgatgganaacataaatactacagagaccttccggtcgggccgtattcaccatctaccaaagactaatttagaaacgaacacgtcttgtttctgacaaatagaaacacgcctagagagcgtagagacgacggtctggtacgttattacgttgtttcgtttggttctgtacgtcggtacgggggtaactaccgttacgacgtaccg

SEQ ID NO: 327505 - DNA, 606 bp, Homo sapiens
  misc_feature: GZ8MTXP02FVP62.10.53.E09.1.454.CMB.2.raw
  modified_base (248)..(248): a, c, t, g, unknown or other
  misc_feature (248)..(248): n is a, c, g, or t
  modified_base (383)..(383): a, c, t, g, unknown or other
  misc_feature (383)..(383): n is a, c, g, or t
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagcttgggttttcctcgttgctcttttaagaggtgtccagtgtcaggtgcagctgggtggagtcgtgggggagcgtggtccagcctgggagtccctnagactctctgttagcctctggatcaccttcagtagttatcctttgctacgtgggtccgtcaggctccgaggcgaaggggctgggaggtgggtgctaggttatcctctagtttgatggaagacaataaatactaanagagtacgtccgggttcggggacctagttaccaccatacctacaaaagactaaatttagaaagaaacacgtacttgtttacctagactaaatacgaaacacgacctaggacgaagcgtaggacgggacgaacggtcgtagttacggttatttacgttcgttttcggtttggtttcgtaaggtacgtacgggtacgggggtaacttaccgttacgacgtaccgg

SEQ ID NO: 327506 - DNA, 556 bp, Homo sapiens
  misc_feature: GZ8MTXP02FW6LM.10.53.E09.1.454.CMB.2.raw
  modified_base (239)..(239): a, c, t, g, unknown or other
  misc_feature (239)..(239): n is a, c, g, or t
  modified_base (343)..(343): a, c, t, g, unknown or other
  misc_feature (343)..(343): n is a, c, g, or t
  modified_base (346)..(346): a, c, t, g, unknown or other
  misc_feature (346)..(346): n is a, c, g, or t
  modified_base (356)..(356): a, c, t, g, unknown or other
  misc_feature (356)..(356): n is a, c, g, or t
  modified_base (366)..(366): a, c, t, g, unknown or other
  misc_feature (366)..(366): n is a, c, g, or t
  modified_base (371)..(371): a, c, t, g, unknown or other
  misc_feature (371)..(371): n is a, c, g, or t
  modified_base (431)..(431): a, c, t, g, unknown or other
  misc_feature (431)..(431): n is a, c, g, or t
tcagcatagtagtgcacgaccggtgctcgatttagagagagtgtgttgggtttgggggagacgagcccagcactggaagtcgccggtgtttccattcggtgatcatcactgaacacagaggactcaccatggagtttgggctgagcttgggttttcctcgttgctcttttaagaggtgtccagtgtcaggtgcagctggtggagtcgtgggggagcgtggtccagcctgggagtccctnagactctcctgtttacgcctcgtggacttcaccttcagtagttactcctttgcctacgtgggtcctcaggctccgaggcaaggggctggagtgggtgcagttanctnattgatgganaacaataaanactangagactccggtcgggctattcacatctacaaagactaattagaaagacacgtctgttacngactaaatagaactagacctagagacgcgtagacggacacggctagtagttacttacgtgttcgttaggttctcgtacgtcggtacggggtaactaccgttacacgactacggcgggtacgacgg

SEQ ID NO: 327507 - DNA, 569 bp, Homo sapiens
  misc_feature: GZ8MTXP02G1884.10.53.E09.1.454.CMB.2.raw
  modified_base (239)..(239): a, c, t, g, unknown or other
  misc_feature (239)..(239): n is a, c, g, or t
  modified_base (258)..(258): a, c, t, g, unknown or other
  misc_feature (258)..(258): n is a, c, g, or t
  modified_base (271)..(271): a, c, t, g, unknown or other
  misc_feature (271)..(271): n is a, c, g, or t
  modified_base (330)..(330): a, c, t, g, unknown or other
  misc_feature (330)..(330): n is a, c, g, or t
  modified_base (338)..(338): a, c, t, g, unknown or other
  misc_feature (338)..(338): n is a, c, g, or t
  modified_base (341)..(341): a, c, t, g, unknown or other
  misc_feature (341)..(341): n is a, c, g, or t
  modified_base (354)..(354): a, c, t, g, unknown or other
  misc_feature (354)..(354): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagctgggttttcctcgttgcttcttttaagaggtgtccagtgtcaggtgcagctggtggagtcgtgggggagcgtggtccagccgtgggagtccctnagactctcctgttagcctntggattcaccttnagtagttatcctttgcactgggtccgtcaggctccgaggcaaggggctgggagtggggngcagttanctntatttgatggganacaataaatctacagacgacgtccggttcggggcctaattcacctatcctaccaaagactaatttagaaagaacacgcttgttctagacaaatagaacagacctaggagacgacgtaggacggacgacggctggtagttacttacgttgttcgtttggttcctgtacgtcggtacggggaacttccgttacgacgcgacggtcgggccgtacggg

SEQ ID NO: 327508 - DNA, 572 bp, Homo sapiens
  misc_feature: GZ8MTXP02J1ZLC.10.53.E09.1.454.CMB.2.raw
  modified_base (253)..(253): a, c, t, g, unknown or other
  misc_feature (253)..(253): n is a, c, g, or t
  modified_base (444)..(444): a, c, t, g, unknown or other
  misc_feature (444)..(444): n is a, c, g, or t
tcagcatagtagtgcacgaccggtgctcgatttagagagagtgtgttgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcactgggtccgtcaggctccaggcaagggggctgggagtgggtggcagttatctcatttgatgganacaataaatactacagagactccgttcggggccgattcaccatctaccaaagacaatttgaagaacacgctgtttctgacaaatgaaacagcctgagagctgaggacacggctgtgtattactgttcgttgtctgcgtcgtcgggggaatccttcagcacgtggggccagggccaccgtggtccaccgtcncctcacgccctccaccgacgggcccacgtccggtcccttccccgtcggcctacccctcctaccgaacgaccgaccaccgtccgtcgggggaccaacgacggccggcccgtgggcctcggccgtacggg

SEQ ID NO: 327509 - DNA, 585 bp, Homo sapiens
  misc_feature: GZ8MTXP02JHQL9.10.53.E09.1.454.CMB.2.raw
  modified_base (344)..(344): a, c, t, g, unknown or other
  misc_feature (344)..(344): n is a, c, g, or t
  modified_base (355)..(355): a, c, t, g, unknown or other
  misc_feature (355)..(355): n is a, c, g, or t
  modified_base (368)..(368): a, c, t, g, unknown or other
  misc_feature (368)..(368): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggaggcgtggtccagccgtgggaggtccctcagactctcctgtttacgcctctggattcaccttcagtagttatcctttgcacgtgggtcctcaggcctccgaggcaaggggctgggagtgggtgcagttatctnatttgatgganacaataatctacngagactccggttcgggctattcaccatctaccaaagactaattagaaagaacacgtcttagttctagtacaaatagaaacacgacctagaagacgcgtaggaggacgacggtctagtacgttacttacgttggtttccggtttggttcgtcgtacgttccgggtacgggggtaacttaccgttacgacggtaccgacggttacggggaccgacgggg

SEQ ID NO: 327510 - DNA, 570 bp, Homo sapiens
  misc_feature: GZ8MTXP02JUUGV.10.53.E09.1.454.CMB.2.raw
  modified_base (315)..(315): a, c, t, g, unknown or other
  misc_feature (315)..(315): n is a, c, g, or t
  modified_base (322)..(322): a, c, t, g, unknown or other
  misc_feature (322)..(322): n is a, c, g, or t
  modified_base (353)..(353): a, c, t, g, unknown or other
  misc_feature (353)..(353): n is a, c, g, or t
  modified_base (405)..(405): a, c, t, g, unknown or other
  misc_feature (405)..(405): n is a, c, g, or t
  modified_base (436)..(436): a, c, t, g, unknown or other
  misc_feature (436)..(436): n is a, c, g, or t
tcagcatagtagtgcacgaccggtgctcgatttagagagagtgtgttgggtttgggggagctacaacaggcaggcaggggcagcaagatggtgttgcagacccaggtcttcatttctctgttgctctggatctctggtgccgtacggggacatcgtgatgacccagtctccagacctccctgcctgtgtctcgtgggcgagacgggccaccatcaactgacaagtccagccagtagttgttttatcagctaccgaacaataagaactacttagcttggaccagcaagaaaccaggacagcctacctaagctgctnatttacnggcagtccgacccgggatcccccggggtccngaccgattcgagtggcaggcgggtctggggacagtacttcactctacaccancagcacgcctgacagctagagatcggcggtnttaaggtttactaccgtgtacagactaacttattaacgtaacctacccctattaccactaccgttaccggtacccgtagggaaccctaaaggtcggaacgtaactaaccgaaaacgtaacgtcggtacggtacg

SEQ ID NO: 327511 - DNA, 625 bp, Homo sapiens
  misc_feature: GZ8MTXP02IOBVT.10.53.E09.1.454.CMB.2.raw
  modified_base (363)..(363): a, c, t, g, unknown or other
  misc_feature (363)..(363): n is a, c, g, or t
  modified_base (492)..(492): a, c, t, g, unknown or other
  misc_feature (492)..(492): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagcgtgggttttcctcgttgctcttttaagaggtgtccagtgtcaggtgcagctggtggagtcgtgggggagcgtggtccagccgtgggacgtccctcagactctccttgttacgcctctggattcaccttcagttagttatcctttgctacgtgggtcctcaggctccgaggcgaaggggctgggagtggggtggctagttatcgtcatttgatgggaanaactaaataaaatactacaggtagtaccgtccgggttcgggggcctattccaaccatacaccaaagactaattagaaagaacacgtctcgttactacgactaaatacgaaactacgaccgtaggaacgngacgtaggacggacgacggtctaggttagttagtttacgttggtttcggttttcggttacgttcggtacggttcgggttacgggggtaacttaccggttacgtacgtccgtacggtcggggacccgaccgggg

SEQ ID NO: 327512 - DNA, 588 bp, Homo sapiens
  misc_feature: GZ8MTXP02HDVP6.10.53.E09.1.454.CMB.2.raw
  modified_base (238)..(238): a, c, t, g, unknown or other
  misc_feature (238)..(238): n is a, c, g, or t
  modified_base (343)..(343): a, c, t, g, unknown or other
  misc_feature (343)..(343): n is a, c, g, or t
  modified_base (356)..(356): a, c, t, g, unknown or other
  misc_feature (356)..(356): n is a, c, g, or t
  modified_base (430)..(430): a, c, t, g, unknown or other
  misc_feature (430)..(430): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggaggcgtggtccagcctgggagtccctnagactctctgttagcctctggatcaccttcagtagttatcctttgctacgtgggtcctcaggcctccgaggcgaaggggctgggagtggggtgctagttatcgtnagtttgatggaanacaaataaatactaacagagtactccggttcggggcctattccgaaccactctaccaaagactaaattagaaanacacgtcttagttctagacaaatacgaacagcctagagagcgtaggagacgcggtactgtagttacttacgttggtttcgtttggttacgtcgtacgttcgggtacgggggtaacttaccgttacgtacgaccgtacggtacgggggacccgtacggg

SEQ ID NO: 327513 - DNA, 605 bp, Homo sapiens
  misc_feature: GZ8MTXP02HGRYW.10.53.E09.1.454.CMB.2.raw
  modified_base (241)..(241): a, c, t, g, unknown or other
  misc_feature (241)..(241): n is a, c, g, or t
  modified_base (342)..(342): a, c, t, g, unknown or other
  misc_feature (342)..(342): n is a, c, g, or t
  modified_base (358)..(358): a, c, t, g, unknown or other
  misc_feature (358)..(358): n is a, c, g, or t
tcagcatagtagtgcacgaccggtgctcgatttagagagagtgtgttgggtttgggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggagcgtggtccagccgtgggacggtccctnagactctctgttacgcctctggattcaccttcagtagttatcctttgctactgggtcctcaggctccgaggcgaaggggctgggagtgggtgctagttacnctctatttgatggaanaacaaataaaactctaacaggacgtacgttcccgggttacgggggacctaattccaaccctactacctaccaaaacgactaaattagaaagaacacgtcttgttactagacaaatagaactagaccgtagagacgcgtagacggacacggtctagtattagttacgttgtttcgtttggttcgtacgtacgttacggtacggggtaacttaccgttacgacgaccgtacgtacggggtacaccgggg

SEQ ID NO: 327514 - DNA, 560 bp, Homo sapiens
  misc_feature: GZ8MTXP02GH5Y6.10.53.E09.1.454.CMB.2.raw
  modified_base (246)..(246): a, c, t, g, unknown or other
  misc_feature (246)..(246): n is a, c, g, or t
  modified_base (263)..(263): a, c, t, g, unknown or other
  misc_feature (263)..(263): n is a, c, g, or t
  modified_base (273)..(273): a, c, t, g, unknown or other
  misc_feature (273)..(273): n is a, c, g, or t
  modified_base (345)..(345): a, c, t, g, unknown or other
  misc_feature (345)..(345): n is a, c, g, or t
  modified_base (356)..(356): a, c, t, g, unknown or other
  misc_feature (356)..(356): n is a, c, g, or t
  modified_base (370)..(370): a, c, t, g, unknown or other
  misc_feature (370)..(370): n is a, c, g, or t
  modified_base (418)..(418): a, c, t, g, unknown or other
  misc_feature (418)..(418): n is a, c, g, or t
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggagcgtggtccagcctgggagtccctnagctctctgttagcctngatcaccttnagtagttactcctttgcactgggtcctcaggctccgaggcgaaggggctggaggtgggtgctagttatcctnattgatggaanaacataaatactanagacgtactcggtcgggacctatcacatctacaaagactaattagaanaacacgtacttgtttactagtacaaatacgaaacacgcctagagacgcgtaggacgacgacggtgttagtagttacttacgttgtttacgtttgttcgtaacgtacgttcgggtacggggtaacttaccgtacgacgtaccg

SEQ ID NO: 327515 - DNA, 630 bp, Homo sapiens
  misc_feature: GZ8MTXP02GNDCY.10.53.E09.1.454.CMB.2.raw
  modified_base (238)..(238): a, c, t, g, unknown or other
  misc_feature (238)..(238): n is a, c, g, or t
  modified_base (354)..(354): a, c, t, g, unknown or other
  misc_feature (354)..(354): n is a, c, g, or t
tcagcatagtagtgcacgaccggtgctcgatttagagagagtgtgttgggtttgggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggagcgtggtccagcctgggagtccctnagctctcctgttagctctggattcaccttcagtagttatcctttgctacgtgggtcctcaggctccgaggcgaaggggctgggaggtggggtgcgagttatctctatttgatgganaactaaataaactactaacagacgtacgttccgggttacggggccgtattaccacctactacctaaccaaagtaactaaatttagaaacgaaccacgtacttagtttactacgtaactaaatagaaacgtacgaccgtagaagacgacgtaggaacggacgacggtacgttgtagttactttacgttgtttcggtttacggttcgttacgtacgttacggtacgggggtaacttaccgttacgtacgtacgtaccggtacggggaccgtaccgggg

SEQ ID NO: 327516 - DNA, 605 bp, Homo sapiens
  misc_feature: GZ8MTXP02G3SHE.10.53.E09.1.454.CMB.2.raw
  modified_base (243)..(243): a, c, t, g, unknown or other
  misc_feature (243)..(243): n is a, c, g, or t
  modified_base (352)..(352): a, c, t, g, unknown or other
  misc_feature (352)..(352): n is a, c, g, or t
  modified_base (363)..(363): a, c, t, g, unknown or other
  misc_feature (363)..(363): n is a, c, g, or t
  modified_base (372)..(372): a, c, t, g, unknown or other
  misc_feature (372)..(372): n is a, c, g, or t
  modified_base (429)..(429): a, c, t, g, unknown or other
  misc_feature (429)..(429): n is a, c, g, or t
tcagcatagtagtgcacgaccggtgctcgatttagagagagtgtgttgggtttggggctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggagcgtggtccagcctgggaggtccctnagactctcctgttacgcctctggattcaccttcagtagttatcctttgcacgtcgggtcctcaggtcctccgagggcaagggggctgggagtggggtgctagttatctnatttgatgganacaataaanctacagacgtacctccggtcggggcctattcacctatcacaaagactaattacgaanacacgtacttcgttacagtaacaaagtacgaacgacgtaccgtagacgacgtacgaggaacggaccgacggtacgttacgttagttacttacggtttcggtttcggtttcggttcgttacggtaccggtcggggtacgggtaacttaccgtacgacgtaccggtacggtaccgggg

SEQ ID NO: 327517 - DNA, 602 bp, Homo sapiens
  misc_feature: GZ8MTXP02H2CWZ.10.53.E09.1.454.CMB.2.raw
  modified_base (195)..(195): a, c, t, g, unknown or other
  misc_feature (195)..(195): n is a, c, g, or t
  modified_base (361)..(361): a, c, t, g, unknown or other
  misc_feature (361)..(361): n is a, c, g, or t
tcagcatagtagtgcacgaccggtgctcgatttagagagagtgtgttgggtttggggctgggagacgagcccagcactggaagtcgccggtgtttccattcggtgatcatcactgaacacagaggactcaccatggagtttgggctgagctgggttttcctcgttgctcttttaagaggtgtccagtgtcaggtncagctggtggagtcgtgggggagcgtggtccagccgtgggaggtccctcagactctcctgttacgcctctggattcaccttcagtagttatcctttgcacgtgggtcctcaggctccgaggcaaggggctgggagtggggtgctagttatctcagtttgatggganacaaataaactctacgagacgtaccgtccgttcggggacctattcaccatcctacaaagactaatttagaaacgaactacgcttagttctagaactaaatagaacacgccgtagagagtcgtacggaggtacgacggctggtacgtttagttacgttcggtttccggtttggttacctcggtaccggttaaccgggtacgggggtaacttaccgttacgtacgtaccgtacggtccggggg

SEQ ID NO: 327518 - DNA, 599 bp, Homo sapiens
  misc_feature: GZ8MTXP02F8PU2.10.53.E09.1.454.CMB.2.raw
  modified_base (191)..(191): a, c, t, g, unknown or other
  misc_feature (191)..(191): n is a, c, g, or t
  modified_base (242)..(242): a, c, t, g, unknown or other
  misc_feature (242)..(242): n is a, c, g, or t
  modified_base (349)..(349): a, c, t, g, unknown or other
  misc_feature (349)..(349): n is a, c, g, or t
  modified_base (363)..(363): a, c, t, g, unknown or other
  misc_feature (363)..(363): n is a, c, g, or t
  modified_base (380)..(380): a, c, t, g, unknown or other
  misc_feature (380)..(380): n is a, c, g, or t
  modified_base (445)..(445): a, c, t, g, unknown or other
  misc_feature (445)..(445): n is a, c, g, or t
tcagcatagtagtgcacgaccggtgctcgatttagagagagtgtgttgggtttgggggagacgagcccagcactggaagtcgccggtgtttccattcggtgatcatcactgaacacagaggactcaccatggagtttgggctgagctgggttttcctcgttgctcttttaagaggtgtccagtgtcaggtncagctggtggagtcgtgggggagcgtggtccaggccgtgggacggtccctnagactctcctgttacgcctctggattcaccttcagttagttatcctttgctacgtgggtcctcaggctccgaggcgaaggggctggaggtggggtgctagttatctntatttgattggaanaactaataaatacctanagagacttccggtacgggcctattcacatctacaaagactaattagaaagacacgtcttgttacngtacaaagtgaacacgcctaggacgtagcgtagacggacacggtatggttattaacttcgtttggtttcgtttcggttacgttacgtaaccggttcgggttaacgggggtaacttaccgttacgacgtcgaaccggtcggggacgtacccgggg

SEQ ID NO: 327519 - DNA, 603 bp, Homo sapiens
  misc_feature: GZ8MTXP02F84G0.10.53.E09.1.454.CMB.2.raw
  modified_base (388)..(388): a, c, t, g, unknown or other
  misc_feature (388)..(388): n is a, c, g, or t
  modified_base (403)..(403): a, c, t, g, unknown or other
  misc_feature (403)..(403): n is a, c, g, or t
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtggagtcgtgggggagcgtggtccagccgtgggacggtccctcagactctcctgtttacgcctcgtggacttccaccttcagttagtttactcctttgcctacgtcgggtcctcgaggcctcccgaggccgaaggggctgggaggtgggtggctaggttatccttcatttgagttggaanaacaataaatactanaagagacgttccggtcgggccgtatccaccatactacaaaacgactaattagaaacgaaacacgtacttacgtttactacgaactaaatacgaaacgacgccgtagagagtcgaggacgacgacggtcgtagtacgttattacgttcgtttcgtttgttcgtcgtacgttcggtacggggtacttaccgtcgacgtacgg

SEQ ID NO: 327520 - DNA, 589 bp, Homo sapiens
  misc_feature: GZ8MTXP02GZAEI.10.53.E09.1.454.CMB.2.raw
  modified_base (242)..(242): a, c, t, g, unknown or other
  misc_feature (242)..(242): n is a, c, g, or t
  modified_base (344)..(344): a, c, t, g, unknown or other
  misc_feature (344)..(344): n is a, c, g, or t
  modified_base (358)..(358): a, c, t, g, unknown or other
  misc_feature (358)..(358): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggaggcggtggtccagccgtgggacggtccctnagactctcctgttagcctctggattccaccttcagtagttatcctttgcacttgggtcctcaggcctccgaggcaaggggctgggagtggggtgctagttanctcatttgatgganacaaataaatactacagacgtactcccgggttacgggggcctaattccaaccactactaccaaagactaaattagaaagaacacgcttagttacctagaccaaatagaaacagacctagagagcagacggacacggctgtgtacttacgttgtttcgtttggttactcgtaccggttcggtacgggggtaacttaccgttacgacgtacgtacggtcggggccgaaccggg

SEQ ID NO: 327521 - DNA, 573 bp, Homo sapiens
  misc_feature: GZ8MTXP02G7MG0.10.53.E09.1.454.CMB.2.raw
  modified_base (237)..(237): a, c, t, g, unknown or other
  misc_feature (237)..(237): n is a, c, g, or t
  modified_base (338)..(338): a, c, t, g, unknown or other
  misc_feature (338)..(338): n is a, c, g, or t
  modified_base (341)..(341): a, c, t, g, unknown or other
  misc_feature (341)..(341): n is a, c, g, or t
  modified_base (351)..(351): a, c, t, g, unknown or other
  misc_feature (351)..(351): n is a, c, g, or t
  modified_base (359)..(359): a, c, t, g, unknown or other
  misc_feature (359)..(359): n is a, c, g, or t
  modified_base (364)..(364): a, c, t, g, unknown or other
  misc_feature (364)..(364): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggagcgtggtccagcctgggagtccctnagactctcctgttagcctctggattcaccttcagttagtactcctttgctacgtgggtcctcaggcctccgaggcaaggggctgggagtgggtgcagttanctnatttgatganacaataanctacngagactccgtcgggccattcacatctacaaagacaattagaagaacacgtctgttactagacaaagtagaaacagaccgtagagacgacgtaggacggacgacggtatagtagttaacttacgttggtttcgtttcggttactcgtacgttcgggtacggggtaacttaccgttacgacgtacgtaccggtacggggaccgtaaccggg

SEQ ID NO: 327522 - DNA, 623 bp, Homo sapiens
  misc_feature: GZ8MTXP02H7L7V.10.53.E09.1.454.CMB.2.raw
  modified_base (250)..(250): a, c, t, g, unknown or other
  misc_feature (250)..(250): n is a, c, g, or t
  modified_base (269)..(269): a, c, t, g, unknown or other
  misc_feature (269)..(269): n is a, c, g, or t
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagctgggttttcctcgttgcttcttttaagaggtgtccagtgtcaggtgcagctggtggagtcgtgggggagcgtggtccagccgtggggacgtccctnagctctcctgttagcctcnggacttcaccttcagtagttatcctttgcctacgtcgggtccgtcaggcctccgaggcgaaggggctggggagtggggtgctagttactcctctagtttgattggaagaactaattaaatactaacgaagacgtaccgttccgggttcgggaccgtagtcaccactacaccaaaagtaacctaagtttaacgaaacgtaaccgaacgacttacgtttacctagtaactaaaataggaaacacgaccgtagacgagtacgagaacggaacgacggtacgttggtagttacttacgttgtttcgtttcgttcgtcgtacgtcgggttacggggaactttaccgtacgtacgtaccg

SEQ ID NO: 327523 - DNA, 722 bp, Homo sapiens
  misc_feature: GZ8MTXP02IMKAK.10.53.E09.1.454.CMB.2.raw
  modified_base (238)..(238): a, c, t, g, unknown or other
  misc_feature (238)..(238): n is a, c, g, or t
  modified_base (257)..(257): a, c, t, g, unknown or other
  misc_feature (257)..(257): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggagcgtggtccagcctgggacgtccctnagactctcctgttagcctntggattcaccttcagtagttatcctttgctacgtgggtcctcaggctccgaggcgaaggggctggaggtgggtggctaggttatcgtcatttggaattggaagtaacaaataaaattacctaacagaacgtaccgttcccggttaccgggggccctattccgaaaccactctacccaaaagtactaaatttagaaacgaaactacgtacttgtttacctagacctaaaagttacgaaacctaacggacccgttaggaaacggaacggtaccgttagggaaacgggtaaccgaaccggggtcgttacggttaggtttaaaacgtttaccgttttgggttttaccgtttttacggggtttccgtttacggttaccggtttaccggggttacggggggttaaaacctttacccgtttaccggtaaacggtaaaccggttcgggggtacccggtaacggggtacccccg

SEQ ID NO: 327524 - DNA, 621 bp, Homo sapiens
  misc_feature: GZ8MTXP02IVV8P.10.53.E09.1.454.CMB.2.raw
  modified_base (248)..(248): a, c, t, g, unknown or other
  misc_feature (248)..(248): n is a, c, g, or t
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggagcgtggtccagccgtgggacgtccctnagactctcctgttagccttctggattcaccttcagttagttactcctttgcctacgttcgggtccgtcaggtcctaccgaggcgaaggggtctgggaggtggggtgctagtttactcctactagtttgatggaataacaattaaactactaacgagacgtacgttccgggtcgggcctatcacactctacaaagactaattagaaacgacacgtacttcgtttactagtactaaagtacgaacgacgcctacgagacgacgtagacgacgacggtcgttagttacgttactttacgttcggtttcggttttcggttacgttaacggtaccggttacgggttacgggggtaacttaccgtttacgacgtaccgg

SEQ ID NO: 327525 - DNA, 645 bp, Homo sapiens
  misc_feature: GZ8MTXP02ILZZH.10.53.E09.1.454.CMB.2.raw
  modified_base (250)..(250): a, c, t, g, unknown or other
  misc_feature (250)..(250): n is a, c, g, or t
  modified_base (539)..(539): a, c, t, g, unknown or other
  misc_feature (539)..(539): n is a, c, g, or t
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagcttgggttttcctcgttgctcttttaagaggtgtccagtgtcaggtgcagctggtggagtcgtgggggagcgtggtccagccgtggggacgtccctnagctctctgttagcctctgatcacttcagttagttatcctttgcacgtgggtcctcaggcctccgaggccgaaggggctgggacggtggggtggcgtagtttactccgtctagtttgatggaagtaacaagtaaaactcgtaaacaagtaacgtaccgttcccggggttacgggggtacccgtatttaccgaacccagttaccctaaccgaaaacgacttaaagtttacgaaagtaaaccacgtacgttacgtttactagactaaatagaaaccacgacctagagacgngtagaggtacgacgggtcttaggtattaacttcgttacggtttacgtttggtttctcgggtaccgttacggggttaccggggtaactttaccgtcgacgtacccgg

SEQ ID NO: 327526 - DNA, 683 bp, Homo sapiens
  misc_feature: GZ8MTXP02HX9CU.10.53.E09.1.454.CMB.2.raw
  modified_base (234)..(234): a, c, t, g, unknown or other
  misc_feature (234)..(234): n is a, c, g, or t
  modified_base (251)..(251): a, c, t, g, unknown or other
  misc_feature (251)..(251): n is a, c, g, or t
  modified_base (292)..(292): a, c, t, g, unknown or other
  misc_feature (292)..(292): n is a, c, g, or t
  modified_base (333)..(334): a, c, t, g, unknown or other
  misc_feature (333)..(334): n is a, c, g, or t
  modified_base (349)..(349): a, c, t, g, unknown or other
  misc_feature (349)..(349): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggagcgtgtccagctgggagtcctnagactctctgttagctntggattcacttcagtagttatcctttgctacgtgggtcctnacggctcgaggcgaaggggctgggaggtgggtggctagttnntcatttgataggganacaaaattaatactaacagacgtaccgttccgggttaccgggggctaactttcgaaccctataccctaacaaaagtactaaagtttaagaaacgtaaccacgtacttacgtttactacgaaactaaacgtacgaaaacgtgtaccgtaggaacgacggcgtaagggaacggaaccgtaccgggtacgttaggttacgtttaacgtttacggtttacgggttttacggtttttcgggtttaccgtcgggttaaccgtttacggggttaaccgggggtaaactttacccgttacggacggtacgtacccggggttacggggtacccggtaccgggg

SEQ ID NO: 327527 - DNA, 576 bp, Homo sapiens
  misc_feature: GZ8MTXP02I3BC4.10.53.E09.1.454.CMB.2.raw
  modified_base (316)..(316): a, c, t, g, unknown or other
  misc_feature (316)..(316): n is a, c, g, or t
tcagcatagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctgcctgtgtctcgtgggcgagacgggccacatcaactgcaagtccagccagagttgtttatcagctaccgacaataagaactacttagcttggaccagcaagaaaccaggacagcctactaagctgctctatttacgngggacatccgtaacccgggaatcccccggggtcctgaccgtattcgaggtcgcgagcggggtctaggggacagtactttcactctacaccatcagcacgcctgaccaggtctaggaaagagtcggcgacttaggtttactacgtgtacacgactaacttattacgtaactacccctattaccacgtacgttaccggacccgttacgggaaacctaaaggtcggaactaacgtaacgaaaacgtacgtggtacggtacccg

SEQ ID NO: 327528 - DNA, 757 bp, Homo sapiens
  misc_feature: GZ8MTXP02GERIU.10.53.E09.1.454.CMB.2.raw
tcagcatagtagtgcacgaccggtgctcgatttagagagagtgtgttggggtttggggagctctgggagacgagcccagcactggaagtcgccggtgtttccattcggtgatcatcactgaacacagaggactcaccatggagtttgggctgagcttgggttttcctcgttgctcttttaagaggtgtccagtgtcaggtgcagctgggtggagtcgtgggggaggtcggtggtccaggccgtggggacggtccctcagactctcctgtttacgcctctggattcaccttcagtagttatcctttgctacgtgggtccgtcacggcctccgaggcgaaggggctgggaggtgggtgctagttatccgtctatttgatggaagaactaataaactactaacgaagtacgtaccgttccgggttaccggggtaccgtactttaccgaccacttacctaacccgtaaaacgtaaccttaaaagtttaacgaaaacgtaaaaccgaaccggtaccgtttacgttttaccgttacggtaacctaaaagttaacggaaaaccgtaacggtacccgtaggaacggtaacggtaccgttagggaacgggaaccgaacggggtcgttacgggtttaggttaaacgttttaaccggtttcggtttttaccgggttttcgggttttaccggttaacggttaccgggtttaccggggttaaccggggggttaaacttaaccccggtttacggaaccggtttaacccggg

SEQ ID NO: 327529 - DNA, 694 bp, Homo sapiens
  misc_feature: GZ8MTXP02I4AQZ.10.53.E09.1.454.CMB.2.raw
  modified_base (260)..(260): a, c, t, g, unknown or other
  misc_feature (260)..(260): n is a, c, g, or t
tcagcatagtagtgcacgaccggtgctcgatttagagagagtgtgttgggtttggggctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggagcgtggtccagcctgggacgtcctcagctctcctgttagcctntggatcacttcagtattatccttgctactggtcctcaggctccgaggcgaaggggctgggagtggggtgctagttactcgtactagtttgagtagggaataactaaaagttaaaatacgtaaacaaggtaacgaccgttcccggggttacgggggaccctaacttaccgaacctacttaccctaacccgaaaaggtaaccttaaaagtttacggaaaacgaaacctaaccgtacgttacgtttacgttacggaacctaaaagttacgaaactaacggacccgtaggagtacgtacgtagggaacgtaaccgacggtcgttacgttaggttactttaaccgttggttttcggttttacggttcgtacggtaaccggttcggggttaacgggggttaaccttacccggtacgtaacgtccggtaacggtccggggg

SEQ ID NO: 327530 - DNA, 670 bp, Homo sapiens
  misc_feature: GZ8MTXP02FZAXA.10.53.E09.1.454.CMB.2.raw
  modified_base (190)..(190): a, c, t, g, unknown or other
  misc_feature (190)..(190): n is a, c, g, or t
  modified_base (238)..(238): a, c, t, g, unknown or other
  misc_feature (238)..(238): n is a, c, g, or t
  modified_base (353)..(353): a, c, t, g, unknown or other
  misc_feature (353)..(353): n is a, c, g, or t
  modified_base (370)..(370): a, c, t, g, unknown or other
  misc_feature (370)..(370): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagctgggttttcctcgttgctcttttaagaggtgtccagtgtcaggtncagctggtggagtcgtgggggagcgtggtccagcctgggacgtccctnagactctcctgttacgcctcgtggtattcaccttcagtagttactcctttgcctacgtcgggtcctcgaggcctccgaggcgaaggggctgggagtgggtggctagtttactctntagtttgagtagggaanaaactaaaataaactactaacaggacgtaccgttccggggttccggggacctaagttccaacctactaccctaaccaaagtaactaagttagaaacgaacctacgtcgttgttactagaactaaatagtaacagccgtaagagacgacgtaggaacggacgtaccggtagttggttacgtttaacgtttacgtttcggttttccggtttaggtttccgttacggtaccggttcggggtaaccggggtaaactttcccgttacgaccggtccgtaaccgggtccggggtaccgaaccgggg

SEQ ID NO: 327531 - DNA, 614 bp, Homo sapiens
  misc_feature: GZ8MTXP02G9TTP.10.53.E09.1.454.CMB.2.raw
  modified_base (192)..(192): a, c, t, g, unknown or other
  misc_feature (192)..(192): n is a, c, g, or t
  modified_base (240)..(240): a, c, t, g, unknown or other
  misc_feature (240)..(240): n is a, c, g, or t
  modified_base (345)..(345): a, c, t, g, unknown or other
  misc_feature (345)..(345): n is a, c, g, or t
  modified_base (349)..(349): a, c, t, g, unknown or other
  misc_feature (349)..(349): n is a, c, g, or t
  modified_base (360)..(360): a, c, t, g, unknown or other
  misc_feature (360)..(360): n is a, c, g, or t
  modified_base (375)..(375): a, c, t, g, unknown or other
  misc_feature (375)..(375): n is a, c, g, or t
  modified_base (400)..(400): a, c, t, g, unknown or other
  misc_feature (400)..(400): n is a, c, g, or t
  modified_base (410)..(410): a, c, t, g, unknown or other
  misc_feature (410)..(410): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagcttgggttttcctcgttgcttcttttaagaggtgtccagtgtcaggtncagctggtggagtcgtgggggagcgtggtccagccgtgggagtccctnagactctcctgttacgcctctggattcaccttcagttattactcctttgctacgtcgggtcctcaggcctccgaggcgaaggggctgggaggtgggtgctagttntctntattgatgganaacaataaatacaangacactccggtcgggcctatccacntaccacaaanactaattagaaagaaccacgtacttgttactagaactaaagtagaaactacgcctagaagacgacgtacggacggaacgaccggtagtgtacgttaagttacgtttaggtttcgtttacggttacgttcggtaccggttcgggtaccgggggttaaacttccgttaacggacgtaccgtaccggtacggggacccgtacccggg

SEQ ID NO: 327532 - DNA, 595 bp, Homo sapiens
  misc_feature: GZ8MTXP02JOAFA.10.53.E09.1.454.CMB.2.raw
  modified_base (249)..(249): a, c, t, g, unknown or other
  misc_feature (249)..(249): n is a, c, g, or t
  modified_base (354)..(354): a, c, t, g, unknown or other
  misc_feature (354)..(354): n is a, c, g, or t
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagctgggttttcctcgttgcttcttttaagaggtgtccagtgtcaggtgcagctggtggagtcgtgggggagcgtggtccagcctggggacgtccctnagactctcctgttagcctctgattcaccttcagtagttatcctttgctacgtggtccgtcaggctccgaggcgaaggggctgggaggtgggtgctagttatcctntatttgatggaagaacataaatactacagacgacgtccgggtcggggaccgtactccaccactactaccaaagactaaattagaaacgaacacgtacttcgttactagtacaaatagaacacgacctagagacgacgtaggacggaacgacggtacgtgtagttaacttacgttcgtttaccggttttggttcgttcgtacgttacgggtacgggggtaacttaccgttacgacgtaccgg

SEQ ID NO: 327533 - DNA, 629 bp, Homo sapiens
  misc_feature: GZ8MTXP02JO477.10.53.E09.1.454.CMB.2.raw
  modified_base (244)..(244): a, c, t, g, unknown or other
  misc_feature (244)..(244): n is a, c, g, or t
tcagcatagtagtgcacgaccggtgctcgatttagagagagtgtgttgggtttggggctgggagacgagcccagcactggaagtcgccggtgtttccattcggtgatcatcactgaacacagaggactcaccatggagtttgggctgagctgggttttcctcgttgcttcttttaagaggtgtccagtgtcaggtgcagctggtggagtcgtgggggaggcgtggtccagcctgggagtccctnagctctcctgttacgcctctggacttcacctttcagttagtttactcctttggcctacgtcgggtcctcaggcctccgaggcgaagggggctgggaggtggggtggctagttactctctagttttgagttaggaacgaactaaaattaaactacctaaacgaggaacggtaccgttcccggggttacgggggccctattaccacctactcctaaccaaagaactaaatttagaaacgaacgacgtaccttagtttacgacgactaaatacgaaactacgaccgtagagacgcgtaggacggacgacggctcgtagttacttacgttgtttcgtttgttctcgtacgtcgggtacgggtaacttacgtcgacgcgtacggtacggg

SEQ ID NO: 327534 - DNA, 605 bp, Homo sapiens
  misc_feature: GZ8MTXP02HB7LV.10.53.E09.1.454.CMB.2.raw
  modified_base (348)..(348): a, c, t, g, unknown or other
  misc_feature (348)..(348): n is a, c, g, or t
  modified_base (359)..(359): a, c, t, g, unknown or other
  misc_feature (359)..(359): n is a, c, g, or t
tcagcatagtagtgcacgaccggtgctcgatttagagagagtgtgttgggtttgggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggagcgtggtccagccgtgggaggtccctcagactctcctgttacgcctctggattcaccttcagtagttatcctttgctacgtgggtcctcaggcctccgaggcgaaggggctgggaggtgggtggctagttatctntattgatgganacaaataaatactacagagactccgggttcggggcctattaccaccatcctaccaaagaactaaattagaaagaacacgtcttgttactgacaaatagaactagacctagaagagacgtaggaggacgacggtacgtgttagttacttacgttggtttcggtttcggtttcgttacgtaccgttccgggttacgggggtaacttaccgttacgacggtaccgtacggtcgggggaccgtaacgggg

SEQ ID NO: 327535 - DNA, 567 bp, Homo sapiens
  misc_feature: GZ8MTXP02FQZKE.10.53.E09.1.454.CMB.2.raw
  modified_base (246)..(246): a, c, t, g, unknown or other
  misc_feature (246)..(246): n is a, c, g, or t
  modified_base (362)..(362): a, c, t, g, unknown or other
  misc_feature (362)..(362): n is a, c, g, or t
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggagcgtggtccagcctgggagtccctnagctctctgttagcctctggattcaccttcagtagttatccttgcacgttgggtcctcaggctccgaggcgaaggggctgggaggtggggtgctagttatcctctatttgatgganacataaactactaacagacgtacgtccgggttcggggccgtattccaccactactaccaaagactaattagaacgaacacgtcttgttctagacaaatacgaaacacgcctagagagcgtagacggacgacggcgtgtagttattacgttgtttcgtttggttcgtgtacgttcggtacgggggtacttaccgttacgacgtacg

SEQ ID NO: 327536 - DNA, 756 bp, Homo sapiens
  misc_feature: GZ8MTXP02F6MJS.10.53.E09.1.454.CMB.2.raw
  modified_base (259)..(259): a, c, t, g, unknown or other
  misc_feature (259)..(259): n is a, c, g, or t
  modified_base (310)..(310): a, c, t, g, unknown or other
  misc_feature (310)..(310): n is a, c, g, or t
tcagcatagtagtgcacgaccggtgctcgatttagagagagtgtgttgggttttcctcgttgctcttttaagaggtgtccagtgtcaggtgcagctggtggagtcgtgggggaggcgtggtccagcctgggaggtccctcagactctcctgtttagcctctggattccaccttcagtagttatcctttgcactgggtccgtcaggcctccaggcgaaggggctgggagtggggtggctagttatctctatttgatgganacaaataaatactacagagactccggtcgggccattcaccatctaccaaanactaattgaaacgaacacgtcttgtttctagaactaaatgaaacagaccgtagaggacgtcgaggaacgacgacggcttgtgttattacgttgtttcgtttggttctaggtaccgttacggggtacgggggtaaactaccgttcgacggtctacggtccgggggaccgacgggggtccctacccggttcggtacccgtacccggttccttccccgtacgacccgtaccccgtaccccgaaacccggacccgggtccccacgttccccgggttcccccttaccccccggtcggtaccccctaccccccgttacccgtaaccccgaaaccggtaccgaaccccgtacccggttacccggggtcggggggtaccccctaaccggtaaccggggcccccgggtcccccggtaacggggttcccctacggggtccccgtttaacccggggg

SEQ ID NO: 327537 - DNA, 542 bp, Homo sapiens
  misc_feature: GZ8MTXP02GJLKI.10.53.E09.1.454.CMB.2.raw
  modified_base (315)..(315): a, c, t, g, unknown or other
  misc_feature (315)..(315): n is a, c, g, or t
tcagcatagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctgcctgtgtctctgggcgagagggccaccatcaactgcaagtccagccagagttgttttatcagctaccgacaataagaactacttagcttggtaccagcaagaaaccaggacagcctaccaagctgctcatttacngggcatccgtacccgggatcccccggggtccctgaccgtattcgagtggcgaggcgggtcgtggggacagactttcactctacacactcagcacgcctgcaggctagaagagtgcggctagtttatacgtgtacagtactactattactacgtacccctattaccactacgttccggcccgtacggacctaaagtggaacgactacgaaacgtaacgtgtacgtacg

SEQ ID NO: 327538 - DNA, 563 bp, Homo sapiens
  misc_feature: GZ8MTXP02JYNJM.10.53.E09.1.454.CMB.2.raw
  modified_base (265)..(265): a, c, t, g, unknown or other
  misc_feature (265)..(265): n is a, c, g, or t
  modified_base (351)..(351): a, c, t, g, unknown or other
  misc_feature (351)..(351): n is a, c, g, or t
  modified_base (365)..(365): a, c, t, g, unknown or other
  misc_feature (365)..(365): n is a, c, g, or t
tcagcatagtagtgcacgaccggtgctcgatttagagagagtgtgttgggtttggggctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtggggggagcgtggtccagccgagggaggtccctcagactctcctgtttagcctntggattcaccttcagtagttatcctttgcacgtgggtcccgtcaggcctccgaggcgaaggggctgggaggtggggtgctagttanctcatttgatgganacaattaatctacagacgacgtccggttcggggcctatccacatctacaaagactaattagaagaacacgcttgttctgacaaatgaacagcctagagagctaggaggacgacggctgtgttattcgttagtttcgtttggttcgttgtaccgttcgggtacggggtaacttaccgttcgacgtcgacggtaccgggg

SEQ ID NO: 327539 - DNA, 484 bp, Homo sapiens
  misc_feature: GZ8MTXP02HBJX8.10.53.E09.1.454.CMB.2.raw
  modified_base (228)..(228): a, c, t, g, unknown or other
  misc_feature (228)..(228): n is a, c, g, or t
  modified_base (235)..(235): a, c, t, g, unknown or other
  misc_feature (235)..(235): n is a, c, g, or t
  modified_base (248)..(248): a, c, t, g, unknown or other
  misc_feature (248)..(248): n is a, c, g, or t
  modified_base (251)..(251): a, c, t, g, unknown or other
  misc_feature (251)..(251): n is a, c, g, or t
  modified_base (254)..(254): a, c, t, g, unknown or other
  misc_feature (254)..(254): n is a, c, g, or t
  modified_base (257)..(257): a, c, t, g, unknown or other
  misc_feature (257)..(257): n is a, c, g, or t
  modified_base (260)..(260): a, c, t, g, unknown or other
  misc_feature (260)..(260): n is a, c, g, or t
  modified_base (263)..(263): a, c, t, g, unknown or other
  misc_feature (263)..(263): n is a, c, g, or t
  modified_base (265)..(265): a, c, t, g, unknown or other
  misc_feature (265)..(265): n is a, c, g, or t
  modified_base (269)..(269): a, c, t, g, unknown or other
  misc_feature (269)..(269): n is a, c, g, or t
  modified_base (271)..(271): a, c, t, g, unknown or other
  misc_feature (271)..(271): n is a, c, g, or t
  modified_base (278)..(279): a, c, t, g, unknown or other
  misc_feature (278)..(279): n is a, c, g, or t
  modified_base (282)..(282): a, c, t, g, unknown or other
  misc_feature (282)..(282): n is a, c, g, or t
  modified_base (285)..(285): a, c, t, g, unknown or other
  misc_feature (285)..(285): n is a, c, g, or t
  modified_base (287)..(287): a, c, t, g, unknown or other
  misc_feature (287)..(287): n is a, c, g, or t
  modified_base (292)..(292): a, c, t, g, unknown or other
  misc_feature (292)..(292): n is a, c, g, or t
  modified_base (294)..(294): a, c, t, g, unknown or other
  misc_feature (294)..(294): n is a, c, g, or t
  modified_base (296)..(296): a, c, t, g, unknown or other
  misc_feature (296)..(296): n is a, c, g, or t
  modified_base (298)..(298): a, c, t, g, unknown or other
  misc_feature (298)..(298): n is a, c, g, or t
  modified_base (301)..(301): a, c, t, g, unknown or other
  misc_feature (301)..(301): n is a, c, g, or t
  modified_base (303)..(304): a, c, t, g, unknown or other
  misc_feature (303)..(304): n is a, c, g, or t
  modified_base (306)..(306): a, c, t, g, unknown or other
  misc_feature (306)..(306): n is a, c, g, or t
  modified_base (308)..(308): a, c, t, g, unknown or other
  misc_feature (308)..(308): n is a, c, g, or t
  modified_base (310)..(310): a, c, t, g, unknown or other
  misc_feature (310)..(310): n is a, c, g, or t
  modified_base (312)..(312): a, c, t, g, unknown or other
  misc_feature (312)..(312): n is a, c, g, or t
  modified_base (314)..(315): a, c, t, g, unknown or other
  misc_feature (314)..(315): n is a, c, g, or t
  modified_base (318)..(318): a, c, t, g, unknown or other
  misc_feature (318)..(318): n is a, c, g, or t
  modified_base (320)..(320): a, c, t, g, unknown or other
  misc_feature (320)..(320): n is a, c, g, or t
  modified_base (322)..(322): a, c, t, g, unknown or other
  misc_feature (322)..(322): n is a, c, g, or t
  modified_base (324)..(324): a, c, t, g, unknown or other
  misc_feature (324)..(324): n is a, c, g, or t
  modified_base (326)..(326): a, c, t, g, unknown or other
  misc_feature (326)..(326): n is a, c, g, or t
  modified_base (328)..(328): a, c, t, g, unknown or other
  misc_feature (328)..(328): n is a, c, g, or t
  modified_base (355)..(355): a, c, t, g, unknown or other
  misc_feature (355)..(355): n is a, c, g, or t
  modified_base (357)..(357): a, c, t, g, unknown or other
  misc_feature (357)..(357): n is a, c, g, or t
  modified_base (363)..(363): a, c, t, g, unknown or other
  misc_feature (363)..(363): n is a, c, g, or t
  modified_base (370)..(370): a, c, t, g, unknown or other
  misc_feature (370)..(370): n is a, c, g, or t
  modified_base (372)..(372): a, c, t, g, unknown or other
  misc_feature (372)..(372): n is a, c, g, or t
  modified_base (374)..(374): a, c, t, g, unknown or other
  misc_feature (374)..(374): n is a, c, g, or t
  modified_base (376)..(376): a, c, t, g, unknown or other
  misc_feature (376)..(376): n is a, c, g, or t
  modified_base (378)..(378): a, c, t, g, unknown or other
  misc_feature (378)..(378): n is a, c, g, or t
  modified_base (380)..(380): a, c, t, g, unknown or other
  misc_feature (380)..(380): n is a, c, g, or t
  modified_base (393)..(393): a, c, t, g, unknown or other
  misc_feature (393)..(393): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagcggtggtttcgcgtaggctctttaagaggtgtcagtgtcaggtgcagctggtggagtgtgggggaggcgtggtccagcctgggngtccctnagtctctctgttnctntgntcnctnatntntctncngtggtcnngcncgngngaggngngngnggngnntntntntntnnganananananangagcgtcgtcgcgctcacactacacananataganacatctntntnanananacagcgagagagngagacgacgacgtcgtgtagtattagttgttcgttcgttcgtcgtacgtcggtacggtaacgtacgtacgtacgtacgtacgtcggacgcg

SEQ ID NO: 327540 - DNA, 581 bp, Homo sapiens
  misc_feature: GZ8MTXP02G1HCL.10.53.E09.1.454.CMB.2.raw
  modified_base (248)..(248): a, c, t, g, unknown or other
  misc_feature (248)..(248): n is a, c, g, or t
  modified_base (357)..(357): a, c, t, g, unknown or other
  misc_feature (357)..(357): n is a, c, g, or t
  modified_base (373)..(373): a, c, t, g, unknown or other
  misc_feature (373)..(373): n is a, c, g, or t
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagctgggttttcctcgttgcttcttttaagaggtgtccagtgtcaggtgcagctggtggagtcgtgggggagcgtggtccagccgtgggagtccctnagactctcctgtttacgcctctggacttcaccttcagttagttactcctttgcctacgtcgggtccgtcaggcctccgaggcaaggggctgggagtgggtgctagttancctcatttgatggaanaacaataaactactaacagacgacgtccggtcgggcacttcaccatacacaaagactaattagaaagacacgtacttagtttactagactaaatacgaaacacgcctagagacgactagaggacacgggtctaggtacgttattacgttcgtttccgtttggttcgtggtacgtcgggtacggggtaacttaccgttacgacgtaccg

SEQ ID NO: 327541 - DNA, 734 bp, Homo sapiens
  misc_feature: GZ8MTXP02G1Y9V.10.53.E09.1.454.CMB.2.raw
  modified_base (245)..(245): a, c, t, g, unknown or other
  misc_feature (245)..(245): n is a, c, g, or t
  modified_base (259)..(259): a, c, t, g, unknown or other
  misc_feature (259)..(259): n is a, c, g, or t
  modified_base (267)..(267): a, c, t, g, unknown or other
  misc_feature (267)..(267): n is a, c, g, or t
tcagcatagtagtgcacgaccggtgctcgatttagagagagtgtgttgggtttggggctgggagacgagcccagcactggaagtcgccggtgtttccattcggtgatcatcactgaacacagaggactcaccatggagtttgggctgagctgggttttcctcgttgcttcttttaagaggtgtccagtgtcaggtgcagctggtggagtcgtgggggagcgtggtccagccgtgggacgtccctnagactctctgttcnctcgtgtntcacttcagtagttactccttgctacgtcgggtcctacgacggtcctccgaggccggaaggggtcgtaggggtagggttggggtggtcctaaggttactccgttataacgttttgagttagggaaactaactaaaaattaaaactacgttaaccgaaggtaaccgtacccgtttcccgggggtttaccgggggacccttaacgtttacccaaacccttaacttacccgtaaaccgtaaaacggtaaaccttaaagtttaacgaaacgtaaaccgtaccgtacgtttacgtttactacgaaacctaaaagttacgaaacgtaccggtactaaggagtacgagtacggacggacgacggtacttagttagttacgttacgttggtttacgttttacgtcgtacggttaccgttaacggggtaacggggtaacctttaccgtacggtacgtaccggtacggtacccgggg

SEQ ID NO: 327542 - DNA, 704 bp, Homo sapiens
  misc_feature: GZ8MTXP02JJG3D.10.53.E09.1.454.CMB.2.raw
  modified_base (190)..(190): a, c, t, g, unknown or other
  misc_feature (190)..(190): n is a, c, g, or t
  modified_base (341)..(341): a, c, t, g, unknown or other
  misc_feature (341)..(341): n is a, c, g, or t
  modified_base (371)..(371): a, c, t, g, unknown or other
  misc_feature (371)..(371): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagctgggttttcctcgttgctcttttaagaggtgtccagtgtcaggtncagctggtggagtcgtgggggagcgtggtccagccgtgggacggtccctcagactctcctgtttacgcctctggtacttccaccttcagttagttactcctttgctacgtgggtcctcaggcctccgaggcgaaggggctgggaggtgggnggctagtttatctctagtttgagtaggaanaactaaataaactacgtaacaggtacgtaccgttccggggttaccgggggaccttacgttaccaacctaactccgtaaacccgaaaaacgtaccttaaaagtttaacggaaaacgtaacccgaacggttccgtttaggtttacctacgtaaacgtaaaagttaacggaaaacgtacggacccttagggaacgaacgtccgtaaggacggacgaacggtcgttagtacgtttagtttaccgttggttttcggtttcggttacgttcggtaaccgttcgggtacggggtaacttaccgttacgaacgtccgtacggtcggggacccgtaacgggg

SEQ ID NO: 327543 - DNA, 691 bp, Homo sapiens
  misc_feature: GZ8MTXP02JHUXW.10.53.E09.1.454.CMB.2.raw
  modified_base (181)..(181): a, c, t, g, unknown or other
  misc_feature (181)..(181): n is a, c, g, or t
  modified_base (248)..(248): a, c, t, g, unknown or other
  misc_feature (248)..(248): n is a, c, g, or t
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagctgggttttcctcgttgctcttttaagnggtgtccagtgtcaggtgcagctggtggagtcgtgggggagcgtggtccagccgtgggacgtccctnagactctcctgttacgcctctggattcaccttcagttagttactcctttgcctacgtcgggtccgtcacggtcctccgaggccgaaggggctgggaggttggggtgctaggttatcctactagtttgagtggaagaactaattaaaactactaaacgacgtaacgtaccgttcccgggttaccgggggacccgtacgttacccaacccgtactacctaacccaaaacggtaacctaaagtttaacgaaacgaaacctacgtaccgtttacgtttacgtacggtaacaaaagttacgaaaacgtacgtacccgtaggacgagtaccgtaggacggacgaacggtcgttaggttacgttactttacgttcgtttcggtttacggtttcgttaacggtaccggttacggggtaccgggggtaacttacccgtttcgacgtacccgg

SEQ ID NO: 327544 - DNA, 546 bp, Homo sapiens
  misc_feature: GZ8MTXP02FWG5C.10.53.E09.1.454.CMB.2.raw
  modified_base (239)..(239): a, c, t, g, unknown or other
  misc_feature (239)..(239): n is a, c, g, or t
  modified_base (258)..(258): a, c, t, g, unknown or other
  misc_feature (258)..(258): n is a, c, g, or t
  modified_base (301)..(301): a, c, t, g, unknown or other
  misc_feature (301)..(301): n is a, c, g, or t
  modified_base (329)..(329): a, c, t, g, unknown or other
  misc_feature (329)..(329): n is a, c, g, or t
  modified_base (340)..(340): a, c, t, g, unknown or other
  misc_feature (340)..(340): n is a, c, g, or t
  modified_base (351)..(351): a, c, t, g, unknown or other
  misc_feature (351)..(351): n is a, c, g, or t
  modified_base (369)..(369): a, c, t, g, unknown or other
  misc_feature (369)..(369): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggagcgtggtccagcctgggacggtccctnagactctcctgttagcctntggattccaccttcagtagttatcctttgctactgggtccctnaggctccaggcaaggggctggagtgggngcagttatctnatttgatgganacaataaatactacaganactccgtcggggcattcacatctaccaaagacaatttagaaagaacacgtctgtttctagacaaatgaaacagcctagagagcgtagaggacacggactgtagtattacgtgtttcgtttggttctcgtacgtcggtacggggaactaccgttcgacgcgacgtcggggacacgggg

SEQ ID NO: 327545 - DNA, 617 bp, Homo sapiens
  misc_feature: GZ8MTXP02JYY75.10.53.E09.1.454.CMB.2.raw
  modified_base (251)..(251): a, c, t, g, unknown or other
  misc_feature (251)..(251): n is a, c, g, or t
  modified_base (271)..(271): a, c, t, g, unknown or other
  misc_feature (271)..(271): n is a, c, g, or t
  modified_base (308)..(308): a, c, t, g, unknown or other
  misc_feature (308)..(308): n is a, c, g, or t
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctgggtggagtcgtgggggagcgtggtccagcctggggacgtccctnagactctcctgttacgcctntgatcacttcagtattatcctttgcacgtggtccgtnaggcctccgaggcgaaggggctagggaggtggggtgctagttatcctctatttgagtggaacaactaataaactactacgagacgtaccgttccgggtacggggaccgtattaccacctactacctaaccaaagaactaagttacgaaacgtaactacgtacttagtttactacgactaaatacgaacacgaccgtagagacgacgtagacggacgacggtacgttgtagttactttacgttcgtttcggtttggttacgtaacggtacgttacgggtacgggggtaacttaccgttacgacggtaccg

SEQ ID NO: 327546 - DNA, 705 bp, Homo sapiens
  misc_feature: GZ8MTXP02JPAJ5.10.53.E09.1.454.CMB.2.raw
  modified_base (250)..(250): a, c, t, g, unknown or other
  misc_feature (250)..(250): n is a, c, g, or t
  modified_base (364)..(364): a, c, t, g, unknown or other
  misc_feature (364)..(364): n is a, c, g, or t
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagctgggttttcctcgttgcttcttttaagaggtgtccagtgtcaggtgcagcgtggtggagtcgtgggggagcgtggtccagccgtgggacgtccctnagactctcctgtttacgcctctggacttccaccttcaagttagttactccgtttgacctacgtgggtccgtcaggctaccgaggcgaaggggctgggagtggggtgctagttanccgtctagtttgagttggaacaactaattaaactactaacgagtaacgtaccgttccgggttcggggaccgtacttaccaacctacttacctaaccaaaacgtaacctaaatttaacggaaaacgtaaaccgtaccgtactttacgtttacgtacgtaaacctaaagttacgaaaaccgtacgtaccgtaggtaacgagtaccgttaaggaacggaaccgtaccgggtcgttaggttacgttaaagtttacgtttacggttttaccggtttggtttcgttaacggttaccggtttacgggttaaccgggggtaactttacccggttacgtacgtaacccgg

SEQ ID NO: 327547 - DNA, 687 bp, Homo sapiens
  misc_feature: GZ8MTXP02HC5OW.10.53.E09.1.454.CMB.2.raw
  modified_base (243)..(243): a, c, t, g, unknown or other
  misc_feature (243)..(243): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtggagtcgtgggggaggcgtggtccaggccgtgggacgtccctnagactctccttgttacgcctcgtggacttccaccttcagttagttactccctttgctacgtcggggtcctcaggcctccgaggcgaaggggctgggagtggggtgctaggttatctactagtttgaagtggggaaactaactaaaataaaatacgtaacaggtaacgaccgttcccggggttacgggggaccctaatttcccaaaccctactacccttaaacccgaaaagtaacctaaagtttaacgaaaacgtaaaccgtacgtacctttacgtttaccgttacgaaaccgtaaaattacgaaaaccgtacgaccgttaggaagacgtacgaggacggacgaccggtgtagttacgttatttacgttggtttcgttggttcgtacgtacgtcgggtacggggtaactaccgttcgacggcgtaccggtcggggaccgaccggg

SEQ ID NO: 327548 - DNA, 628 bp, Homo sapiens
  misc_feature: GZ8MTXP02FQUSL.10.53.E09.1.454.CMB.2.raw
  modified_base (190)..(190): a, c, t, g, unknown or other
  misc_feature (190)..(190): n is a, c, g, or t
  modified_base (237)..(237): a, c, t, g, unknown or other
  misc_feature (237)..(237): n is a, c, g, or t
  modified_base (255)..(255): a, c, t, g, unknown or other
  misc_feature (255)..(255): n is a, c, g, or t
  modified_base (354)..(354): a, c, t, g, unknown or other
  misc_feature (354)..(354): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagctgggttttcctcgttgctcttttaagaggtgtccagtgtcaggtncagctggtggagtcgtgggggagcgtggtccagcctgggagtccctnagctctcctgttagcctntggattcaccttcagtattatcctttgctacgtgggtcctcgaggcctccgaggcaaggggctgggaggtggggtgctagttatctctatttgatgganaacaaataaatactaacagacgtacgttccgggttcgggggacctaatttccaaaccctactacctacccaaaagaactaaagtttagaaagaaacacgtacttcgtttactacgtaacaaatacgtaaacagaccgtagaagtacgacgtaggaacggaacgtacgggtacgtagtagttacgtttacgttgtttacggtttcggttacgttcgtacgttacgggtacgggggtaacttaccgttacgacggtcgacggtcggggacgacggg

SEQ ID NO: 327549 - DNA, 663 bp, Homo sapiens
  misc_feature: GZ8MTXP02IBAJP.10.53.E09.1.454.CMB.2.raw
  modified_base (258)..(258): a, c, t, g, unknown or other
  misc_feature (258)..(258): n is a, c, g, or t
  modified_base (270)..(270): a, c, t, g, unknown or other
  misc_feature (270)..(270): n is a, c, g, or t
  modified_base (320)..(320): a, c, t, g, unknown or other
  misc_feature (320)..(320): n is a, c, g, or t
tcagcatagtagtgcacgaccggtgctcgatttagagagagtgtgttgggtttgggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggagcgtggtccagcctgggacgtccctcagactctcctgttagcctnggattcaccttnagtagctacggcatgcacgtgggtcccaccaaactccgaggcaaaggggnttgggagtggggtgctaggtttgtttcatcgtggaggggtctagttgttcaattgggtatgctgaccgccgtaggaacgggcctattcgacctatctaccaagacgacctaacgtaccgaaggaaaccacgtaaacgttgttaacgtttacggaaccttaggaaacctaacgtacccgttaaagtacccgtaggaacggtacgtacgggggttacgtacgttaaaccgttaacgtagggttaaaccggggaaagggggaacgggggaaccgtacggggacggggtacgttaaccgtaaacggttaccttccggtttaggaccggttcggtacggggtacccgg

SEQ ID NO: 327550 - DNA, 612 bp, Homo sapiens
  misc_feature: GZ8MTXP02HETDM.10.53.E09.1.454.CMB.2.raw
  modified_base (249)..(249): a, c, t, g, unknown or other
  misc_feature (249)..(249): n is a, c, g, or t
  modified_base (353)..(353): a, c, t, g, unknown or other
  misc_feature (353)..(353): n is a, c, g, or t
  modified_base (359)..(359): a, c, t, g, unknown or other
  misc_feature (359)..(359): n is a, c, g, or t
  modified_base (373)..(373): a, c, t, g, unknown or other
  misc_feature (373)..(373): n is a, c, g, or t
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtggagtcgtgggggagcgtggtccagccgtgggagtccctnagactctcctgttagcctctggattcaccttcagtagttatccttgctagtcgggtccgtcaggctccgaggcgaaggggctgggaggtgggtggctagttacnccgtanatttgagtggaaanaaactaataaactactaacgagtacgtacgtccgggtacgggactactaccactactacctaacaaacgaactaaagttaacgaaacgaactacgtacgttacgttactagtaacaaataagaaacgacgacgagagagacgacgacggacgacgtacgtagtacgttacgttacgttacgtttcgtttcggttcgtaacgtacgtacggtacgggtaacgttaccgtacgtacgtacg

SEQ ID NO: 327551 - DNA, 753 bp, Homo sapiens
  misc_feature: GZ8MTXP02I5EII.10.53.E09.1.454.CMB.2.raw
  modified_base (334)..(334): a, c, t, g, unknown or other
  misc_feature (334)..(334): n is a, c, g, or t
  modified_base (542)..(542): a, c, t, g, unknown or other
  misc_feature (542)..(542): n is a, c, g, or t
tcagcatagtagtgcacgaccggtgctcgatttagagagagtgtgttgggtttggggagctacaacaggcaggcaggggcagcaagatggtgttgcagacccaggtcttcatttctctgttgctctggatctctggtgcctacggggacatcgtgatgacccagtctccagactcctgcctgtgtctcgtgggcgagacgggccacatcaactgacaagtccagccagtagttgttttaatcagtctaccgaacaaataacgaacttacttagcgttagaccagacgaacgaaaccaggacacgtcctacgtaagcctgcctactaatttacgngggactacgttacccggtaaccggggtaacgttccccccggggtaccctaggtacccgtaatttcggaacggttcgggcgtacgggcgggtaccgttaggggactaacggttactttaccaccgtcttacccaaaccgtactaccgacgacgcctaacggcgtacggtacgtaggtaacgtaacggtacgtacgggtaccgtaacggngttttaacgtttaaccgttacggttaccgtaacggtaccgtaaaccgttaaacgtttaaacgtttaaaccgttaacccccgttaaccgtttacccgttaaaccgtaaccgtttacccgggttaccccggttaccggggtaaacccggtaaaacggtaacgggtaacggtaacgtaaccgtaaaaccggtaaaccgtacggttacggtaccg

SEQ ID NO: 327552 - DNA, 663 bp, Homo sapiens
  misc_feature: GZ8MTXP02G1EDM.10.53.E09.1.454.CMB.2.raw
  modified_base (245)..(245): a, c, t, g, unknown or other
  misc_feature (245)..(245): n is a, c, g, or t
  modified_base (264)..(264): a, c, t, g, unknown or other
  misc_feature (264)..(264): n is a, c, g, or t
  modified_base (344)..(344): a, c, t, g, unknown or other
  misc_feature (344)..(344): n is a, c, g, or t
  modified_base (361)..(361): a, c, t, g, unknown or other
  misc_feature (361)..(361): n is a, c, g, or t
tcagcatagtagtgcacgaccggtgctcgatttagagagagtgtgttgggtttggggctgggagacgagcccagcactggaagtcgccggtgtttccattcggtgatcatcactgaacacagaggactcaccatggagtttgggctgagctgggttttcctcgttgcttcttttaagaggtgtccagtgtcaggtgcagctggtggagtcgtgggggagcgtggtccagccgtgggacgtccctnagctctcctgttacgcctntggatcaccttcagtagttactcctttgctacgtggtcctcaggctccgaggcgaaggggctgggagtgggtgcagttanctctagtttgatggaanacaaataaatactacagtacgtaccgtccgggttacggggacctagttaccacctactacctaaccaaaagtaacctaaatttacgaaacgtaaaccgtacgtacttacgtttactaggtaaactaaagttacgaaacgtacgtacctagaagacgtacgtaggaacggacgacgggtacttacggttagtttacgtttaccgtttggtttacggttttacggttcgttacggttaccggttaacggggttacgggggtaaactttacccggttacgtacggtaccgtacgggtaccggggg

SEQ ID NO: 327553 - DNA, 529 bp, Homo sapiens
  misc_feature: GZ8MTXP02G2VJL.10.53.E09.1.454.CMB.2.raw
  modified_base (177)..(177): a, c, t, g, unknown or other
  misc_feature (177)..(177): n is a, c, g, or t
  modified_base (242)..(242): a, c, t, g, unknown or other
  misc_feature (242)..(242): n is a, c, g, or t
  modified_base (327)..(327): a, c, t, g, unknown or other
  misc_feature (327)..(327): n is a, c, g, or t
  modified_base (336)..(336): a, c, t, g, unknown or other
  misc_feature (336)..(336): n is a, c, g, or t
  modified_base (350)..(350): a, c, t, g, unknown or other
  misc_feature (350)..(350): n is a, c, g, or t
tcagcatagtagtgcacgaccggtgctcgatttagagagagtgtgttgggtttggggctgggagacgagcccagcactggaagtcgccggtgtttccattcggtgatcatcactgaacacagaggactcaccatggagtttgggctgagctgggttttcctcgttgctcttttaagnggtgtccagtgtcaggtgcagctggtggagtcgtgggggagcgtggtccagcctgggagtccctnagctctcctgtttagcctctggatcacttcagtagttatccttgcactgggtcctcaggtctccaggcaaggggctggagtgggnggcagttanctcatttgatgganacaataaatactacagagacctccgtcggggcctatcacatctaccaaagacaattgaaagaacacgctgttctgacaaatagaacagccagagagctgagacgacgctagtatattactgttcgtttgttctagtacgtcggtacggggtaactacccgttgaacgcgaacgtcgggg

SEQ ID NO: 327554 - DNA, 574 bp, Homo sapiens
  misc_feature: GZ8MTXP02HL8MG.10.53.E09.1.454.CMB.2.raw
  modified_base (240)..(240): a, c, t, g, unknown or other
  misc_feature (240)..(240): n is a, c, g, or t
  modified_base (357)..(357): a, c, t, g, unknown or other
  misc_feature (357)..(357): n is a, c, g, or t
  modified_base (371)..(371): a, c, t, g, unknown or other
  misc_feature (371)..(371): n is a, c, g, or t
  modified_base (433)..(433): a, c, t, g, unknown or other
  misc_feature (433)..(433): n is a, c, g, or t
tcagcatagtagtgcacgaccggtgctcgatttagagagagtgtgttgggtttgggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctgggtggagtcgtgggggagcgtggtccaggcctgggagtccctnagctctcctgttagcctctggattcaccttcagtagttatcctttgcacgtgggtccgtcaggcctccgaggcaagggggctgggaggtggggtgctagttatctcatttgatgganacaataaatactangagactccggtcggggccatcaccatctaccaaagactaatttagaaagacacgtctgttcngacaaatgaaacagcctagaagagcgtaggacggacgacggacgtgtagttacttacgttgtttcggtttaggttctgtacgttcgggtacgggggtaacttaccgttacgacgcgtaccggtcggggtaccgtaccgggg

SEQ ID NO: 327555 - DNA, 774 bp, Homo sapiens
  misc_feature: GZ8MTXP02GZB64.10.53.E09.1.454.CMB.2.raw
  modified_base (245)..(245): a, c, t, g, unknown or other
  misc_feature (245)..(245): n is a, c, g, or t
tcagcatagtagtgcacgaccggtgctcgatttagagagagtgtgttgggtttggggctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggaggcgtggtccagccgtgggacgtccctnagactctcctgtttacgcctcgtggtacttccaccttcagttagtttactcctttgcctacgtcgggtcccgtcgacgggcctaccgaggtccgaagggggtctaggggagggttggggtggtctaaggtttactccgttacgtaagttttggaagttacgggaaacgtaaactaaaacttaaaacgttaccgtaaacgaaggtaaacccggtaccgttcccccgggggtttacgggggacccctaaacgttacccgtaaccctaaccgttaccctaaacccgtaaaaacgtaaacccgttaaaagtttaacggaaaacggtaaaccgtaaaccgttcgtttacgtttaccgtacggtaaactaaaacgttacgaaacgtacgtaccgtagacggtagacgtacggaacggacgacggtacgtagttacgttacgtttacgtttcggtttacgtttacggttcgtaggtaaccggttcgggtaacggggttaaccttaccggttacgtacgtacggtaccggtacgggg

SEQ ID NO: 327556 - DNA, 747 bp, Homo sapiens
  misc_feature: GZ8MTXP02H92FV.10.53.E09.1.454.CMB.2.raw
  modified_base (244)..(244): a, c, t, g, unknown or other
  misc_feature (244)..(244): n is a, c, g, or t
  modified_base (264)..(264): a, c, t, g, unknown or other
  misc_feature (264)..(264): n is a, c, g, or t
tcagcatagtagtgcacgaccggtgctcgatttagagagagtgtgttgggtttggggctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggagcgtggtccagccgtgggacgtccctnagactctcctgttacgcctntggattccaccttcagtagttactccttgctacgtgggtcctcgaggtcctccgaggcgaaggggctggggagtggggtgctagttactctctagtttggaattggggaaagtaaactaaaattaaaactaccgtaaacgaaggtacgtaacccgttcccggggtttaccgggggacccttaaacgtttacccgaaacccctaacttacccgtaaacccgtaaaaacggtaaacccgttaaaagttttaacggaaaacgtaaaacccgtaaccgtactttacggtttaccgtacgtaaacctaaaagttacgaaaccacggtacccgtaggaacggacgacgtaagggaaccggaccgtaacgggtcgttacggttagttaacgttacgtttcggtttacggttttcggttcgttacggtaccgttaacggggttaccgggggtaaacttacccgttacgaccggtccgtaacggtccggggg

SEQ ID NO: 327557 - DNA, 595 bp, Homo sapiens
  misc_feature: GZ8MTXP02GTEEQ.10.53.E09.1.454.CMB.2.raw
  modified_base (274)..(274): a, c, t, g, unknown or other
  misc_feature (274)..(274): n is a, c, g, or t
  modified_base (361)..(361): a, c, t, g, unknown or other
  misc_feature (361)..(361): n is a, c, g, or t
  modified_base (378)..(378): a, c, t, g, unknown or other
  misc_feature (378)..(378): n is a, c, g, or t
  modified_base (396)..(396): a, c, t, g, unknown or other
  misc_feature (396)..(396): n is a, c, g, or t
  modified_base (437)..(437): a, c, t, g, unknown or other
  misc_feature (437)..(437): n is a, c, g, or t
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctgggtggagtcgtgggggagcgtggtccagccgtggggacgtccctcagacctctcctgtttagccctntggacttcacttcagtagtttactcctttgctacgtcgggtcctcaggctccgaggcgaaaggggctgggagtgggtgactagttancctatattgatggaaanaactaataaactactaanagacgtacgtcggtacgggactactacacatacaacaaaanactaaagttagaaacactacgtacttagttctaagaacaaataacgaacaacgacgtacgacgagagagacgaacgacggtacgtagttacgttagttacgttacgttcgtttcgttcgtcgtacgtacggtacggtaacgtaccgtacgtacgtacg

SEQ ID NO: 327558 - DNA, 738 bp, Homo sapiens
  misc_feature: GZ8MTXP02HLKKF.10.53.E09.1.454.CMB.2.raw
  modified_base (251)..(251): a, c, t, g, unknown or other
  misc_feature (251)..(251): n is a, c, g, or t
  modified_base (357)..(357): a, c, t, g, unknown or other
  misc_feature (357)..(357): n is a, c, g, or t
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtggagtcgtgggggagcgtggtccagcctggggacgtcccctnagactctcctgttagcctctggattcaccttcagtagttatcctttgctacgtgggtccgtcaggcctccgaggcgaaggggctgggagtggggtgctaggtttancctactatttgagttggaagaactaataaaactactaacgagacgtaccgttacccgggttcggggaccgtacgtttaccgaccctaacgttacctaacccgaaaacgtaacctaaagttttacggaaaacgtaaaccgaaccgtaccgttacgttttaccgtagtaaccgtaaaagttacgtaaaccgacgtacccgttaggaaggtaacggaccgtagggaacgggaaccgtaaccggggtacgttcggttaacggtttaacgtttaaaccgtttcggttttaccggtttttacgggtttccgttaacggttaacccggtttaccggggttaaccgggggttaaacctttaacccggtttaccgtaaacggttacccgg

SEQ ID NO: 327559 - DNA, 554 bp, Homo sapiens
  misc_feature: GZ8MTXP02HWJDR.10.53.E09.1.454.CMB.2.raw
  modified_base (243)..(243): a, c, t, g, unknown or other
  misc_feature (243)..(243): n is a, c, g, or t
  modified_base (274)..(274): a, c, t, g, unknown or other
  misc_feature (274)..(274): n is a, c, g, or t
  modified_base (297)..(297): a, c, t, g, unknown or other
  misc_feature (297)..(297): n is a, c, g, or t
  modified_base (354)..(354): a, c, t, g, unknown or other
  misc_feature (354)..(354): n is a, c, g, or t
  modified_base (370)..(370): a, c, t, g, unknown or other
  misc_feature (370)..(370): n is a, c, g, or t
  modified_base (374)..(374): a, c, t, g, unknown or other
  misc_feature (374)..(374): n is a, c, g, or t
tcagcatagtagtgcacgaccggtgctcgatttagagagagtgtgttgggtttggggctgggagacgagcccagcactggaagtcgccggtgtttccattcggtgatcatcactgaacacagaggactcaccatggagtttgggctgagcttgggttttcctcgttgctcttttaagaggtgtccagtgtcaggtgcagctggtggagtcgtgggggagcgtggccagccgtgggagtccctnagctctcctgttagcctctggattcaccttnagtattatcttgcactgggtccnagggctccgaggcgaaggggctgggagtggggtgcagttactctcagtttgatgganactaaataaactctanaganaccgttcggtcgggctatcacatctacaaagactaaattagaagaacacgtactgttactgtaactaaatagaactacgccgtagagagtcgaggacgacgacggtctgtagttattacgttgtttcgtttgttcctagtacgtcgggtacggggtactaccgtgacgcgtacgtcgggg

SEQ ID NO: 327560 - DNA, 761 bp, Homo sapiens
  misc_feature: GZ8MTXP02IBDT1.10.53.E09.1.454.CMB.2.raw
  modified_base (368)..(368): a, c, t, g, unknown or other
  misc_feature (368)..(368): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggagcgtggtccagcctgggacgtccctcagactctcctgttacgcctctggattcaccttcagttagttatccctttgctacgtcgggtcctcgaggcctccgaggcgaaggggctgggaggtggggtggctaggttatctactagtttgagtggaanaacaaataaactacaacgagaacgtaacccgttccgggttaccgggggacctacgtttacccgaaaccctaactaccctaacccgaaaacgtaaccttaaaagtttacggaaaacgtaaacccgtaaccgtacctttacggtttaccgtacggtaaacctaaaacgttaccggaaaacgtacggacccgttagggaacgtaacggtaccgtaaggaacgggtaaaccgaccgggtaccgttaggttaacgtttaacgtttacgtttcgggtttaccggttttcgggtttaccgttacgggtacccggttaccggggtaaccgggggtaaacctttaccccgttacggtaaccggtacccggtaccggttacgggggaccccggtaaccggggg

SEQ ID NO: 327561 - DNA, 592 bp, Homo sapiens
  misc_feature: GZ8MTXP02F8PMU.10.53.E09.1.454.CMB.2.raw
  modified_base (261)..(261): a, c, t, g, unknown or other
  misc_feature (261)..(261): n is a, c, g, or t
  modified_base (291)..(291): a, c, t, g, unknown or other
  misc_feature (291)..(291): n is a, c, g, or t
  modified_base (322)..(322): a, c, t, g, unknown or other
  misc_feature (322)..(322): n is a, c, g, or t
  modified_base (394)..(394): a, c, t, g, unknown or other
  misc_feature (394)..(394): n is a, c, g, or t
  modified_base (448)..(448): a, c, t, g, unknown or other
  misc_feature (448)..(448): n is a, c, g, or t
tcagcatagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagacctcctgcctgtgtctcgtgggcgaggacgggccacatcaactgacaacgtccagccagtagttgttttatcagctacgacaaataanaactactagctacggaccagcaagaaaccnggacacgcctacaagctgctatactttacgnggactacgtaccgtaaccggggacgttcccccggggtccacgaccgtattcgagttcgggcgagggcgggtntacggggactagtctttccacctctaccacgatcgaagcacgcctgacgacggntaagaagagtcgggacgtacttaagtttataccgtgtactagactaattagtaacttaccgtaccctattaccacgttacgttcccggaccgtaacgggaacctaaaggtggaaaatactaaacgaaaacgtcgtacgtggacc

SEQ ID NO: 327562 - DNA, 585 bp, Homo sapiens
  misc_feature: GZ8MTXP02IFHNF.10.53.E09.1.454.CMB.2.raw
  modified_base (241)..(241): a, c, t, g, unknown or other
  misc_feature (241)..(241): n is a, c, g, or t
  modified_base (343)..(343): a, c, t, g, unknown or other
  misc_feature (343)..(343): n is a, c, g, or t
tcagcatagtagtgcacgaccggtgctcgatttagagagagtgtgttgggtttgggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctgggtggagtcgtgggggaggcgtggtccagcctggggagtccctnagactctcctgttagcctctggattcaccttcagtagttatcctttgctactgggtccgtcaggctccgaggcaaggggctgggagtgggtgcagttatctntagtttgatggaagacaaataaatactaacaggacgtactccggttcggggccgtattcaaccatctaccaaacgactaatttagaaagaacacgcttagttactgactaaatagaacagacctagagagcgtagacggacgacggctagtagttacttacgttggtttcgtttggttctcgtaccgttacggtacgggggtaacttaccgttacacgtcgacggtcggggaccgtaccggg

SEQ ID NO: 327563 - DNA, 575 bp, Homo sapiens
  misc_feature: GZ8MTXP02IVM8K.10.53.E09.1.454.CMB.2.raw
  modified_base (317)..(317): a, c, t, g, unknown or other
  misc_feature (317)..(317): n is a, c, g, or t
  modified_base (401)..(401): a, c, t, g, unknown or other
  misc_feature (401)..(401): n is a, c, g, or t
tcagcatagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctgcctgtgtctcgtgggcgagagggccaccatcaactgcaagtccagccagtagttgtttatcagctccgacaataagaactacttagcttggtaccagcaagaaaccaggacagccctcctaagctgctcatttacgngggcactcgtacccggggactccccggggtccctgaccgattcagtgcgaggcgggtcgtaggcgagtactttcactctcaccntcagcacgcctgcagctagagatgcggtactagtttactacgtgtacagacatttaactagtaccgtaacccctattaccacgttaacgttcccgggtacccgttacggggaaccctaaaaggtcggtaacggtaacgttaaccgaaaaccggtaaccgtggttacgggacccg

SEQ ID NO: 327564 - DNA, 734 bp, Homo sapiens
  misc_feature: GZ8MTXP02GUSGV.10.53.E09.1.454.CMB.2.raw
  modified_base (250)..(250): a, c, t, g, unknown or other
  misc_feature (250)..(250): n is a, c, g, or t
  modified_base (326)..(326): a, c, t, g, unknown or other
  misc_feature (326)..(326): n is a, c, g, or t
tcagcatagtagtgcacgaccggtgctcgatttagagagagtgtgttgggtttgggggagctacaacaggcaggcaggggcagcaagatggtgttgcagacccaggtcttcatttctctgttgctctggatctctggtgccgtacggggacatcgtgatgacccagtctccagacctccctgcctgtgtctctgggcgagagggccaccatcaactgacaagtccagccagagtgtttatcagctccganaataagaactacttagcttggaccagcgaacaaaccgaggacactccctactaagctcgcttacttaagtttacgngggactaacgtaccccggtaaaccccggggtaaccggttcccccccggggtaccctacggtaaaccgttacttacggtagggttcggaccgtagggggtacggggttaaggtacgggggaacctaggtttaacctttcctaaccttcctacccaactactacgaacgtaccacgtcccgtgaccgaggtacgaaaggtaaagtacgtgggtacgtacgtttaagttttaacttacgtacgtacgaactaaccttaaacttaactttaaacgtaaccccgttaacccttattaaccctaaccgttaccggttacccggtacccggtaaaccggggtaaaaccgtaaaaggggtcggtaaaacgtaaaccttaaaaccggaaaaccggttaccggtacgggtcgtacccg

SEQ ID NO: 327565 - DNA, 671 bp, Homo sapiens
  misc_feature: GZ8MTXP02G0P89.10.53.E09.1.454.CMB.2.raw
  modified_base (363)..(363): a, c, t, g, unknown or other
  misc_feature (363)..(363): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagctgggtttcctcgttgctctttaagaggtgtccagtgtcaggtgcagctggtggagtcgtgggggagcgtggtccagccgtgggacgtccctcagactctcctgtttacgcctctggacttccaccttcagttagttactcctttgcctacgtcggggtccctcgagggtcctccgagggcgaagggggtctgggaggtggggtggctaggttactctntagtttgagtagggaataactaaaattaaatacctaagacgggtacgtaccgttcccggggttacgggggacctaattccaacctactacctaaccgaaagtaactaaagttacgaaacgaaccgacgtacttcgttacgtacgtaaacctaaagtacgaacgtacgtaccgtaggaagacgtacgtaggacggacgtacggtcgtagttagttaacgtttacgttcggtttcggtttcggttcgttcggtacgttcgggtacggggtaacttaccgtacgacgtcgtacggtcgggaccgtaccggg

SEQ ID NO: 327566 - DNA, 612 bp, Homo sapiens
  misc_feature: GZ8MTXP02HYT3G.10.53.E09.1.454.CMB.2.raw
  modified_base (240)..(240): a, c, t, g, unknown or other
  misc_feature (240)..(240): n is a, c, g, or t
  modified_base (272)..(272): a, c, t, g, unknown or other
  misc_feature (272)..(272): n is a, c, g, or t
  modified_base (337)..(337): a, c, t, g, unknown or other
  misc_feature (337)..(337): n is a, c, g, or t
  modified_base (353)..(353): a, c, t, g, unknown or other
  misc_feature (353)..(353): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagctgggttttcctcgttgcttcttttaagaggtgtccagtgtcaggtgcagctgggtggagtcgtgggggagcgtggtccagccgtgggagtccctnagactctcttgttagcctctggattcaccttnagtatatcctttgcactgggtcctcaggcctccgaggcaaggggctgggagtgggtgctagttanctcagtttgatggaanaacaaataaatactacagacgactccgggttcggggcctattcaaccactcaccaaagactaattagaaagaacacgtctagtttctagacaaatagaaacagtacctagagagacgtaggaacgacgacggtctagtagttacgtttacgttggtttcgtttcggttacgttacggtaccgttccggggttaccgggggttaaacttacccgtttacgtacggtaccgtaaccgggttcgggggacccgaaccggggg

SEQ ID NO: 327567 - DNA, 565 bp, Homo sapiens
  misc_feature: GZ8MTXP02JCKWV.10.53.E09.1.454.CMB.2.raw
  modified_base (182)..(182): a, c, t, g, unknown or other
  misc_feature (182)..(182): n is a, c, g, or t
  modified_base (247)..(247): a, c, t, g, unknown or other
  misc_feature (247)..(247): n is a, c, g, or t
  modified_base (267)..(267): a, c, t, g, unknown or other
  misc_feature (267)..(267): n is a, c, g, or t
  modified_base (280)..(280): a, c, t, g, unknown or other
  misc_feature (280)..(280): n is a, c, g, or t
  modified_base (311)..(311): a, c, t, g, unknown or other
  misc_feature (311)..(311): n is a, c, g, or t
  modified_base (357)..(357): a, c, t, g, unknown or other
  misc_feature (357)..(357): n is a, c, g, or t
  modified_base (369)..(369): a, c, t, g, unknown or other
  misc_feature (369)..(369): n is a, c, g, or t
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagctgggttttcctcgttgcttcttttaagnggtgtccagtgtcaggtgcagctggtggagtcgtgggggagcgtggtccagcctgggagtccctnagactctcctgtttagcctntggattcaccttnagttagttactcctttgcacgttgggtcctnaggcctccgaggcgaaggggctgggagtggggtgctagttatcctnatttgattgganacataaatactacagagactccgggtcgggccgtactcaccatctaccaaagaactaatttagaaagaacacgacttgtttctagtacaaatagaaacagcctagagagcgtagaggacgacggctgtacgtattacgttcgtttcgtttggttcgtgtacgtcggtacgggggtaacttaccgttacgacgtacg

SEQ ID NO: 327568 - DNA, 671 bp, Homo sapiens
  misc_feature: GZ8MTXP02H2UKQ.10.53.E09.1.454.CMB.2.raw
  modified_base (240)..(240): a, c, t, g, unknown or other
  misc_feature (240)..(240): n is a, c, g, or t
  modified_base (341)..(341): a, c, t, g, unknown or other
  misc_feature (341)..(341): n is a, c, g, or t
  modified_base (354)..(354): a, c, t, g, unknown or other
  misc_feature (354)..(354): n is a, c, g, or t
  modified_base (553)..(553): a, c, t, g, unknown or other
  misc_feature (553)..(553): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctgggtggagtcgtgggggagcgtggtccagccgtgggacgtccctnagactctccttgtttacgccttctggtattcaccttcagttagttatcctttgctacgtgggtcctcaggcctccgaggcgaaggggctgggaggtggggngctagttactctnatttgagtaggaagaactaaaattaaactacgtaacaggacgtaccgttccgggttcgggggacctacttacaaccctactacctaaccaaaagtaactaaagtttacgaaagtaaccaacgtcttacgtttactagaactaaagttacgaacgtacgaccgtaggaagacgtcgtaggaacgggacgtaaccggggtntaggttacgttacgtttacgtttcggttttacggtttcggttacgtacggttaccggttacggggtacggggttaacttacccgtacgtacggtacgtaccggtcggggaccgacggg

SEQ ID NO: 327569 - DNA, 696 bp, Homo sapiens
  misc_feature: GZ8MTXP02H4M0N.10.53.E09.1.454.CMB.2.raw
tcagcatagtagtgcacgaccggtgctcgatttagagagagtgtgttgggttgggggagctacaacaggcaggcaggggcagcaagatggtgttgcagacccaggtcttcatttctctgttgctctggatctctggtgcctacggggacatcgtgatgacccagtctccagacctccctgcctgtcgtctctgggcgaggacgggccaccatcaactgacaagtccagccagtagttgttttatcagtctaccgaacaataagaactactagcttcgaaccagcaagaaacccagacacgcctaccaagctgctctatttacgtgggcacgtaccgaccccggggtacgtcccccggggtccctagacccgtattccgaggtacggcgacgggtccgggtcgtacggggaactacggtactttaccaccttcctaccaaccgtactacgaacgcccgtaacgcccgtacgaccggagggtacgtacggtaaagaacggttcgggacgggttaccttaagggttttaacttacgtacgttaccggaagtaccttaaaccgtttaagttaaccttaaaacccggttacccctaaacgttttaccaaaccgttaccggttacccggaccccggttaacgggaaacccgtaaaggtaacggaacgtaaactaacgaaaaccgtaacgtcggttaacgccg

SEQ ID NO: 327570 - DNA, 708 bp, Homo sapiens
  misc_feature: GZ8MTXP02FLYTJ.10.53.E09.1.454.CMB.2.raw
tcagcatagtagtgcacgaccggtgctcgatttagagagagtgtgttgggtttggggctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtggggggagcgtggtccagcctgggagtccctcagctctcctgttagcctctggattcaccttcagttagttactccttgctacgtgggtcctcaggcctccgaggcgaaggggctgggaggtggggtggctagttatctctatttgatggagaacaaataaatcaacagagaccgttccgggttcgggggaccgtacttaccaccctaacttacctaacccgtaaaacggtaacctaaaacgtttaggaaaacggtaaaccgtaaccggtaccttacgttttaccgtcgtaaactaaaacttaggaaaacacggtacccgtagaaggaacgcgttaggaacgggtaccgaaccgggtcgttacggttaggtttaactttaaccgtttcggttttaccggtttttacgggtttaccgttcggttaaccggttaaccgggggttacggggggttaaaaccttacccgtttaccgacggtaccgtaaccggttccggggg

SEQ ID NO: 327571 - DNA, 557 bp, Homo sapiens
  misc_feature: GZ8MTXP02HG1UH.10.53.E09.1.454.CMB.2.raw
  modified_base (246)..(246): a, c, t, g, unknown or other
  misc_feature (246)..(246): n is a, c, g, or t
  modified_base (260)..(260): a, c, t, g, unknown or other
  misc_feature (260)..(260): n is a, c, g, or t
  modified_base (337)..(337): a, c, t, g, unknown or other
  misc_feature (337)..(337): n is a, c, g, or t
  modified_base (345)..(345): a, c, t, g, unknown or other
  misc_feature (345)..(345): n is a, c, g, or t
  modified_base (349)..(349): a, c, t, g, unknown or other
  misc_feature (349)..(349): n is a, c, g, or t
  modified_base (360)..(360): a, c, t, g, unknown or other
  misc_feature (360)..(360): n is a, c, g, or t
  modified_base (377)..(377): a, c, t, g, unknown or other
  misc_feature (377)..(377): n is a, c, g, or t
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggagcgtggtccagcctgggagtccctnagctctcctgttancctctggattcaccttcagtagttatcctttgctactgggtccgtcaggcctccgaggcaaggggctgggagtgggngcagttancctnatttgatgganacataaatactacaganacgtccggtcgggaccgattaccacatactacaaagacaatttagaagaacacgtctgtttactgtacaatacgaacagcctagagagcgtagagacgacggtcgtgtagtattacgttgtttcgtttcggttcgttggtacgttacggtacgggggtaacttaccgtcgtaacgtccgg

SEQ ID NO: 327572 - DNA, 674 bp, Homo sapiens
  misc_feature: GZ8MTXP02GQO9Y.10.53.E09.1.454.CMB.2.raw
  modified_base (240)..(240): a, c, t, g, unknown or other
  misc_feature (240)..(240): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagcgtgggttttcctcgttgctcttttaagaggtgtccagtgtcaggtgcagctggtggagtcgtgggggagcgtggtccagccgtgggacgtccctnagctctcctgttacgcctctgattcacttcagtattactcctttgcctacgtcggggtcctcgaggtcctccgaggtcgaaggggtctgggaggtggggtgctaggttatccgtatagtttgagtagggaataactaaaataaactactaacgagacgtaccgttccggggttaccggggacctactttccaacctactacctaaaccaaaacgactaaagtttacgaaaacaactaacgtcttagtttactaggaaactaaattacgaaacgacgtaccgaggagaacggacgtaggaacggaacgtacggtcgttagttacgttacgtttacgtttcggtttcggtttcggttacgttacggtaccggttacgggttaacgggtaaccttacgtacgtacggtaccggtacgggtaccggggaccgtaccgg

SEQ ID NO: 327573 - DNA, 611 bp, Homo sapiens
  misc_feature: GZ8MTXP02JSLCD.10.53.E09.1.454.CMB.2.raw
  modified_base (242)..(242): a, c, t, g, unknown or other
  misc_feature (242)..(242): n is a, c, g, or t
  modified_base (350)..(350): a, c, t, g, unknown or other
  misc_feature (350)..(350): n is a, c, g, or t
  modified_base (361)..(361): a, c, t, g, unknown or other
  misc_feature (361)..(361): n is a, c, g, or t
  modified_base (375)..(375): a, c, t, g, unknown or other
  misc_feature (375)..(375): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagcttgggttttcctcgttgctcttttaagaggtgtccagtgtcaggtgcagctggtggagtcgtgggggaggcgtggtccagcctggggacggtccctnagacctctcctgtttagcctctggattcaccttcagttagttactcctttgcacgtgggtcctcaggctccgaggcgaaggggctgggagtggggtgctagttatctnatttgatgganacaaataatactanagacgaccgttccggtacggggcctattccacctactctaccaaacgactaattagaaacgacacgtcttgttactagtacaaatagaacagcctagagagcgtaggacggacgacggtacgtagtacgttacgtttacgttggtttcggttttaggttcgttacggtaccggttacgggttacgggggtaacgttaccgttacgacggtaccgtacggtcggggaccgtaccggg

SEQ ID NO: 327574 - DNA, 726 bp, Homo sapiens
  misc_feature: GZ8MTXP02I5PKA.10.53.E09.1.454.CMB.2.raw
  modified_base (243)..(243): a, c, t, g, unknown or other
  misc_feature (243)..(243): n is a, c, g, or t
tcagcatagtagtgcacgaccggtgctcgatttagagagagtgtgttgggtttggggctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggagcgtggtccagccgagggagtccctnagactctcctgttagccctctggattcaccttcagtagttatcctttgctacgtgggtcccgtcaggctccgaggcaaggggctgggagtggggtgctagttatctctagtttgatgggaagtactaaaagttaaatacctaagaaggaacgtaccgttcccgggttacggggggaccctaagttcccaaaccctacttaccctaaccgtaaaacgaacctaaaagttttacggaaaacgaaacctaaccggtaccttaggttttacctagtaacctaaaagttacgaaaacctacgggtaccctaggtaggaacggtaccgtaaggacgggaaccgaacggggtctttagggttaggtttactttaaaccggtttgggttttaccggtttttaggtttaccgttcggtaaaccgtttcccgggggttaagggggtaaaacctttacccggtttacgaaccggtccgtaacgggttccggggg

SEQ ID NO: 327575 - DNA, 720 bp, Homo sapiens
  misc_feature: GZ8MTXP02JKRW6.10.53.E09.1.454.CMB.2.raw
  modified_base (190)..(190): a, c, t, g, unknown or other
  misc_feature (190)..(190): n is a, c, g, or t
  modified_base (238)..(238): a, c, t, g, unknown or other
  misc_feature (238)..(238): n is a, c, g, or t
  modified_base (256)..(256): a, c, t, g, unknown or other
  misc_feature (256)..(256): n is a, c, g, or t
  modified_base (267)..(267): a, c, t, g, unknown or other
  misc_feature (267)..(267): n is a, c, g, or t
  modified_base (295)..(295): a, c, t, g, unknown or other
  misc_feature (295)..(295): n is a, c, g, or t
  modified_base (337)..(337): a, c, t, g, unknown or other
  misc_feature (337)..(337): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagctgggttttcctcgttgctcttttaagaggtgtccagtgtcaggtncagctggtggagtcgtgggggagcgtggtccagcctgggacgtccctnagctctcctgttagcctntgattcacttnagtagttatcctttgcacgtgggtcctnaggctccgaggcgaaggggctggagtgggtgctagttatctntagtttgagtggaagaacaaaattaaatacctaacgaggtaacgtaaccgttcccggggttaccgggggaccgtactttaccaacccgaacttacccgtaacccgaaaaaggtaaccttaaaagttttaacggaaaacgtaaaccctaaccggttacgttacggttttaccaaggtaaaccgtaaaaacgttaccgaaaacggtacggtacccgttacgggaaggaacgtaccgtagggaaacgggaccgtaacgggtccgttagttaacggtttaacgtttacgtttcggttttccggttttaggtttcccgttagtaccggttcggggtaacggggtaacttacccgtacgtacggacgtacggtcgggggaccgaacggg

SEQ ID NO: 327576 - DNA, 760 bp, Homo sapiens
  misc_feature: GZ8MTXP02G6YE8.10.53.E09.1.454.CMB.2.raw
  modified_base (241)..(241): a, c, t, g, unknown or other
  misc_feature (241)..(241): n is a, c, g, or t
tcagcatagtagtgcacgaccggtgctcgatttagagagagtgtgttgggtttgggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggaggcgtggtccagccgtgggaggtccctnagactctcctgttagcctctgattcacttcagtattatcctttgctacgtgggtcctcgaggctccgaggcgaaggggtctgggaggtggggtgctagttatctctatttgagtgggaagaactaaaattaaaacgtaccttaacgaggtaacgtaccttcccggggttacggggacccgtaagtttacccaacccgtaactacctaacccgtaaaaacgtaaccgtaaaagtttaacggaaaacgtaaaccctaaccgtactttacggtttacctacgtaaacctaaaacgttaacggaaacctacggacccgttaagggaaacggaacggtaccggtagggaaacgggtaaccgaccgggttaccgttaggttaggtttaacgtttaaccggtttggttttacccggtttttgggttaccgtttacgggtaccggtttaccggggttaaccgggggtaaactttacccgttacggtaacggtaccggtaccgggtacgggggtacccgtaaccgggg

SEQ ID NO: 327577 - DNA, 580 bp, Homo sapiens
  misc_feature: GZ8MTXP02F526U.10.53.E09.1.454.CMB.2.raw
  modified_base (249)..(249): a, c, t, g, unknown or other
  misc_feature (249)..(249): n is a, c, g, or t
  modified_base (378)..(378): a, c, t, g, unknown or other
  misc_feature (378)..(378): n is a, c, g, or t
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtggagtcgtgggggagcgtggtccagccgtgggagtccctnagactctcctgtttagcctctggattcacttcagtagttatcctttgcacgtgggtccgtcaggcctccgagggcgaagggggctggggaggttggggtggctagtttatccgtctagtttgatggaanaacaataaatactacagagtacttccgggttcggggccgtacttcaccatctaccaaagactaaatttagaagaacacgcttagtttctagacaaatagaaacacgcctagagagctaggacgacgacggctggtagttacttacgttgtttcgtttggttcgtgtacgtcggtacggggtaacttaccgttacgacgtacg

SEQ ID NO: 327578 - DNA, 694 bp, Homo sapiens
  misc_feature: GZ8MTXP02I9WKB.10.53.E09.1.454.CMB.2.raw
  modified_base (238)..(238): a, c, t, g, unknown or other
  misc_feature (238)..(238): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggagcgtggtccagcctgggacgtccctnagctctcctgttagcctctggattcaccttcagttagttactcctttgcctacgtcgggtcctcaggcctccgaggccgaaggggcctggggagtggggtggctagttactctctagtttgagttaggagaactaaattaaactactaacagaacgtaccgtcccgggttaccgggggacctaacttccaacccaacttaccctaaccgtaaaacgtaaactaaatttaagaaacgaaccgtaaccgtacgttacgtttactagtaacaaaattacggaaacacgtacccgtaggaagtaacgcgtaacggacggaaccgtacggtacgtacgttagtttaacgtttacgttggtttaccggttttggttacgttacggtaaccgttccggggtacgggggttaacttaccgttacgtacggtaccgtacgggttaccggggaccggtaaccgggg

SEQ ID NO: 327579 - DNA, 629 bp, Homo sapiens
  misc_feature: GZ8MTXP02GLF3X.10.53.E09.1.454.CMB.2.raw
  modified_base (323)..(323): a, c, t, g, unknown or other
  misc_feature (323)..(323): n is a, c, g, or t
tcagcatagtagtgcacgaccggtgctcgatttagagagagtgtgttgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcactgggtccgtcaggctccaggcaaggggctggagtgggtgcagttatctcatttgatggagacaataaatactacagagactcgtcgggcattcaccatctaccaaagactaatttgaagaacacgctgtttcngacaaatgaaacagcctagagacgctgaggacacggctgtgtaattacgttgtttcgtttggttctaggtacgttcgggtacgggggtaaacttaccgttacgacgtcgacgtcgggggaccgacggggtccacccgttggtaccgtaccgttcctccctcgacgccctacccgaccgaacgggccctacgtcccggtcccttcccccgtcggccctaccccgtccctaccaaacggaccgtccgacccgtcggtacgggggccaaccggacggcccggcccgtcgggcctcggtcccgttacggg

SEQ ID NO: 327580 - DNA, 624 bp, Homo sapiens
  misc_feature: GZ8MTXP02IH3JT.10.53.E09.1.454.CMB.2.raw
  modified_base (239)..(239): a, c, t, g, unknown or other
  misc_feature (239)..(239): n is a, c, g, or t
  modified_base (343)..(343): a, c, t, g, unknown or other
  misc_feature (343)..(343): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctgggtggagtcgtgggggagcgtggtccagcctgggacgtccctnagctctcctgttagcctctggattcaccttcagttagttatcctttgctacgtgggtccctcaggctccgaggcaaggggctggaggtgggtgctagttatctnatttgatgagacaaataaactactacaggacgtaaccttcccgggttccgggggaccctagtttccaaacctatacctacccaaaagactaaatttagaaagaacctacgcttgttacctagaacaaattacgaaacacgtaccctagaacgacgcgtaggacgggaacgacggtctacggttagttacgtttagttcggtttcgttttggttcgttcgtaacgttccggtacgggggtaacttaccgttacgtacgacgtaccggtcgggaccgaccggg

SEQ ID NO: 327581 - DNA, 582 bp, Homo sapiens
  misc_feature: GZ8MTXP02FM9Q9.10.53.E09.1.454.CMB.2.raw
  modified_base (243)..(243): a, c, t, g, unknown or other
  misc_feature (243)..(243): n is a, c, g, or t
  modified_base (257)..(257): a, c, t, g, unknown or other
  misc_feature (257)..(257): n is a, c, g, or t
  modified_base (260)..(260): a, c, t, g, unknown or other
  misc_feature (260)..(260): n is a, c, g, or t
  modified_base (263)..(263): a, c, t, g, unknown or other
  misc_feature (263)..(263): n is a, c, g, or t
  modified_base (269)..(269): a, c, t, g, unknown or other
  misc_feature (269)..(269): n is a, c, g, or t
  modified_base (291)..(291): a, c, t, g, unknown or other
  misc_feature (291)..(291): n is a, c, g, or t
  modified_base (345)..(345): a, c, t, g, unknown or other
  misc_feature (345)..(345): n is a, c, g, or t
tcagcatagtagtgcacgaccggtgctcgatttagagagagtgtgttgggtttggggctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggagcgtggtccagccgtgggagtccctnagactctctgttanctntgntcactnagtatatcttgcactggtcctnagctccgaggcgaggggctggagtgggtggctagttatctctatttgatggaanaactaaataaatctacgagacgtaccgttccgggttacggggacctattaccaccactacctaaccaaagaactaagttacgaaacgaaacacgtacttgtttactagaactaaacgtacgaacacgtacctagagagacgtaggaacggacgacggctgttagttattacgttgtttcgtttcggttacgtgtaccgtcggtacggggtaacttaccgtacgacgcgacgtcgggg

SEQ ID NO: 327582 - DNA, 582 bp, Homo sapiens
  misc_feature: GZ8MTXP02G4NWV.10.53.E09.1.454.CMB.2.raw
  modified_base (249)..(249): a, c, t, g, unknown or other
  misc_feature (249)..(249): n is a, c, g, or t
  modified_base (352)..(352): a, c, t, g, unknown or other
  misc_feature (352)..(352): n is a, c, g, or t
  modified_base (356)..(356): a, c, t, g, unknown or other
  misc_feature (356)..(356): n is a, c, g, or t
  modified_base (366)..(366): a, c, t, g, unknown or other
  misc_feature (366)..(366): n is a, c, g, or t
  modified_base (373)..(373): a, c, t, g, unknown or other
  misc_feature (373)..(373): n is a, c, g, or t
  modified_base (425)..(425): a, c, t, g, unknown or other
  misc_feature (425)..(425): n is a, c, g, or t
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtggagtcgtgggggagcgtggtccagccgtgggagtccctnagactctcctgttacgcctctggattcaccttcagttagttatcctttgcacgtcgggtccgtcaggcctccgaggcgaaggggctggagtgggtgcagttancctnattgatgganacataanactacgagagtactccggtcgggcattcacatcaccaagtactaattagaanacacgtacttgttactagtactaaagtagaaacacgacctagagacgacgtaggaacggacgtacggtacgtggttacgttagttacgttcggtttcgtttggttacgtcggtacgttcgggttacgggggtaacttaccggttacgacggtaccgg

SEQ ID NO: 327583 - DNA, 711 bp, Homo sapiens
  misc_feature: GZ8MTXP02FLPPH.10.53.E09.1.454.CMB.2.raw
  modified_base (249)..(249): a, c, t, g, unknown or other
  misc_feature (249)..(249): n is a, c, g, or t
  modified_base (269)..(269): a, c, t, g, unknown or other
  misc_feature (269)..(269): n is a, c, g, or t
  modified_base (355)..(355): a, c, t, g, unknown or other
  misc_feature (355)..(355): n is a, c, g, or t
  modified_base (367)..(367): a, c, t, g, unknown or other
  misc_feature (367)..(367): n is a, c, g, or t
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtggagtcgtgggggagcgtggtccagccgtgggagtccctnagactctcctgttacgcctntggattcaccttcagtagttatcctttgcacgtgggtcctcaggctccgaggcgaaggggctgggagtgggtagctagttatcctntattgatggaanactaataaactactaacgagacgtaccgttccgggttacggggacccgtacgttaccaaccctaactacccttaacccgaaaacgtaacctaaaacgtttaacgaaaacgtaaaacccgtaaccggttaccgtttacgtttaccgttacggaaacctaaaagttaacggaaacctaacgtacccggtaggaacggtaagaccgtagggaacggtaaccgaacggtcgttaggttacgtttaaacgtttacgtttcggttttacggttttcggtttaccgtaacggttacccggttaccggggttaaccgggggtaaacctttacccgttaccgtacggtacccg

SEQ ID NO: 327584 - DNA, 672 bp, Homo sapiens
  misc_feature: GZ8MTXP02FSMFW.10.53.E09.1.454.CMB.2.raw
  modified_base (238)..(238): a, c, t, g, unknown or other
  misc_feature (238)..(238): n is a, c, g, or t
  modified_base (269)..(269): a, c, t, g, unknown or other
  misc_feature (269)..(269): n is a, c, g, or t
  modified_base (345)..(345): a, c, t, g, unknown or other
  misc_feature (345)..(345): n is a, c, g, or t
  modified_base (348)..(348): a, c, t, g, unknown or other
  misc_feature (348)..(348): n is a, c, g, or t
  modified_base (363)..(363): a, c, t, g, unknown or other
  misc_feature (363)..(363): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggagcgtggtccagccgtgggagtccctnagactctcctgttagcctctggattcacttnagtagttatcctttgctacgtgggtccctcgaggcctccgagggcgaaggggtctgggaggtggggtgctagttanctnagtttgagttggaanaactaaataaactacacaggactaccgtccgggttaccgggggcctaattccgaactacgtacctaaccgaaaataaaccgtaaagtttacgaaaacgaacgtaacgtacttcgtttacgagtaacctaaagtacgaaaactacgacctacggaagacggacggacggaaccgacggtactaggtagttaacgtttaacggttcgttttacggtttcggttacgttacgtaccggttaccggttacgggggttaaacttaaccgtttacgacggtacccgtacgggtacggggccgtaacgggtccccg

SEQ ID NO: 327585 - DNA, 759 bp, Homo sapiens
  misc_feature: GZ8MTXP02G4ZL0.10.53.E09.1.454.CMB.2.raw
  modified_base (239)..(239): a, c, t, g, unknown or other
  misc_feature (239)..(239): n is a, c, g, or t
  modified_base (258)..(258): a, c, t, g, unknown or other
  misc_feature (258)..(258): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggagcgtggtccagccgtgggacgtccctnagactctcctgttagcctntggattccaccttcagttacgttactcctttgcctacgttcgggtcccgtgacggtcctaccgagggtaccgaaagggggtcctggggtaggttggggtacggtacctaaggtttatccgttactagttttggaacgttagggaaacgtaaactaaaattaaaacgtaccttaaacgaggtaacgtaaccgttcccggggttacgggggacccgtaatttacccgaaaccctaactaccctaaacccgaaaacgtaaacctaaagtttaaacgaaaacgtaaaccgtaccgtacctttacggtttaccgtacgtaaacctaaaagttacggaaaccgtacgtacccgtagggaaagaacgtacgtaacgggaacggaaccgaacggtcgtaggttacgttaacgtttacgtttcggttttacggtttcggtttacgtacgtaccggttcgggtacggggtaacttacgttacgacgtaccgtacggtcggggacgaccggg

SEQ ID NO: 327586 - DNA, 668 bp, Homo sapiens
  misc_feature: GZ8MTXP02JLB8K.10.53.E09.1.454.CMB.2.raw
  modified_base (242)..(242): a, c, t, g, unknown or other
  misc_feature (242)..(242): n is a, c, g, or t
  modified_base (262)..(262): a, c, t, g, unknown or other
  misc_feature (262)..(262): n is a, c, g, or t
  modified_base (339)..(339): a, c, t, g, unknown or other
  misc_feature (339)..(339): n is a, c, g, or t
tcagcatagtagtgcacgaccggtgctcgatttagagagagtgtgttgggtttgggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggagcgtggtccaggccgtgggacggtccctnagactctcctgttacgcctntggacttcaccttcagttagttactcctttgctacgtgggtcctcaggcctcgaggcgaaggggctgggagtggggngctagttatctatagtttgagtggaagaactaaataaatactaagaggacgtacgttccggggttccgggggacctacttaccgaacctactaccctaaacctaaaacgtacttaaagtttaagaaaacgtaaccgtaacgtcctttagtttaccgtagtaaacctaaagttacgaaactacggacctaggaagacgtccgtaggacggaacgacggtctaggttagttacgtttacgtttcggtttcgtttggttcgtacggttaccggttacgggtacggggtaaacttaccgtacgtacggacgtacggtcggggaccgtaccggg

SEQ ID NO: 327587 - DNA, 607 bp, Homo sapiens
  misc_feature: GZ8MTXP02ID2UT.10.53.E09.1.454.CMB.2.raw
  modified_base (238)..(238): a, c, t, g, unknown or other
  misc_feature (238)..(238): n is a, c, g, or t
  modified_base (345)..(345): a, c, t, g, unknown or other
  misc_feature (345)..(345): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctgggtggagtcgtgggggagcgtggtccagcctgggagtccctnagctctcctgtttagcctctggattcaccttcagtagttatccttttgctactggggtcccgtcagggctccaggcaaggggctgggagtggggtggcagttatctntatttgatggataacaaataaatactacagagtactccggttcgggggccctattccaccactctaccaaagactaaattgaaagaacaacgctgtttctgacaaatgaactagcctagacgagcgtggaggtaccacggctggtagttaacgtttacgttggtttcgtttttgggttacgttcggtaccgtttaccgggtacgggggtaaacttacccgtttacacggtacgtaaccggttcgggggcccgtaaccggggg

SEQ ID NO: 327588 - DNA, 752 bp, Homo sapiens
  misc_feature: GZ8MTXP02JR7UO.10.53.E09.1.454.CMB.2.raw
  modified_base (250)..(250): a, c, t, g, unknown or other
  misc_feature (250)..(250): n is a, c, g, or t
  modified_base (269)..(269): a, c, t, g, unknown or other
  misc_feature (269)..(269): n is a, c, g, or t
  modified_base (403)..(403): a, c, t, g, unknown or other
  misc_feature (403)..(403): n is a, c, g, or t
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtggagtcgtgggggagcgtggtccagcctggggacgtccctnagctctcctgttacgcctntgacttcaccttcagttacgttactcctttgcctacgtgggtccgtcaggcctaccgagggtccgaaaggggtctggggaggtggggtggtctaacggtttatccctacgtaagttttggaagttacggggaanaactaaattaaaacgtacttaaaccgaagaacgtacccgttcccggggttcgggggtacccgtaacgttacccaaccctaacgttaccctaacccgtaaaaaggtaacctaaaagtttaacggaaaacgtaaaccgtaaccgttacgtttacgtttaacgtacgtaaccgtaaaagttacggaaaaccgtaacggtaccgttaggaacggaacggtaccgtagggaacggaaccgtaccgggtacgttaggttacgttaacgtttaccgtttggttttacggtttcggtttcgtaacggttaccgttacggggttacgggggtaacctttaccggttacgtacgtccgg

SEQ ID NO: 327589 - DNA, 711 bp, Homo sapiens
  misc_feature: GZ8MTXP02JT6CT.10.53.E09.1.454.CMB.2.raw
  modified_base (248)..(248): a, c, t, g, unknown or other
  misc_feature (248)..(248): n is a, c, g, or t
  modified_base (267)..(267): a, c, t, g, unknown or other
  misc_feature (267)..(267): n is a, c, g, or t
  modified_base (366)..(366): a, c, t, g, unknown or other
  misc_feature (366)..(366): n is a, c, g, or t
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggagcgtggtccagccgtgggacgtccctnagactctcctgttagcctntgattcacttcagtattatcctttgctacgtgggtcctcagactccgaggcgaaggggctggaggtgggtgctagttactccgtctatttgattggaanaactaagttaaaatacctacgaagacgtaccgttccgggttcggggacccgtacgttaccacctacgttacctaacccgaaagtaacctaaagtttaagaaaacgtaaccacgtacgtttacgtttacgtacgaactaaacttacggaaaccaacgacccgttaggaacggtacggaccgttaagggaacgggaacccgtaccggggtactttacgggttaggtttaaaccgttttacgtttcgggtttttaccggtttttacggtttaccggttaacggttacccggtttaccgggggttaccgggggtaaacctttaacccgtttccgtaacggttaacccgg

SEQ ID NO: 327590 - DNA, 651 bp, Homo sapiens
  misc_feature: GZ8MTXP02H5N3H.10.53.E09.1.454.CMB.2.raw
  modified_base (240)..(240): a, c, t, g, unknown or other
  misc_feature (240)..(240): n is a, c, g, or t
tcagcatagtagtgcacgaccggtgctcgatttagagagagtgtgttgggtttgggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggagcgtggtccagcctgggacggtccctnagactctcctgttagcctctggattcaccttcagttagttattcctttgctacgtgggtccgtcgaggctccgaggcaaggggctggaggtgggtgctaggttatctctagttgagtggaagaacaaaagtaaacttacctaacgagtacggtaccttcccggggttccgggggacccctaattccaaccctatacctaccaaagaactaatttaagaaacgaactacgtcttacgttactcgtaacaaacttagaaacacgacctaggagacgcgtaggacggacgaacggtctagttagttactttacgttggtttcggttttcggttacgttcggtaacgttccgggttaccgggggtaaacttacccgtttacgacgtaccgtaacggtcggggaccgtacccgggg

SEQ ID NO: 327591 - DNA, 768 bp, Homo sapiens
  misc_feature: GZ8MTXP02IVP7K.10.53.E09.1.454.CMB.2.raw
  modified_base (250)..(250): a, c, t, g, unknown or other
  misc_feature (250)..(250): n is a, c, g, or t
  modified_base (270)..(270): a, c, t, g, unknown or other
  misc_feature (270)..(270): n is a, c, g, or t
  modified_base (382)..(382): a, c, t, g, unknown or other
  misc_feature (382)..(382): n is a, c, g, or t
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagcttgggttttcctcgttgctcttttaagaggttgtccagtgtcaggtgcagctggtggagtcgtgggggagcgtggtccagccgtgggacgtccctnagactctcctgttacgcctntggattcacttcagtagtttactcctttgcctacgttcgggtccgttcaggcctaccgaggcgaaggggtctgggagtggggtggctagttatcctctatttgagttggaanaactaagtaaactactaacaagacgtaaccgttccgggtcggggtaccgtacttaccaaccctatacccttaacccaaaaagtaaccgtaaaagttttaacgaaaacgtaaaccgacgtaccgtttacggttttacctaggtaaacctaaaacgttacggaaaaccctaaccggtacccgtaacggtaaggaacggtaaccgttagggaaacgggaaaccggtaaaaccggggtcccgtttaacgggttacggttttaaacgtttaaccggttttcgggtttttaacccgggtttttggggttttaccgttaacgggttacccggtttacgggggttaaccgggggttaaaacctttaccccggtttaccgtaacggtaaccccgg

SEQ ID NO: 327592 - DNA, 594 bp, Homo sapiens
  misc_feature: GZ8MTXP02F1RJR.10.53.E09.1.454.CMB.2.raw
  modified_base (250)..(250): a, c, t, g, unknown or other
  misc_feature (250)..(250): n is a, c, g, or t
  modified_base (357)..(357): a, c, t, g, unknown or other
  misc_feature (357)..(357): n is a, c, g, or t
  modified_base (361)..(361): a, c, t, g, unknown or other
  misc_feature (361)..(361): n is a, c, g, or t
  modified_base (373)..(373): a, c, t, g, unknown or other
  misc_feature (373)..(373): n is a, c, g, or t
  modified_base (386)..(386): a, c, t, g, unknown or other
  misc_feature (386)..(386): n is a, c, g, or t
  modified_base (432)..(432): a, c, t, g, unknown or other
  misc_feature (432)..(432): n is a, c, g, or t
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggagcgtggtccaggccgtgggacggtccctnagactctcctgttacgcctctggacttcaccttcagttattactccgtttgctacgtggtccgtcaggctaccgaggcgaaggggctgggaggtgggtgctagttancctntatttgatgganacataactactanagagacgtccggtcgggactatcacatcacaaagactaattagaanacacgtcttagttcagtacaaatacgaaacacgacctagagagcgtaggagaacgacggtctagttacgttaacgttttacgtttcgttttacggtttcggtttacgtaacggttaccgttacggggttaacggggtaactttaccgttacgacggtacccg

SEQ ID NO: 327593 - DNA, 695 bp, Homo sapiens
  misc_feature: GZ8MTXP02JUPRL.10.53.E09.1.454.CMB.2.raw
  modified_base (241)..(241): a, c, t, g, unknown or other
  misc_feature (241)..(241): n is a, c, g, or t
  modified_base (256)..(256): a, c, t, g, unknown or other
  misc_feature (256)..(256): n is a, c, g, or t
  modified_base (260)..(260): a, c, t, g, unknown or other
  misc_feature (260)..(260): n is a, c, g, or t
  modified_base (344)..(344): a, c, t, g, unknown or other
  misc_feature (344)..(344): n is a, c, g, or t
  modified_base (348)..(348): a, c, t, g, unknown or other
  misc_feature (348)..(348): n is a, c, g, or t
  modified_base (362)..(362): a, c, t, g, unknown or other
  misc_feature (362)..(362): n is a, c, g, or t
  modified_base (380)..(380): a, c, t, g, unknown or other
  misc_feature (380)..(380): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtggagtcgtgggggagcgtggtccagccgtgggacgtccctnagctctcctgttacncctntggacttcaccttcagttagttactcctttgctacgtgggtcctcaggctccgaggtcgaaggggctgggagtgggtgcagttntctntagtttgagtgganaactaaataaatacctanagacgtacgttcccgggttacgggggcctaatttcccaaacctactaccgtaaccaaaacgtactaaagtttaacgaaacgaacctaacgaccgtttagtttaccgtagtaaaccgtaaaagttacgaaaccgacggtaccgtaggaaggaacgtccgtaagggacgggaaccgtaacgggtccttgggttaactttacgtttaacggttggtttacggttttacgggtacccgttaggtacccgttacggggtaccgggggtaaacttacccgttacgacggtaccgacggttaacggggcccgtaacccgggg

SEQ ID NO: 327594 - DNA, 757 bp, Homo sapiens
  misc_feature: GZ8MTXP02ISREW.10.53.E09.1.454.CMB.2.raw
  modified_base (246)..(246): a, c, t, g, unknown or other
  misc_feature (246)..(246): n is a, c, g, or t
  modified_base (402)..(402): a, c, t, g, unknown or other
  misc_feature (402)..(402): n is a, c, g, or t
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagcgtggtttcgtcgttgctctttaagaggtgtccagtgtcaggtgcagctggtggagtcgtgggggagcgtggtccagccgtgggagtcccctnagactctcctgtttacgcctctggacttcacttcagtagtactccttgctacgtggggcctcaggctaccgaggtcgaaggggctgggtaggtggggtcggctaggtttactccctgtagtttgagtcggaagactaaagtaaactactaaaccgngaacgtaccgttccggggttcgggggaccctattacccgaactactaccgttaacccaaaaagacctaaaagtttacggaaaacaaaccgtacggtactttacgggtttaacgtcgaaaacctaaaagttacggaaaaccctaccggttaccgtaaggtaaacggggacggtaccggtaaacggggtacgggaaaccggttaccgggttacgttaggtttaacggtttacgtttaacgggtttcgggtttttcgggttttacgggtttaccgttaaccggggtttaacccgggtttaaccgggggttaaaccggggttaaacccgtttacccggttaacgtaaccggggtaccgg

SEQ ID NO: 327595 - DNA, 783 bp, Homo sapiens
  misc_feature: GZ8MTXP02H817C.10.53.E09.1.454.CMB.2.raw
  modified_base (246)..(246): a, c, t, g, unknown or other
  misc_feature (246)..(246): n is a, c, g, or t
tcagcatagtagtgcacgaccggtgctcgatttagagagagtgtgttgggtttggggctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctgggtggagtcgtgggggagcgtggtccagccgtgggacgtcccnagacttctcctgttacgctcgtggattccaccttcagttacgtttactccctttgctacgttcgggtcccgtcgacgggtcctaccgaggacggaagggggtctggggacgggttggggtggctaacggtttactcttacgtagtttaggagtagggaaacgtaaactaaaattaaaacttaccgtaacgtaaaggtaaccggttacccgttacccggggtttcccgggggaacccttaacttaccccaaacccgtaacttacccgtaaaccgtaaaacggtaaactttaaaacgtttaacggaaaaccgttaaacccgtaaccggttcgtttacgtttaccgtaacggtaaacctaaaacgttacgaaacgtacggtacccgtaaggaagacggacgtacggaacggacgacggtcgttagtcgtttaacgtttcgtttacggtttcggttttacggtcgttacggtaccggttaacggggttaaccggggtaactttacccgttaacgtaccggtaccggtaaccgggtccgggg

SEQ ID NO: 327596 - DNA, 838 bp, Homo sapiens
  misc_feature: GZ8MTXP02F4D9U.10.53.E09.1.454.CMB.2.raw
tcagcatagtagtgcacgaccggtgctcgatttagagagagtgtgttgggttttcctcgttgctcttttaagaggtgtccagtgtcaggtgcagctggtggagtctggggggaggcgtggtccagcctgggaggtccctcagactctcctgtttagcctctggattcaccttcagtagttatcctttgcacgtgggtccgtcaggctccgaggcaaggggctgggagtgggtggcagttatctcatttgatggagacaataatactacagagactccgtcgggcgatcaccatctaccaaagacaatttagaaagaacacgcttgtttctgactaaaatggaaaccagacctaggagaacgcgtaggaaggaaccgacggtacgttggttgttaagttacgtttggtttccggttttggtttactcggtaacgttccggggttaccgggggtaaaacttacccgttacgacggtccgtaacggtcgggggtacccgacggggtacccgaccccgttcgggtacccgtacccggttcccgttaccccgttaccgaccggtaccccgttacccccgaaaccccggaaaccgggggtacccccctaaccgggttccccgggtttacccccgtttacccccccgggtttcccggggaccccccgttaaccccccgttacccccttaacccccgtaaaaccgggtaccgacccccggttaaacccggttaccccggttcccgggggggtaacccctaaccccgggaacccggggaccccgggggttaccccccgggtccgggggtacccggttacccgggtcccccgggtttaaacccggggg

SEQ ID NO: 327597 - DNA, 711 bp, Homo sapiens
  misc_feature: GZ8MTXP02FKECC.10.53.E09.1.454.CMB.2.raw
  modified_base (247)..(247): a, c, t, g, unknown or other
  misc_feature (247)..(247): n is a, c, g, or t
  modified_base (369)..(369): a, c, t, g, unknown or other
  misc_feature (369)..(369): n is a, c, g, or t
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggagcgtggtccaggcctgggagtccctnagctctctgttagcctctggatcaccttcagtagttactcctttgcacgttgggtccgtcaggcctccgagggcgaaggggctggggaggtgggcggctagttatcctctatttgatggaanaactaataaatactacgaagtacgtaccgtccgggttacggggaccgtacgttaccaaccctaactacctaacccgtaaaaacgtaaccttaaaagtttaacggaaaacgtaaaaccgtaaccgtaccgtttacggtttaccttacggtaacctaaaaagttacggaaaaccgacgtacccgttaaggaacggaacggaccgttagggaacgggaaaccgtaaccgggtcgttaggttacgtttaacgtttaacgtttacggttttaccggtttcggtttacgttaacggtaccgttaccggggttacgggggtaactttacccggtttacgacggtaccgg

SEQ ID NO: 327598 - DNA, 690 bp, Homo sapiens
  misc_feature: GZ8MTXP02G6202.10.53.E09.1.454.CMB.2.raw
  modified_base (253)..(253): a, c, t, g, unknown or other
  misc_feature (253)..(253): n is a, c, g, or t
  modified_base (411)..(411): a, c, t, g, unknown or other
  misc_feature (411)..(411): n is a, c, g, or t
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtggagtcgtgggggagcgtggtccaggccgtggggacgtccctanagtactctccttgtttacgccttcgtggtacttccacctttcaagttacgtttactccctttggcctacgtcggggtcctcgacggcctaccgaggcggaaggggtctaggggaggtggggtcgactaggtttactccgttactagtttgagtggaanaacctaagttaaactactaacgaagaaccgtaccgttccggggttccgggggacctacttaccaaccctaattaccctaaaccgaaaagtactaaacgtttaacgaaaacgaaaccgtaacgtcgttacgtttacacggtaactaaagtacggaaactacggaccgtagacggaagcggtagaacggacgtaacggtcgttagttagttaactttcgttagtttcgtttgttacgtcgtacggttcgggtaacggggtacttaccgtacgtaacgccgg

SEQ ID NO: 327599 - DNA, 706 bp, Homo sapiens
  misc_feature: GZ8MTXP02JQA08.10.53.E09.1.454.CMB.2.raw
  modified_base (262)..(262): a, c, t, g, unknown or other
  misc_feature (262)..(262): n is a, c, g, or t
tcagcatagtagtgcacgaccggtgctcgatttagagagagtgtgttgggtttggggctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagcgtggtggagtcgtgggggagcgtggtccagccgtgggacgtccctcagctctcctgttacncctcgtggattccaccttcagttagtttactccgtttagcctacgttcgggtcctcagggccctccggaggaccggaagggggctaggggacgggttggggtcggactaagtttactcgttacttaagtttggaagttagggaaagaaactaaaaagttaaaactacctaaacgaagtacggtaacccgttcccgggttacgggggacccttaaacgttaccctaaccctaacttacccgtaaacccgtaaaaacggtaaaccttaaagtttaacgaaaaacggtaaaccctaaccggtacgtttacgtttacctaacggtaacctaaaagtacgaaacgacgtacctagagacgcgtaggagaacgacgcgttagtacgttattacgttgtttcgttcgttctagtacgtcggtacggggtactacgtcacgcgacgtacggg

SEQ ID NO: 327600 - DNA, 557 bp, Homo sapiens
  misc_feature: GZ8MTXP02IOVAJ.10.53.E09.1.454.CMB.2.raw
  modified_base (242)..(242): a, c, t, g, unknown or other
  misc_feature (242)..(242): n is a, c, g, or t
  modified_base (273)..(273): a, c, t, g, unknown or other
  misc_feature (273)..(273): n is a, c, g, or t
  modified_base (303)..(303): a, c, t, g, unknown or other
  misc_feature (303)..(303): n is a, c, g, or t
  modified_base (333)..(333): a, c, t, g, unknown or other
  misc_feature (333)..(333): n is a, c, g, or t
tcagcatagtagtgcacgaccggtgctcgatttagagagagtgtgttgggtttggggagctacaacaggcaggcaggggcagcaagatggtgttgcagacccaggtcttcatttctctgttgctctggatctctggtgcctacggggacatcgtgatgacccagtctccagactccctgcctgtgtctctgggcgagaggccaccatcaactgcaagtccagcagagtgttatcagctcganaataagactactagctgtacagcagaaaccnggacagcctctaagctagctcaatttacgnggactatcgtaaaccggatccccgggtccngaccattcgagtgcgagcggtacgaggacagtattcactctacacgatcagacacgcgtcgacgacgacgtagaaagagtagtacgacgtagttaacttacgtacgtacacgtacgtaactaataactaacgtaaccgtactactaactaacgttacggtaccgtacggtaaccgaaaacgtaacgtaacgaacgtaacgtaaaacgtaaacgtacgtacgtcg

SEQ ID NO: 327601 - DNA, 623 bp, Homo sapiens
  misc_feature: GZ8MTXP02I0TNU.10.53.E09.1.454.CMB.2.raw
  modified_base (303)..(303): a, c, t, g, unknown or other
  misc_feature (303)..(303): n is a, c, g, or t
  modified_base (346)..(346): a, c, t, g, unknown or other
  misc_feature (346)..(346): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctgggtggagtcgtgggggaggcgtggtccagcctggggaggtccctcagactctcctgtttagcctctggattcaccttcagttattatcctttgctactggggtcctnaggctccgaggcaaggggctgggagtgggtggcagtttatctntagtttgagtggaagaactaaaattaaaactacctaacaggtacgtaccgttcccgggttaccgggggcccgtaatttccacctactctaccaaaagaactaaatttagaaagaactacgtacttacgttactagtacaaaatacgaaacagacctaggaagacgacgtaggaggacgacggacgtgtagtattacgttgtttcggtttggttcgtcgtacgttcggtacgggggtaacttacgttacgtacgtacgtacgtcggggaccgtacggg

SEQ ID NO: 327602 - DNA, 658 bp, Homo sapiens
  misc_feature: GZ8MTXP02IHCGF.10.53.E09.1.454.CMB.2.raw
  modified_base (242)..(242): a, c, t, g, unknown or other
  misc_feature (242)..(242): n is a, c, g, or t
  modified_base (282)..(282): a, c, t, g, unknown or other
  misc_feature (282)..(282): n is a, c, g, or t
  modified_base (334)..(334): a, c, t, g, unknown or other
  misc_feature (334)..(334): n is a, c, g, or t
  modified_base (358)..(358): a, c, t, g, unknown or other
  misc_feature (358)..(358): n is a, c, g, or t
tcagcatagtagtgcacgaccggtgctcgatttagagagagtgtgttgggtttgggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctgggtggagtcgtgggggaggcgtggtccagccgtgggacgtccctnagactctccttgttagcctctggattcacttcagttattntcctttgcacgtgggtcctcaggctccgaggcgaaggggctgggagtggggnggcagttatctctatttgatgganacaaataatactacagacgtacccgttccgggttccgggggccctaatttccaacctactcctacccaaaagtaactaaatttagaaacgaacctaacgtcttacgtttactagaactaaagtacgaaacgacgtaccgtaggagacgcgtacggaacgggaacgacgggtcgttacggtagtttaacgtttaccgtttgggttttcggtttttcgggttccgttcggtaaccggtttccggggtacgggggtaactttaccgttacgacgccgtaaccggttcggggacccgtacgggg

SEQ ID NO: 327603 - DNA, 582 bp, Homo sapiens
  misc_feature: GZ8MTXP02JU56E.10.53.E09.1.454.CMB.2.raw
  modified_base (320)..(320): a, c, t, g, unknown or other
  misc_feature (320)..(320): n is a, c, g, or t
tcagcatagtagtgcacgaccggtgctcgatttagagagagtgtgttgggtttgggggagctacaacaggcaggcaggggcagcaagatggtgttgcagacccaggtcttcatttctctgttgctctggatctctggtgccgtacggggacatcgtgatgacccagtctccagactccctgcctgtgtctctgggcgagacgggccaccatcaactgcaagtccagccagagttgtttatcagctccgacaataagaactactagcttaggtaccagacaagaaaccaggacagccctactaagctgctactatttacgngggcacgtccgtacccgggaagtccccccggggtccctggaccctattcaggtcggcgacgggcggggttccgtaggggactaggtactttccgacttcctccaaccatccagcacgccctgcgaggctaggaagacgtcggcggtacttaaggtttatacgtgtacacgtctaacttattactacgttaccccattaccactacgtaccggccgtacgggaaccaaaggtcgaagtaacaccgaaaacgacgtgacgtacg

SEQ ID NO: 327604 - DNA, 587 bp, Homo sapiens
  misc_feature: GZ8MTXP02G9G0I.10.53.E09.1.454.CMB.2.raw
  modified_base (248)..(248): a, c, t, g, unknown or other
  misc_feature (248)..(248): n is a, c, g, or t
  modified_base (267)..(267): a, c, t, g, unknown or other
  misc_feature (267)..(267): n is a, c, g, or t
  modified_base (338)..(338): a, c, t, g, unknown or other
  misc_feature (338)..(338): n is a, c, g, or t
  modified_base (347)..(347): a, c, t, g, unknown or other
  misc_feature (347)..(347): n is a, c, g, or t
  modified_base (350)..(350): a, c, t, g, unknown or other
  misc_feature (350)..(350): n is a, c, g, or t
  modified_base (360)..(360): a, c, t, g, unknown or other
  misc_feature (360)..(360): n is a, c, g, or t
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagctgggttttcctcgttgcttcttttaagaggtgtccagtgtcaggtgcagctggtggagtcgtgggggagcgtggtccagccgtgggagtccctnagactctcctgttagcctntgattcacttcagtattactccttgctagtcgggtcctcaggcctccgaggcgaaggggctgggagtgggngctagttanctnattgatgganaacataaatactacagacgtacgtccggtacgggccgatcacatctacaaagactaattagaaagaacacgtacttgttactagactaaatagaaacacgacctaggacgacgcgtagacggacgaacggtcgtaggtacgttagtttacgttcgtttacggtttcggttcgttaacggtacggttacggggtacgggggtaaacttacccgttacgtaacgtccgg

SEQ ID NO: 327605 - DNA, 556 bp, Homo sapiens
  misc_feature: GZ8MTXP02FNZ9V.10.53.E09.1.454.CMB.2.raw
  modified_base (238)..(238): a, c, t, g, unknown or other
  misc_feature (238)..(238): n is a, c, g, or t
  modified_base (297)..(297): a, c, t, g, unknown or other
  misc_feature (297)..(297): n is a, c, g, or t
  modified_base (336)..(336): a, c, t, g, unknown or other
  misc_feature (336)..(336): n is a, c, g, or t
  modified_base (347)..(347): a, c, t, g, unknown or other
  misc_feature (347)..(347): n is a, c, g, or t
  modified_base (361)..(361): a, c, t, g, unknown or other
  misc_feature (361)..(361): n is a, c, g, or t
  modified_base (364)..(364): a, c, t, g, unknown or other
  misc_feature (364)..(364): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggagcgtggtccagcctgggaggtccctnagactctcctgttagcctctggattcaccttcagtagttatcctttgcactgggtcctnaggctccaggcaaggggctggagtgggtgcagttatctnatttgatgganacaataaatactanganacgtcgttggggccattcacatctacaaagacaattagaagaacacgtactcgttctagacaaatacgaacagcctagagagacgtagagacgacggctgtagtacttacgttgttacgtttggttcttcgtacgttcggtacgggggtaacttaccgttacgtacgtaccgacggtcggggaccgtacggg

SEQ ID NO: 327606 - DNA, 603 bp, Homo sapiens
  misc_feature: GZ8MTXP02IPEXY.10.53.E09.1.454.CMB.2.raw
  modified_base (155)..(155): a, c, t, g, unknown or other
  misc_feature (155)..(155): n is a, c, g, or t
  modified_base (255)..(255): a, c, t, g, unknown or other
  misc_feature (255)..(255): n is a, c, g, or t
  modified_base (351)..(351): a, c, t, g, unknown or other
  misc_feature (351)..(351): n is a, c, g, or t
  modified_base (415)..(415): a, c, t, g, unknown or other
  misc_feature (415)..(415): n is a, c, g, or t
  modified_base (434)..(434): a, c, t, g, unknown or other
  misc_feature (434)..(434): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagcgtggtttccncgttagctctttaagaggtgtccagtgtcaggtgcagctggtggagtcgtgggggagcgtggtccagcctggggagtccctcagactctctgttagcctntggatcaccttcagtagttatcctttgctacgtgggtccctcgaggctccgaggcaaggggctggagtggggtgctagttatctcatttgatgganaacaaataaatactaacagacgtacctccgggttacggggcctattcacccatcaccgtaaaanataatagaaacgacacgtnttacgtactagaataaagtacgaacacgtactagagagacgaggacggacgtacggtcgttagtacgtttacgtttacgttggtttcggtttacggttcgtacggttaccggttacgggtacggggtaacttaccgtacgacgaccgtaccggtcggggaccggacggg

SEQ ID NO: 327607 - DNA, 723 bp, Homo sapiens
  misc_feature: GZ8MTXP02HIWV6.10.53.E09.1.454.CMB.2.raw
  modified_base (251)..(251): a, c, t, g, unknown or other
  misc_feature (251)..(251): n is a, c, g, or t
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtggagtcgtgggggagcgtggtccaggcctgggacggtccctnagactctcctgttacgcctctggacttcaccttcagtagttactcctttgcacgttgggtcctcgaggcctccgaggcaaggggctgggagtgggtgcagttatcctctagtttgagttggaagtactaataaaagtactaacgagtacgtaccgttaccggggttccggggaccgtaacgttacccaaccctaacttacccgttaacccgaaaaggtaaaccttaaagttttaacgaaaacggtaaacctaacggttccgtttacgttttaccgtacgtaaaccgtaaaattacgggtaaaaccacggtacccgttaggaacggtaacgtcgtacgggaaacggacgtaaccgggtcgttaggttagttaacgtttacgttacggttttccggttttaaggtttcgtccggtaaacggttccgggggttaccgggggttaaaacttacccgtttacggaacggttacccgg

SEQ ID NO: 327608 - DNA, 759 bp, Homo sapiens
  misc_feature: GZ8MTXP02JVSD3.10.53.E09.1.454.CMB.2.raw
  modified_base (241)..(241): a, c, t, g, unknown or other
  misc_feature (241)..(241): n is a, c, g, or t
  modified_base (348)..(348): a, c, t, g, unknown or other
  misc_feature (348)..(348): n is a, c, g, or t
  modified_base (368)..(368): a, c, t, g, unknown or other
  misc_feature (368)..(368): n is a, c, g, or t
tcagcatagtagtgcacgaccggtgctcgatttagagagagtgtgttgggtttgggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctgggtggagtcgtgggggagcgtggtccagccgtgggacgtccctnagactctcctgttacgcctctgattcaccttcagttattactcctttgctacgtcgggtcctcgacggctccgagggaccgaaggggtcgtaggggacggttggggnggaccgtaagtttatccttntagttttagacgtagggaaactaactaaaattaaaactacgtaacgaggaacgggtacccgtttcccggggttacgggggacccttacgttaccctaaccctaaacgtacccttaaaaccgaaaacggtaaaccttaaaagttttaaacgggaaaacgaaaccctaacggttacctttggtttaacctaggtaaactaaaacgttacgaaaccgacgtccgtagggaagaccgtagtacggaaacggcgtaccggtcgtagttacgtttaaagtttaccggtttagttttcggtttacggttcgtacgggttaccggttccgggggtaaccggggtaacctttaccgttcgaaacggtcccgtacggttaccgggggacccgtacccgggg

SEQ ID NO: 327609 - DNA, 604 bp, Homo sapiens
  misc_feature: GZ8MTXP02IGOT9.10.53.E09.1.454.CMB.2.raw
  modified_base (240)..(240): a, c, t, g, unknown or other
  misc_feature (240)..(240): n is a, c, g, or t
  modified_base (253)..(253): a, c, t, g, unknown or other
  misc_feature (253)..(253): n is a, c, g, or t
  modified_base (257)..(257): a, c, t, g, unknown or other
  misc_feature (257)..(257): n is a, c, g, or t
  modified_base (268)..(268): a, c, t, g, unknown or other
  misc_feature (268)..(268): n is a, c, g, or t
  modified_base (340)..(340): a, c, t, g, unknown or other
  misc_feature (340)..(340): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctgggtggagtcgtgggggagcgtggccagcctgggacgtccctnagctctctgttancctntggatcacttnagtagttatcctttgctacgtgggtccgtcaggctccgaggcaaggggctggaggtgggtgctagttatctntatttgactggaagacaaaataaatactaacagacgtactccgggttcggggcctattcaccatcacaaagactaattagaagaacacgtctagttacagtaactaaatacgaactacgacctagagacgacgtaggacgacgacgtcgtagttacgttaatttcgttggtttcgttttcggttcgttacggtaccgttacggtacgggggttaaacttaccgtttacacggtacgtaccggttacggggacccgtaaccgggg

SEQ ID NO: 327610 - DNA, 556 bp, Homo sapiens
  misc_feature: GZ8MTXP02JK2PZ.10.53.E09.1.454.CMB.2.raw
  modified_base (177)..(177): a, c, t, g, unknown or other
  misc_feature (177)..(177): n is a, c, g, or t
  modified_base (244)..(244): a, c, t, g, unknown or other
  misc_feature (244)..(244): n is a, c, g, or t
  modified_base (344)..(344): a, c, t, g, unknown or other
  misc_feature (344)..(344): n is a, c, g, or t
  modified_base (347)..(347): a, c, t, g, unknown or other
  misc_feature (347)..(347): n is a, c, g, or t
  modified_base (357)..(357): a, c, t, g, unknown or other
  misc_feature (357)..(357): n is a, c, g, or t
  modified_base (435)..(435): a, c, t, g, unknown or other
  misc_feature (435)..(435): n is a, c, g, or t
  modified_base (444)..(444): a, c, t, g, unknown or other
  misc_feature (444)..(444): n is a, c, g, or t
tcagcatagtagtgcacgaccggtgctcgatttagagagagtgtgttgggtttggggctgggagacgagcccagcactggaagtcgccggtgtttccattcggtgatcatcactgaacacagaggactcaccatggagtttgggctgagctgggttttcctcgttgctcttttaagnggtgtccagtgtcaggtgcagctggtggagtcgtgggggagcgtggtccagcctggggacgtccctnagactctcctgttagcctctggattcaccttcagtagttatccttgcacgtgggtcctcaggcctccgaggcaaggggctgggagtggggtgctagttanctnattgatgganacaaataaatcacagagacctcggtcgggctatcaccatcaccaaagactaattagaaacaacacgtcttagtttacngataataanaacgacgacagagagacgagagacgacgcgtacgtagtacgttacttgttcgtttcgttcgtcgtacgtaacggtacgggtaacgtaccgtacgtacgtacgtacggtacgg

SEQ ID NO: 327611 - DNA, 614 bp, Homo sapiens
  misc_feature: GZ8MTXP02FV5FS.10.53.E09.1.454.CMB.2.raw
  modified_base (248)..(248): a, c, t, g, unknown or other
  misc_feature (248)..(248): n is a, c, g, or t
  modified_base (266)..(266): a, c, t, g, unknown or other
  misc_feature (266)..(266): n is a, c, g, or t
  modified_base (272)..(272): a, c, t, g, unknown or other
  misc_feature (272)..(272): n is a, c, g, or t
  modified_base (300)..(300): a, c, t, g, unknown or other
  misc_feature (300)..(300): n is a, c, g, or t
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggagcgtggtccagccgtgggaggtccctnagactctctgttagcctntgatcnccttcagtatatccttgcactggtcctnaggctccgaggcgaaggggctgggaggttggggtgctaggttatcctctatttgattggaagtaacaagtaaaactactaacgaagacgtaacctccggggttaccggggccgtacgttccaaccacgtctaaccgaaaacgtactaaatttagaaacgaaaccgacgtacttagttctacgactaaaatacgaaacaacgtcctagagaacgcgtaggacggaacgacggtactggtacgttaagtttacgttggtttacgtttggttcgtcggtacgtcgggtacggggtaacttacccgtacgtacgtacg

SEQ ID NO: 327612 - DNA, 568 bp, Homo sapiens
  misc_feature: GZ8MTXP02FLS32.10.53.E09.1.454.CMB.2.raw
  modified_base (181)..(181): a, c, t, g, unknown or other
  misc_feature (181)..(181): n is a, c, g, or t
  modified_base (248)..(248): a, c, t, g, unknown or other
  misc_feature (248)..(248): n is a, c, g, or t
  modified_base (281)..(281): a, c, t, g, unknown or other
  misc_feature (281)..(281): n is a, c, g, or t
  modified_base (345)..(345): a, c, t, g, unknown or other
  misc_feature (345)..(345): n is a, c, g, or t
  modified_base (485)..(485): a, c, t, g, unknown or other
  misc_feature (485)..(485): n is a, c, g, or t
  modified_base (498)..(498): a, c, t, g, unknown or other
  misc_feature (498)..(498): n is a, c, g, or t
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagctgggttttcctcgttgctcttttaagnggtgtccagtgtcaggtgcagctgggtggagtcgtgggggagcgtggtccagcctgggacgtccctnagactctcctgtttagcctctggattcaccttnagtagttatcctttgcatgggtcctcaggctccaggcaaggggctgggagtggggtgcagttancctcatttgatggaagactaataaatactacagagactccgggtagggccgattcacatcaccgtaaagactaaagttagaaagaaacacgtacgttagtttactagtacaaaattacgaaactagccgtagagaacgtnagaggaccacggngtagtacgttattacgtgtttcgttcggtttctgacttcgggtacggggtaactacgttacgacgtaccg

SEQ ID NO: 327613 - DNA, 648 bp, Homo sapiens
  misc_feature: GZ8MTXP02JUJVR.10.53.E09.1.454.CMB.2.raw
  modified_base (351)..(351): a, c, t, g, unknown or other
  misc_feature (351)..(351): n is a, c, g, or t
tcagcatagtagtgcacgaccggtgctcgatttagagagagtgtgttgggtttggggggagctacaacaggcaggcagggggcagcaagatggtgttgcagacccaggtcttcatttctctgttgctctggatctctggtcgccgtacggggacatcgtgatcgacccagtcctccacgacctccctgcctgtgtctcgtgggcgaggacgggccaccatcaactgacaacgtccacgccagtagttgttttactcagcctaccgaaactaaataaacgaacttacgttacgcgttacggtaaccagacaacgaaaccgaggacacgccctacagctgctctacgttacgnggactacgtaccggtaccggtacgtcccccggggtcctagacctatcgaggtcggcgtacgggcggggttcgacgggactagttacttaccactcctacccactacgccgaacgtccgacgtccgtaggacgacgggtcgaaacggaagtcggtccgggacggttacgtttaacggttttactaccgtcggtacctactacttaacttacgttaactacccgttaccctatacctcgtaacgtccgaccggacggaactagggtaacgacgtaacaacgaacgtcgtcggactaccg

SEQ ID NO: 327614 - DNA, 694 bp, Homo sapiens
  misc_feature: GZ8MTXP02I60SX.10.53.E09.1.454.CMB.2.raw
tcagcatagtagtgcacgaccggtgctcgatttagagagagtgtgttgggtttgggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggagcgtggtccagccgtgggacgtccctgagctctctgttagcctcgtgacttcacttcagttattactcctttgcctacgttcgggtcctcgacggtcctaccgagggaccgaaggggtctaggggaggtggggtcgcgtagttactcgtactagtttgacgtaggaacgaactaaaattaaatactaacacgggtaacgtaccggttcccggggttaccggggaccttacttcccgaaacctataccctaaacgaaaagtaacttaagtttaacgaaacgtaacccacgttcgtttagttacgacgaactaaaagtacgaaactcgaccgtaggacagccgtaggaacggacgtcggtacgttagttagttacgtttacggtttcggtttacgttttcggtactacggtaaccggtttcggggtaaacggtaactttacccgttagaaccggtccggtaacgggtcggggaacccgtcggg

SEQ ID NO: 327615 - DNA, 666 bp, Homo sapiens
  misc_feature: GZ8MTXP02JN2XY.10.53.E09.1.454.CMB.2.raw
  modified_base (244)..(244): a, c, t, g, unknown or other
  misc_feature (244)..(244): n is a, c, g, or t
  modified_base (339)..(339): a, c, t, g, unknown or other
  misc_feature (339)..(339): n is a, c, g, or t
tcagcatagtagtgcacgaccggtgctcgatttagagagagtgtgttgggtttggggctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggagcgtggtccagccgtgggacgtccctnagactctcgtgttacgcctgtgattcaccttcagtagttactccgtttgctacgtgggtcctgacggcctccgaggcgaggggctggaggtgggngctagttactctatagtttgagtggaagactaaataatctacgagtacgtaccgtccgggtcggggactagtcccacctactacctaaccgaaagtacctaaagtttacgaaaacgtaaaccgtacgtaccgtttgtttaccgacgtaaaccgtaaaagttacgaaaccgacgtacccgtaggaacgacgtacgtacgggacggaaccgtacggcttaggttacgttatttacggttcggttttacccggtttggttacgtacggttaccgttaaccggggtacggggtaacttacccgttagacggtaccgtacggtacccggggg

SEQ ID NO: 327616 - DNA, 622 bp, Homo sapiens
  misc_feature: GZ8MTXP02G5RW5.10.53.E09.1.454.CMB.2.raw
  modified_base (162)..(162): a, c, t, g, unknown or other
  misc_feature (162)..(162): n is a, c, g, or t
  modified_base (245)..(245): a, c, t, g, unknown or other
  misc_feature (245)..(245): n is a, c, g, or t
  modified_base (354)..(354): a, c, t, g, unknown or other
  misc_feature (354)..(354): n is a, c, g, or t
  modified_base (357)..(357): a, c, t, g, unknown or other
  misc_feature (357)..(357): n is a, c, g, or t
  modified_base (372)..(372): a, c, t, g, unknown or other
  misc_feature (372)..(372): n is a, c, g, or t
tcagcatagtagtgcacgaccggtgctcgatttagagagagtgtgttgggtttggggctgggagacgagcccagcactggaagtcgccggtgtttccattcggtgatcatcactgaacacagaggactcaccatggagtttgggctgagcgtgggttttccncgttgctcttttaagaggtgtccagtgtcaggtgcagctggtggagtcgtgggggagcgtggtccagccgtgggacgtccctnagactctcctgttacgcctctggattcaccttcagtagttactccttgctacgtgggtcctcgaggtcctaccgaggcgaaggggctgggagtcggggtgctaagtttnctntagtttgatgggaanaactaaataaaacttacaacgagagtaccgtcccggggttacggggacctaattccaacccgtataccctacccaaaagtacctaaaagtttagaaacgaaacgtacgtcgttagtttacctaggacctaaaattggaaaacctacgacctagacgacgcgaggacgacgcgtctacgtagttattacgttgtttcgttcgttcgtacgtacggtcggtacggtaactactacgacgtacgtacggtcgg

SEQ ID NO: 327617 - DNA, 594 bp, Homo sapiens
  misc_feature: GZ8MTXP02GPYVI.10.53.E09.1.454.CMB.2.raw
  modified_base (315)..(315): a, c, t, g, unknown or other
  misc_feature (315)..(315): n is a, c, g, or t
  modified_base (333)..(333): a, c, t, g, unknown or other
  misc_feature (333)..(333): n is a, c, g, or t
tcagcatagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatcgacccagtctccagactcctgcctgtgtctcgtgggcgagagggccaccatcaactgacaagtccagccagtagttgttttaatcagctaccgaacaaataaagaactacttagcttaggtaaccagcaagaaaaccaggaacagccctacgtaanctagctactaatttacgngggcaatccgaaaccggggtacgtccccggggtccctagaccagttcgagtggcaggcgggtcacgggactagtacttcactctacacatcagtacacgacctacgacggtactagaaagagtggcggtactagtttactacgtagtacacgtactaacttattaacgtacgtaacccctattaccactaacgttccggtacccgtacgggaaaccgtaaagtacggaaataacaacgaaaacgacgtaggtcggactacg

SEQ ID NO: 327618 - DNA, 688 bp, Homo sapiens
  misc_feature: GZ8MTXP02GTFJL.10.53.E09.1.454.CMB.2.raw
  modified_base (238)..(238): a, c, t, g, unknown or other
  misc_feature (238)..(238): n is a, c, g, or t
  modified_base (359)..(359): a, c, t, g, unknown or other
  misc_feature (359)..(359): n is a, c, g, or t
  modified_base (476)..(476): a, c, t, g, unknown or other
  misc_feature (476)..(476): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggagcgtggtccagcctgggaggtccctnagctctcctgttagcctctgatcaccttcagtagttatccttgctacgttgggtcccgtcaggcctccgagggcgaaggggctgggaggtggggtggctagttatctcatttggatggaanaacaataaatactaacagactacgtccggttcgggggacctattccacctatcctaacaaagactaattagaaacgtaactacgtacttcgtttactagaacctaaattacgaaacncgtacgttacggaggacgtaccgtagggaacggtaccgtacgggtacgttacggttagtttaaacgtttaccgttttgggttttacccgggtttttgggttaccgtttacggggttaaccgtttacgggggttaacccgggggtaaaacttaccccggtttacggaacggttacccggtaaaccggttccgggggtaccgtaaccccggggg

SEQ ID NO: 327619 - DNA, 597 bp, Homo sapiens
  misc_feature: GZ8MTXP02GCKMF.10.53.E09.1.454.CMB.2.raw
  modified_base (182)..(182): a, c, t, g, unknown or other
  misc_feature (182)..(182): n is a, c, g, or t
  modified_base (249)..(249): a, c, t, g, unknown or other
  misc_feature (249)..(249): n is a, c, g, or t
  modified_base (355)..(355): a, c, t, g, unknown or other
  misc_feature (355)..(355): n is a, c, g, or t
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagctgggttttcctcgttgcttcttttaagnggtgtccagtgtcaggtgcagctggtggagtcgtgggggagcgtggtccaggcctgggacgtccctnagactctcctgttagcctctggattcaccttcagttagttactcctttgctacgtgggtccgtcaggcctccgaggccaaggggctgggaggtggggtgcagttancctcatttgagtgagaacataaatactacagacgtactccggtacgggccgattcacatcctacaaagactaagttagaaacgaacgacgtacttcgtttctagtaccaaataggaacacgccgtagagacgacgtaggaacgacgacggtactggtagtttacttaacgtttcgtttacggtttcgttacgtcggtacgttacgggtacgggggtaacttaccgttacgtacggtacccgg

SEQ ID NO: 327620 - DNA, 643 bp, Homo sapiens
  misc_feature: GZ8MTXP02GMLL1.10.53.E09.1.454.CMB.2.raw
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggagcgtggtccagccgtgggacgtccctcagactctcctgttagcctctggattcacttcagtagttatcctttgctacgtgggtccctcaggtcctccgaggcgaaggggctgggagtgggtggctaggtttatcgtacattttgagtggaagacaaagttaaatacgtaagagacgtaccgttcccggttacgggggcctaagtttccaaaccctagtacctaacccaaaagaacctaaagtttacgaaagaactacgtcttcgtttactagtacaaagtagaaacagtaccgtagagacgacgtaggaacggacgacggctaggtagttacgttacgttacggtttcgtttggttcgttacgtacgttaccgggttacgggggtaacttaccgttacgacgtaccgtacggttcgggggaccgtacgggg

SEQ ID NO: 327621 - DNA, 736 bp, Homo sapiens
  misc_feature: GZ8MTXP02I70OT.10.53.E09.1.454.CMB.2.raw
  modified_base (335)..(335): a, c, t, g, unknown or other
  misc_feature (335)..(335): n is a, c, g, or t
tcagcatagtagtgcacgaccggtgctcgatttagagagagtgtgttggggtttgggggagctacaacaggcaggcaggggcagcaagatggtgttgcagacccaggtcttcatttctctgttgctctggatctctggtgccgtacggggacatcgtgatgacccagtcctccagacctccctgcctgtgtctcgtgggcgaggacgggccaccatacaactgacaagtccagccagtagttgtttatcagctaccgacaaataagaactatagcttaggtaccagcaacgaaaccgaggacacgaccctacgtaagctgctactaactttacgngggactactccgtaacccggggtaaccgtcccccgggggtccctagaccgtacttcgaggtcgggcgacgggccggggttcgtcgggggaactaggtacttttccgaaccttcctaccctaaccaacgtcacggactaccggcctcggacgacgggcgttaaacggaaaggtacggtccggtaccgggttacgtttaacggttttttaaaccgtacgttacgtacgtaaccggtaaaccttaacgtttaaaccgtttaacttaacccccggttaaacccccttattttaacccaaaccgtttaaccgtttccccgggtacccgtaaaacgggggtaaaccctaaagggttaacgggaactaaacttaaacccgaaaacgtaacggttcggtacggtaaccg

SEQ ID NO: 327622 - DNA, 576 bp, Homo sapiens
  misc_feature: GZ8MTXP02FTY43.10.53.E09.1.454.CMB.2.raw
  modified_base (250)..(250): a, c, t, g, unknown or other
  misc_feature (250)..(250): n is a, c, g, or t
  modified_base (355)..(355): a, c, t, g, unknown or other
  misc_feature (355)..(355): n is a, c, g, or t
  modified_base (359)..(359): a, c, t, g, unknown or other
  misc_feature (359)..(359): n is a, c, g, or t
  modified_base (380)..(380): a, c, t, g, unknown or other
  misc_feature (380)..(380): n is a, c, g, or t
  modified_base (420)..(420): a, c, t, g, unknown or other
  misc_feature (420)..(420): n is a, c, g, or t
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctgggtggagtcgtgggggaggcgtggtccagcctgggaggtcccctnagactctcctgtttagcctctggattcaccttcagttagttactcctttgctacgtggggtcctcaggctccaggcgaaggggctgggaggtgggtggcagttancctntatttgatggaagacataaanactacagagactccggttcgggccgattccacatcacaanactaattagaagaacacgcttgttactagactaatagaacacgcctagacgtagcgtaggacgacgacggcgtgtacgttatttacgttggtttacggtttggttcgttaacggtacgtacgggttacgggggtaacttaccgttacgacgtaccg

SEQ ID NO: 327623 - DNA, 671 bp, Homo sapiens
  misc_feature: GZ8MTXP02JTFMW.10.53.E09.1.454.CMB.2.raw
  modified_base (246)..(246): a, c, t, g, unknown or other
  misc_feature (246)..(246): n is a, c, g, or t
  modified_base (260)..(260): a, c, t, g, unknown or other
  misc_feature (260)..(260): n is a, c, g, or t
  modified_base (287)..(287): a, c, t, g, unknown or other
  misc_feature (287)..(287): n is a, c, g, or t
  modified_base (301)..(301): a, c, t, g, unknown or other
  misc_feature (301)..(301): n is a, c, g, or t
  modified_base (332)..(332): a, c, t, g, unknown or other
  misc_feature (332)..(332): n is a, c, g, or t
  modified_base (343)..(343): a, c, t, g, unknown or other
  misc_feature (343)..(343): n is a, c, g, or t
  modified_base (347)..(347): a, c, t, g, unknown or other
  misc_feature (347)..(347): n is a, c, g, or t
  modified_base (362)..(362): a, c, t, g, unknown or other
  misc_feature (362)..(362): n is a, c, g, or t
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagcgtggtttcctcgttgctctttaagaggtgtccagtgtcaggtgcagctggtggagtcgtgggggagcgtggtccagccgtgggagtcccctnagctctcctgttancctctgattcacctcagtattatcttnctacgtgggtcctnaggcctccgaggcgaaggggctggagtgggngactagtttancctntatttgatgggaaanaactaataaactactaacgagtacgtaccgttccgggttaccggggacctacttaccaacctactacctaaaccgaaaactaactaaagttaacgaaacgtaaccgtacgttacgttacgtttactaacgtaactaaaagtacgaaacgtacgtaccgtaggaacgtaacggtacgtagggaacggtaaccggtaccggttacgttaggttacgttacgtttacgtttacgggttttccggtttcggttacggttaacggtaccgggttacggggtaaccggggtaacgtttaccgtacggtacgtcgg

SEQ ID NO: 327624 - DNA, 574 bp, Homo sapiens
  misc_feature: GZ8MTXP02I4DNJ.10.53.E09.1.454.CMB.2.raw
  modified_base (317)..(317): a, c, t, g, unknown or other
  misc_feature (317)..(317): n is a, c, g, or t
  modified_base (380)..(380): a, c, t, g, unknown or other
  misc_feature (380)..(380): n is a, c, g, or t
tcagcatagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctgcctgtgtctcgtgggcgagagggccaccatcaactgcaagtccagccagagttgtttatcagctccgaacaataagaactactagcttggtaccagcaagaaaccaggacacgcctactaagctgctctatttacgnggacatccgtaacccggggaatccccccggggtcctagaccgtattcgagtgcgaggcggtcngggacagtattcactctcaccatcagcacgcctgccgaggctaggaaagtagtcggccggtacttaggtttaacttaccgtgtacaagtacctaacttaattaacgtaaccgtacccctattaccactacgttccggacccgtacgggaaccaaaggtcggaacaactaacgaaaacgtacgtggtacgtaccg

SEQ ID NO: 327625 - DNA, 561 bp, Homo sapiens
  misc_feature: GZ8MTXP02HX37L.10.53.E09.1.454.CMB.2.raw
  modified_base (199)..(199): a, c, t, g, unknown or other
  misc_feature (199)..(199): n is a, c, g, or t
  modified_base (247)..(247): a, c, t, g, unknown or other
  misc_feature (247)..(247): n is a, c, g, or t
  modified_base (308)..(308): a, c, t, g, unknown or other
  misc_feature (308)..(308): n is a, c, g, or t
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagctgggttttcctcgttgctcttttaagaggtgtccagtgtcaggtncagctgggtggagtcgtgggggagcgtggtccagcctgggagtccctnagactctcctgttagcctctggattcaccttcagtagttatcctttgctacgtgggtcctnaggctccgaggcaaaggggctgggagtgggtgcagttatcctctatttgatggagaacataaatactacagagactccggttcggggccatcaccatcaccaaagactaattagaagaacacgctgtttctagtacaaatacgaacacgcctagagagcgtagacggacacggtactgtacgttattacgttgtttcgtttggttcgttaagtacgtacgggtacggggtaacttacccgttacgacgtaccg

SEQ ID NO: 327626 - DNA, 669 bp, Homo sapiens
  misc_feature: GZ8MTXP02G60IQ.10.53.E09.1.454.CMB.2.raw
  modified_base (241)..(241): a, c, t, g, unknown or other
  misc_feature (241)..(241): n is a, c, g, or t
  modified_base (276)..(276): a, c, t, g, unknown or other
  misc_feature (276)..(276): n is a, c, g, or t
tcagcatagtagtgcacgaccggtgctcgatttagagagagtgtgttgggtttgggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggagcgtggtccagccgtgggacggtccctnagactctcctgtttacgcctgtggattccaccttnagttattactcctttgctacgtgggtcctcgaggcctccgaggcgaaggggctggggaggtggggtcggctaggttactcctataagtttgaagttcggggaataaactaaaattaaataaccttaacgaggtaacgtacgttccggggtcggggacctacttccaacctactactaaaccaaagaactaattacgaaataaccacgtcttagttactacgaaactaaatacggaaacctacgacccgttaggaaagcggaccgtagggaacgaccgtaggtccgtagttagttaagtttaccggtttgtttacccggtttggttacgtcgtaaccgtcgggtaacgggtaactaacccgttgacgtaccgacgggtcggggacccgtaacgg

SEQ ID NO: 327627 - DNA, 593 bp, Homo sapiens
  misc_feature: GZ8MTXP02FGMQT.10.53.E09.1.454.CMB.2.raw
  modified_base (156)..(156): a, c, t, g, unknown or other
  misc_feature (156)..(156): n is a, c, g, or t
  modified_base (237)..(237): a, c, t, g, unknown or other
  misc_feature (237)..(237): n is a, c, g, or t
  modified_base (256)..(256): a, c, t, g, unknown or other
  misc_feature (256)..(256): n is a, c, g, or t
  modified_base (297)..(297): a, c, t, g, unknown or other
  misc_feature (297)..(297): n is a, c, g, or t
  modified_base (357)..(357): a, c, t, g, unknown or other
  misc_feature (357)..(357): n is a, c, g, or t
  modified_base (368)..(368): a, c, t, g, unknown or other
  misc_feature (368)..(368): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagctgggttttccncgttgctcttttaagaggtgtccagtgtcaggtgcagctggtggagtcgtgggggagcgtggtccagcctgggagtccctnagctctcctgttagccctnggattcaccttcagtagttatcctttgctacgtgggtcctnaggctccgaggcgaaggggctggaggtggggtgcaggttatcgtctatttgattgggaanaacaaataaanacctacagacgaccgttcggttcggggcctattccgaaccactctaacccaaagaactaattagaacgaacacgtcttgttactagacaaatagaacaagcctagagacgcgtagaacggacgacgcgtgtacgttagttacttggtttcgtttggttctcgtacgtccgggtacgggggtaaactaccgttacgacggtccgtacggtcggggccgaaccgggg

SEQ ID NO: 327628 - DNA, 820 bp, Homo sapiens
  misc_feature: GZ8MTXP02JWZEF.10.53.E09.1.454.CMB.2.raw
tcagcatagtagtgcacgaccggtgctcgatttagagagagtgtgttgggtttggggctgggagacgagcccagcactggaagtcgccggtgtttccattcggtgatcatcactgaacacagaggactcaccatggagtttgggctgagctgggttttcctcgttgcttcttttaagaggtgtccagtgtcaggtgcagctggtggagtcgtgggggaggcgtggtccagccgtgggacggtccctcagactctcctgttacgcctctggacttccaccttcagtagttactcctttgctacgtcgggtccgtcacggcctccgaggccgaaggggctgggaggtggggtgctagttatctctagtttgagtggaacgaactaaattaaaacgttactaacgaaagacggtaccgttaccccggggtttaccgggggacccttaacgttacccaacccgtaacttaccctaaacccgtaaaacgtaaaccttaaagtttaacggaaaacggtaaaaccctaccggttacctttacggttttacctaggtaaccctaaaagtacggtaaaacccgtacggtacccttagggaacggtaacggtaccggttacggaacggggaaaccgtaaccggggtcctttacggggttagtttaaaccgtttaaccgggttttcgggtttttaccggggttttttcgggtttacccggtttacgggttaacccgggtttaaccggggggttaaacccggggggtttaaaaccgtttaccccggtttaccggaaccggggtacccggttaaccggggttaccccgggggg

SEQ ID NO: 327629 - DNA, 622 bp, Homo sapiens
  misc_feature: GZ8MTXP02H7HNL.10.53.E09.1.454.CMB.2.raw
  modified_base (240)..(240): a, c, t, g, unknown or other
  misc_feature (240)..(240): n is a, c, g, or t
  modified_base (270)..(270): a, c, t, g, unknown or other
  misc_feature (270)..(270): n is a, c, g, or t
  modified_base (341)..(341): a, c, t, g, unknown or other
  misc_feature (341)..(341): n is a, c, g, or t
  modified_base (344)..(344): a, c, t, g, unknown or other
  misc_feature (344)..(344): n is a, c, g, or t
  modified_base (350)..(350): a, c, t, g, unknown or other
  misc_feature (350)..(350): n is a, c, g, or t
  modified_base (371)..(371): a, c, t, g, unknown or other
  misc_feature (371)..(371): n is a, c, g, or t
tcagcatagtagtgcacgaccggtgctcgatttagagagagtgtgttgggtttgggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctgggtggagtcgtgggggaggcgtggtccagcctgggagtccctnagctctccttgttcgctctggattcacttnagtagttatcctttgcacgtgggtccgtcaggcctccgaggcgaaggggtctggaggtgggtggctagttnctnatttgntggaatacaaataactactanaggtactacgttcccggttcggggaccctattaccaacctactcctaacccaaagtaactaaacgtttagaaaacgtaacctacgtacttgtttacctagtaacctaaagttacgaaacgacgtaccgtaggaagacgacgtagacggaactacggtctaggtattagttacgttcggtttcgtttcggttcttcgtacgtcgggtacggggtaattcccgttagacggtcgacggtcggaccgtaccggg

SEQ ID NO: 327630 - DNA, 724 bp, Homo sapiens
  misc_feature: GZ8MTXP02GPM0N.10.53.E09.1.454.CMB.2.raw
tcagcatagtagtgcacgaccggtgctcgatttagagagagtgtgttgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcacgtgggtccgtcaggctccgaggcgaagggggctgggaggtggggtggctagttatctctatttgatggagaacaaataaatactacagacgacctccggtcgggccgatcaccatcctaccaaagactaattagaaagaacacgtacttgtttcagacaaatgaaacagcctagagacgctggaaggacacgggtcttggtgttattacgttggtttacgtttggttcgtagtacgttcgggtacggggtaaacttaccgttacacggtaccgtaccggtcgggggaccgtacgggggtccctaaccccggttcggttaccccgtacccgttccgttacccgttccgacccgtacccctaacccgaaaccccggaaccgggtacccctacggtttccccggttccccgttcccccgtcggaccccctaaccccttccccgaacgaaacccggtaccgaccctacccggtaccggggtcggggaccaaccggccgggtcccggcccggtcgggccctcgggtaccgttaaccggg

SEQ ID NO: 327631 - DNA, 682 bp, Homo sapiens
  misc_feature: GZ8MTXP02HEREC.10.53.E09.1.454.CMB.2.raw
  modified_base (282)..(282): a, c, t, g, unknown or other
  misc_feature (282)..(282): n is a, c, g, or t
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagcttgggttttcctcgttgctcttttaagaggtgtccagtgtcaggtgcagctggtggagtcgtgggggagcgtggtccaggcccgggagtccctgagctcctctgttacgcctctggattcctaccttnagttagttacttcctttgcctacgttgggtcccgtacgacggcctccgaggtcgaaggggctgggaggtggggtcgacgtagttatctcctatttgagtggagtaacaaattaatactaacaggacgtaccgttcccgggttcggggaccctacgttcaaccctacttaccgtaaccgaaaacgtacctaaagtttaagaaacgtaaacctacgtacctttggtttactagtacctaaagtacgaaacgtagtacccgtagaacggagaccgtaggaaccggtacgacggttcttaggttcgttaaacgtttcgttacggttttcggtttacggttacgtacgtaaccggttacggggtaaccggggtaaacttaccgtaccgtaggtacccgtacgggg

SEQ ID NO: 327632 - DNA, 634 bp, Homo sapiens
  misc_feature: GZ8MTXP02FMOVX.10.53.E09.1.454.CMB.2.raw
  modified_base (240)..(240): a, c, t, g, unknown or other
  misc_feature (240)..(240): n is a, c, g, or t
  modified_base (260)..(260): a, c, t, g, unknown or other
  misc_feature (260)..(260): n is a, c, g, or t
  modified_base (365)..(365): a, c, t, g, unknown or other
  misc_feature (365)..(365): n is a, c, g, or t
tcagcatagtagtgcacgaccggtgctcgatttagagagagtgtgttgggtttgggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggagcgtggtccagccgtgggacgtccctnagactctcctgttacgcctntggattcaccttcagtagttactcctttgctacgtgggtcctcaggctccgaggcgaaggggctgggaggtgggtgctagttactctctagtttgacgtgggaanaactaaattaaaatactaacaggacgtaccgttccgggttaccgggggacctaattccaacctactacctaacccaaaagtaactaaagtttagaaacgaacacgtacttgttactagaacaaagtagaacagacctagagacgacgtaggacggacgacggtcgtgtacgttacttacgttggtttcggtttaggttcgtcgtacggttcgggtacgggggtaacttaccgttacgacggtaccgtacggtcggggaccgtaccgggg

SEQ ID NO: 327633 - DNA, 712 bp, Homo sapiens
  misc_feature: GZ8MTXP02FW05K.10.53.E09.1.454.CMB.2.raw
  modified_base (192)..(192): a, c, t, g, unknown or other
  misc_feature (192)..(192): n is a, c, g, or t
  modified_base (241)..(241): a, c, t, g, unknown or other
  misc_feature (241)..(241): n is a, c, g, or t
  modified_base (305)..(305): a, c, t, g, unknown or other
  misc_feature (305)..(305): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagcttgggtttttcctcgttgctcttttaagaggtgtccagtgtcaggtncagctggtggagtcgtgggggagcgtggtccagccgtgggacgtccctnagactctcctgttacgcctgtggattcaccttcagttagttactcctttgctacgtgggtcctnaggtcctccgaggcgaaggggtctagggaggtggggtggctaaggtttactcgtatagtttggacgttaggaagtaaactaaaagttaaaataaccgttaacgagggtaacgtaccggtttacccggggttaccgggggacccttaaatttacccaaccctaactacccttaaacccgaaaagtaaactaaacgtttaaggaaaacgtaaccgtaacgtctttacgtttctaacgtaaaccgtaaaagtacgaaaacgtacgaccgtagggaagacggtagtacgggaacgacgacggtcttagtagttaacgtttcgtttggtttacggtttgttacgtagtaccgttcggggtaacgggtaacttacgttacgaacggtcgtaacggtcggggaccgtaaccggg

SEQ ID NO: 327634 - DNA, 715 bp, Homo sapiens
  misc_feature: GZ8MTXP02HHVI3.10.53.E09.1.454.CMB.2.raw
  modified_base (197)..(197): a, c, t, g, unknown or other
  misc_feature (197)..(197): n is a, c, g, or t
  modified_base (246)..(246): a, c, t, g, unknown or other
  misc_feature (246)..(246): n is a, c, g, or t
  modified_base (360)..(360): a, c, t, g, unknown or other
  misc_feature (360)..(360): n is a, c, g, or t
  modified_base (374)..(374): a, c, t, g, unknown or other
  misc_feature (374)..(374): n is a, c, g, or t
tcagcatagtagtgcacgaccggtgctcgatttagagagagtgtgttgggtttggggctgggagacgagcccagcactggaagtcgccggtgtttccattcggtgatcatcactgaacacagaggactcaccatggagtttgggctgagcttgggttttcctcgttgcttcttttaagaggtgtccagtgtcaggtncagctggtggagtcgtgggggagcgtggtccagccgtgggacgtccctnagcctctcctgttacgcctctggtacttccaccttcagttagttactcctttgctacgtgggtccctgacggcctaccgaggcgaaggggctggaggtgggtgctagttatctntagttgagtggaanaactaaataatcacgagacgtaccgtcccggtcggggacctataccacctactactacaaagtaactaaagttacgaaacgtaactacgtacgttcgtttactagtaactaaagttaacgaaactacggtaccgtaggaacgtacggtacggtacgggaacgggtaaccggtaaccgggtacgtttacggttaggtttaaccgtttaacggttttacggtttttaccggggttttcggtttaccggttaccgggttaaccgggtttaacccgggggttaaccgggggttaaacctttaacccggttacgtaccggtaaccggtacggggtaaccccggggg

SEQ ID NO: 327635 - DNA, 728 bp, Homo sapiens
  misc_feature: GZ8MTXP02F4SMJ.10.53.E09.1.454.CMB.2.raw
  modified_base (178)..(178): a, c, t, g, unknown or other
  misc_feature (178)..(178): n is a, c, g, or t
  modified_base (196)..(196): a, c, t, g, unknown or other
  misc_feature (196)..(196): n is a, c, g, or t
  modified_base (244)..(244): a, c, t, g, unknown or other
  misc_feature (244)..(244): n is a, c, g, or t
  modified_base (260)..(260): a, c, t, g, unknown or other
  misc_feature (260)..(260): n is a, c, g, or t
  modified_base (270)..(270): a, c, t, g, unknown or other
  misc_feature (270)..(270): n is a, c, g, or t
  modified_base (351)..(351): a, c, t, g, unknown or other
  misc_feature (351)..(351): n is a, c, g, or t
tcagcatagtagtgcacgaccggtgctcgatttagagagagtgtgttgggtttggggctgggagacgagcccagcactggaagtcgccggtgtttccattcggtgatcatcactgaacacagaggactcaccatggagtttgggctgagcttgggttttcctcgttgctcttttaagnggtgtccagtgtcaggtncagctggtggagtcgtgggggagcgtggtccagcctgggacgtccctnagctctctgttagctntgatcacttnagtagttatcctttgcctacgtgggtcccgtcgaggcctccgaggcgaagggggtctgggagtggggtggctagttatctnatttgatggataacaaattaaactcgtaacaggacgaccgttcccggttacggggcctattccacctactaccgtaaccaaaagtaactaaagtttacgaaacgtaaacgtacgtaccttaggtttacctaggaacctaaaagttacgaaacccgaacggtacccgttaaggaacgtaacggaccgttaagggaaccggaaccgtaacggggtccgttagggtttacgtttaacgttttaaccgttttaggtttttaccgggtttttacgggtttccgttacgggttaacccggtttaaccggggttaaacccgggggttaaacctttaccccggtttaccgaaccgggtacccgtaaaccgggttaccccgggggg

SEQ ID NO: 327636 - DNA, 640 bp, Homo sapiens
  misc_feature: GZ8MTXP02IM23R.10.53.E09.1.454.CMB.2.raw
  modified_base (253)..(253): a, c, t, g, unknown or other
  misc_feature (253)..(253): n is a, c, g, or t
  modified_base (352)..(352): a, c, t, g, unknown or other
  misc_feature (352)..(352): n is a, c, g, or t
  modified_base (360)..(360): a, c, t, g, unknown or other
  misc_feature (360)..(360): n is a, c, g, or t
  modified_base (363)..(363): a, c, t, g, unknown or other
  misc_feature (363)..(363): n is a, c, g, or t
  modified_base (375)..(375): a, c, t, g, unknown or other
  misc_feature (375)..(375): n is a, c, g, or t
tcagcatagtagtgcacgaccggtgctcgatttagagagagtgtgttgggtttggggagctctgggagacgagcccagcaccggaagtcgccggtgtttccattcggtgatcatcactgaacacagaggactcaccatggagtttgggctgagcttgggttttcctcgttgcttcttttaagaggtgtccagtgtcaggtgcagcgtggtggagtcgtgggggaggcgtggtccaggccgtgggacgtccctnagtactctcctgtttacgcctctggattcacttcagttagttactcctttgctacgtcgggtccgtcgaggcctcgaggcaaggggctgggaggtgggngctagttnctnatttgatggaanaactaaataagtactaacgagacgtaccgttccggtacggggccgtaacttccgaaacctactaccctaacgaaaacgtaactaaagtttacgaaaacgtaaccgaacgtcgtttacgtttacgtacgtaacctaaagttacgaaacgacgtaccgtagacgacgcgtaggacggacgacggtctagttgttacttacgttcgtttcgtttcggttctagtaaccgttggtaacggggtactaccgttacgacgtacgtaccggg

SEQ ID NO: 327637 - DNA, 784 bp, Homo sapiens
  misc_feature: GZ8MTXP02GSNXH.10.53.E09.1.454.CMB.2.raw
  modified_base (177)..(177): a, c, t, g, unknown or other
  misc_feature (177)..(177): n is a, c, g, or t
  modified_base (245)..(245): a, c, t, g, unknown or other
  misc_feature (245)..(245): n is a, c, g, or t
tcagcatagtagtgcacgaccggtgctcgatttagagagagtgtgttgggtttggggctgggagacgagcccagcactggaagtcgccggtgtttccattcggtgatcatcactgaacacagaggactcaccatggagtttgggctgagctgggttttcctcgttgctcttttaagnggtgtccagtgtcaggtgcagcgtggtggagtcgtgggggagcgtggtccaggcctgggacgtccctnagtctctcctgttacgcctctggtacttccaccttcagttacgttactcctttgcgtacgtcgggtccgtcaggtcctccgaggcgaaggggtctaggggacggttggggtggctagtttactcgttcgtaagtttgagttaggggaactaaacgtaaaattaaaacgttaccaaacgtaaacggtaaccggtaacccgttcccggggttaccgggggacccttaacgttacccaacccgtaacttacccgtaaacccgaaaagtaacgtaaacgtttaacggaaaacgtaaaccgtaacgttaccttacggtttaccgtaggtaaacctaaagttacggaaaccgtaacggtacccgttaaggaacggtacggcgtaagggaacgggaaccgacgggtacgttaggttacgtttacgttttaccgttcgggttttaccggttttcggttaccgtagggttaacccggttccgggggttaaaccgggggtaaacctttacccggttacgtaccggtaccggttacccgggtcccggggg

SEQ ID NO: 327638 - DNA, 623 bp, Homo sapiens
  misc_feature: GZ8MTXP02GM37H.10.53.E09.1.454.CMB.2.raw
  modified_base (242)..(242): a, c, t, g, unknown or other
  misc_feature (242)..(242): n is a, c, g, or t
  modified_base (259)..(259): a, c, t, g, unknown or other
  misc_feature (259)..(259): n is a, c, g, or t
  modified_base (347)..(347): a, c, t, g, unknown or other
  misc_feature (347)..(347): n is a, c, g, or t
  modified_base (358)..(358): a, c, t, g, unknown or other
  misc_feature (358)..(358): n is a, c, g, or t
tcagcatagtagtgcacgaccggtgctcgatttagagagagtgtgttgggtttgggggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtggagtcgtgggggagcgtggtccagccgtgggacgtccctnagactctcctgtttacncctctggattcaccttcagttagttatcctttgcacgtgggtcctcaggctccgaggcgaaggggctgggagtgggtgcagttatctnatttgatgganaactaataaatactacagacgaccgttccgggttccggggacctattccaacctactacctaaccaaagaactaaagtttagaaacgaaccacgtacttgtttacagaactaaatacgaacagacctaggagagcgtaggacggacgacggtctaggttgttaacgttacgtttggtttcggtttggttacgtcggtaccgttcgggttacgggggtaaacttaccgttacgacggtaccgtacggttcggggaccgtaccgggg

SEQ ID NO: 327639 - DNA, 728 bp, Homo sapiens
  misc_feature: GZ8MTXP02GG2Y8.10.53.E09.1.454.CMB.2.raw
  modified_base (238)..(238): a, c, t, g, unknown or other
  misc_feature (238)..(238): n is a, c, g, or t
  modified_base (258)..(258): a, c, t, g, unknown or other
  misc_feature (258)..(258): n is a, c, g, or t
  modified_base (271)..(271): a, c, t, g, unknown or other
  misc_feature (271)..(271): n is a, c, g, or t
  modified_base (343)..(343): a, c, t, g, unknown or other
  misc_feature (343)..(343): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagcgtggtttcgtcgtaggctctttaagaggtgtccagtgtcaggtgcagctggtggagtcgtgggggagcgtggtccagccgtgggacgtccctnagactctcctgttacgcctntggattcaccttnagttattactccttgctacgtcgggtcctgacggtcctacgaggacgtaaggggtcgtggggtaggtggggngtacgtagtttactcgtacttagttagtagtaggaagtaactaaaataaaactaactaacgacgtaacgtaccggttaccggttaccgggtaccgtacgtacctaacctaactacctaaaccgtaaacgtaaacgtaaacgttaaacgtaaacgtaaacgtaacgtacgttacgtttacgttacgtaaacgtaaacgtaacgtaaacgtaacgtacgtacgaacgtacgtacgtacggtacggtaacggtacggtacgtacgttaggttacgtttacgtttcggttttacggtttcggttacgttacggttacggttaccgggttacggggttaaccgttaaccgttacgtacgtaccggtaccggtaccgggtaccggtaccgg

SEQ ID NO: 327640 - DNA, 639 bp, Homo sapiens
  misc_feature: GZ8MTXP02HPS0I.10.53.E09.1.454.CMB.2.raw
  modified_base (240)..(240): a, c, t, g, unknown or other
  misc_feature (240)..(240): n is a, c, g, or t
  modified_base (268)..(268): a, c, t, g, unknown or other
  misc_feature (268)..(268): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtggagtcgtgggggagcgtggtccagccgtgggcgtccctnagctctcctgtttacgcctctgacttcnccttcagttacgttactcctttgctacgtcggtccgtcgaggctccgaggcgaaggggcgtggaggtgggtgcgtagttatctctatttgagtaggaacaactaaataaatactaagaggtacgtacgttccgggtacggggacccgtattacccacctactaccgtaaccaaaagtaacctaaagtttaacgaaacgtaactaaccgtcttacgttctacgaataaatacgaaacagtccgtagaagagactaggaacgacgacgtcgtagtacgttaactttcgttgtttcgtttggttacgttcgtacgttacggtacgggttaacgttaccgtacgtacgaccgtaccggtcgggacccgtaccggg

SEQ ID NO: 327641 - DNA, 657 bp, Homo sapiens
  misc_feature: GZ8MTXP02F4R2K.10.53.E09.1.454.CMB.2.raw
  modified_base (239)..(239): a, c, t, g, unknown or other
  misc_feature (239)..(239): n is a, c, g, or t
  modified_base (257)..(257): a, c, t, g, unknown or other
  misc_feature (257)..(257): n is a, c, g, or t
  modified_base (340)..(340): a, c, t, g, unknown or other
  misc_feature (340)..(340): n is a, c, g, or t
  modified_base (355)..(355): a, c, t, g, unknown or other
  misc_feature (355)..(355): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggagcgtggtccaggccgtgggagtccctnagctctcctgttagcctntgattcacttcagtagttatcctttgctactgggtcctcaggctccgaggcgaaggggctgggagtgggtgctagttactctntagtttgagtggaanaactaaagtaaatactaacgaggtaacgtaccgttcccggggttccggggaccgtaatttcccgaaccctacgtaccttaacccgaaaacgtaactaaactttagaaaacgaaaccgtacgtcttacgtttactagtaacgtaaacgtacgaaacgacgtaccgtagaagacgacgtaggacggaacgacggtaccgtgttagttacgtttacgttggtttcggttttcggttcgtacgttaacgttcggttaccgggggtaacttaccgttcgtacgtcgtacggtcgggaccgtaccggg

SEQ ID NO: 327642 - DNA, 574 bp, Homo sapiens
  misc_feature: GZ8MTXP02IOD01.10.53.E09.1.454.CMB.2.raw
  modified_base (237)..(237): a, c, t, g, unknown or other
  misc_feature (237)..(237): n is a, c, g, or t
  modified_base (298)..(298): a, c, t, g, unknown or other
  misc_feature (298)..(298): n is a, c, g, or t
  modified_base (329)..(329): a, c, t, g, unknown or other
  misc_feature (329)..(329): n is a, c, g, or t
  modified_base (338)..(338): a, c, t, g, unknown or other
  misc_feature (338)..(338): n is a, c, g, or t
  modified_base (341)..(341): a, c, t, g, unknown or other
  misc_feature (341)..(341): n is a, c, g, or t
  modified_base (351)..(351): a, c, t, g, unknown or other
  misc_feature (351)..(351): n is a, c, g, or t
  modified_base (360)..(360): a, c, t, g, unknown or other
  misc_feature (360)..(360): n is a, c, g, or t
  modified_base (366)..(366): a, c, t, g, unknown or other
  misc_feature (366)..(366): n is a, c, g, or t
  modified_base (411)..(411): a, c, t, g, unknown or other
  misc_feature (411)..(411): n is a, c, g, or t
  modified_base (431)..(431): a, c, t, g, unknown or other
  misc_feature (431)..(431): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggagcgtggtccagcctgggagtccctnagctctcctgttagcctctggattcaccttcagtagttactcctttgctactgggtccctnaggtcctccgaggccaaggggctggagtggngctagttanctnatttgatganacaaataanctaacngagactccgttggggccattcaccatctaccaaagactaaattanaaagaacacgtctgtttacngacaaagtcaaactgacctagagaacgcgtagaacggcaacggctgtacttattaccgtttgtttccgtttgggtttactggtaccgttcggtacgggggtaacttaccgttcgaacggcctacggtacgggccgaaccgggg

SEQ ID NO: 327643 - DNA, 669 bp, Homo sapiens
  misc_feature: GZ8MTXP02JX5VT.10.53.E09.1.454.CMB.2.raw
  modified_base (238)..(238): a, c, t, g, unknown or other
  misc_feature (238)..(238): n is a, c, g, or t
  modified_base (345)..(345): a, c, t, g, unknown or other
  misc_feature (345)..(345): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggagcgtggtccagccgtgggagtccctnagactctcctgttacgcctctggattcaccttcagttagttatcctttgcacgtgggtcctcaggcctccaggcgaaggggctggaggtggggtggctagttatctnatttgagtggaagaacaaataaacgtactaacagacgtacgttcccgggttacggggccgtactttccaaccctactaccgttaaccaaaagaacctaaatttagaaacgtaaccgtacgtactttacgtttctacgtacctaaaattacggaaacctacgtacttagggaagaggtacgtaggaacgggacacgggtctaggttagttaactttacgtttcggtttccgggtttggtttcggttacgtaaccggttaccgggttacgggggtaaacttacccgtttacgacggtaccgaccggttcggggaccggacccgggg

SEQ ID NO: 327644 - DNA, 661 bp, Homo sapiens
  misc_feature: GZ8MTXP02FR5CN.10.53.E09.1.454.CMB.2.raw
  modified_base (162)..(162): a, c, t, g, unknown or other
  misc_feature (162)..(162): n is a, c, g, or t
  modified_base (245)..(245): a, c, t, g, unknown or other
  misc_feature (245)..(245): n is a, c, g, or t
  modified_base (265)..(265): a, c, t, g, unknown or other
  misc_feature (265)..(265): n is a, c, g, or t
tcagcatagtagtgcacgaccggtgctcgatttagagagagtgtgttgggtttggggctgggagacgagcccagcactggaagtcgccgggtgtttccattcggtgatcatcactgaacacagaggactcaccatggagtttgggctgagctgggttttccncgttgctctttaagaggtgtccagtgtcaggtgcagctgggtggagtctgggggagcgtggtccaggcctgggacgttccctnagtactctcctgttagcctntggattcaccttcagtagttatcctttgctacgtcgggtccgtcacgggtctcccgaggccgaaaggggcctaggggacgtggggtcggctaggtttactccgtactaacgttttgacgttagggaataaccgaaaattaaaacgtacctaacgaagaacggtaccgttccggtttacgggggaccctaactttaccgaaccctaacgtacctaaccgaaaacggtaactaaaagtttacggaaaacgtaaactaccgtacgttcgtttacgtacgactaaatacgaacacgccgtagacgagactagacgacgacgctgtagtacttacttgttcgtttacgttcgtagtacgtaacggtacgggaacttaccgtacgacgtacgacgtacgggg

SEQ ID NO: 327645 - DNA, 818 bp, Homo sapiens
  misc_feature: GZ8MTXP02H7AXA.10.53.E09.1.454.CMB.2.raw
tcagcatagtagtgcacgaccggtgctcgatttagagagagtgtgttgggttgggggagacgagcccagcactggaagtcgccggtgtttccattcggtgatcatcactgaacacagaggactcaccatggagtttgggctgagctgggttttcctcgttgcttcttttaagaggtgtccagtgtcaggtgcagctggtgagtcgtgggggagcgtggtccaggccgtgggacgtccctcgagacctctccttgttacgcctgtggattcgaccttcagttagttactccctttgcctacgtcggggtcctcaggtcctaccgaggtcgaaggggtcgtagggaggttggggtgctaggttatcgttcaagtttcgagtggaaagtaactaaataaagtactaacgaggtaacgtaaccgttccccggggtttacgggggaccccttaatacccgtaaaccctaacttaccgtaaaccctaaaacggtaaacgttaaacgtttaacgggtaaaacgtaaaccgtaaccggttacgtttaacggtttttaccgtaacggtaaaccgtaaaacggtttaccgaaaaccggttaaccgggtacccgttaaggggtaaaccggtaaggacgttacgggaaacggggtaaccgtaaccggggttaccgttagggtttaacgtttacggtttacggttttacgggtttttaccgggttttcggtttaccgttacggttaccggtttaccggggtaccgggggttaaactttacccgttacggtaccgtaccgtaaccgggttcggggtaaacccggtcccgggg

SEQ ID NO: 327646 - DNA, 644 bp, Homo sapiens
  misc_feature: GZ8MTXP02J10P8.10.53.E09.1.454.CMB.2.raw
  modified_base (260)..(260): a, c, t, g, unknown or other
  misc_feature (260)..(260): n is a, c, g, or t
  modified_base (301)..(301): a, c, t, g, unknown or other
  misc_feature (301)..(301): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgagtcgtgggggagcgtggtccaggccgtgggacggtccctcagacctctcctgttagcctntggtattcacttcagtattatcctttgctacgtgggtcctnaggctccgaggcgaaggggctgggagtggggtgctagttatctatagtttgataggagaactaaataaactactaacgagacgtacccgtaccggttcggggacctattccgacctacttaccacctaaaacgtaactaaagttaacgaaacgtaaccaacgtcttacgtttactaggaactaaatacgaacacggtacctagggagacgaccgtaggaacggacgacggtctaggttctacgtttacgttggtttacggtttcgtcggttacggtacccgttaccggggttacggggtaacttaccgtcgacggtacgtaccggtcggggaccgtacccggg

SEQ ID NO: 327647 - DNA, 572 bp, Homo sapiens
  misc_feature: GZ8MTXP02HEKM5.10.53.E09.1.454.CMB.2.raw
  modified_base (299)..(299): a, c, t, g, unknown or other
  misc_feature (299)..(299): n is a, c, g, or t
  modified_base (323)..(323): a, c, t, g, unknown or other
  misc_feature (323)..(323): n is a, c, g, or t
  modified_base (380)..(380): a, c, t, g, unknown or other
  misc_feature (380)..(380): n is a, c, g, or t
  modified_base (419)..(419): a, c, t, g, unknown or other
  misc_feature (419)..(419): n is a, c, g, or t
  modified_base (423)..(423): a, c, t, g, unknown or other
  misc_feature (423)..(423): n is a, c, g, or t
  modified_base (470)..(470): a, c, t, g, unknown or other
  misc_feature (470)..(470): n is a, c, g, or t
  modified_base (500)..(500): a, c, t, g, unknown or other
  misc_feature (500)..(500): n is a, c, g, or t
tcagcatagtagtgcacgaccggtgctcgatttagagagagtgtgttgggtttgggggagctacaacaggcaggcaggggcagcaagatggtgttgcagacccaggtcttcatttctctgttgctctggatctctggtgccgtacggggacatcgtgatcgacccagtctccagactcctgcctgtgtctcgtgggcgaggacgggccacatcaactgacaagtccagccagtagttgtttatcagctaccgacaaataagaactactagcttaggaccagacaagaaaccaggaccanccctacaagctgctactatttcgnggctacgtaccggtaacccgggagtcccccggggtccacgacgattcgagtcgacgnggtcgggtacgagggacagtacttcactctacactactnacgnacgcctagcgagacagaagtagcgagtactagtttactacgtcgtanactactacgttaataactacctaaaccctntacctacgtacgtaccggaccgtaacggaactaaaggtaagtaacgtaaacgtaacgacgtcggacgactcg

SEQ ID NO: 327648 - DNA, 640 bp, Homo sapiens
  misc_feature: GZ8MTXP02JWQJ5.10.53.E09.1.454.CMB.2.raw
  modified_base (259)..(259): a, c, t, g, unknown or other
  misc_feature (259)..(259): n is a, c, g, or t
  modified_base (344)..(344): a, c, t, g, unknown or other
  misc_feature (344)..(344): n is a, c, g, or t
tcagcatagtagtgcacgaccggtgctcgatttagagagagtgtgttgggttttcctcgttgctcttttaagaggtgtccagtgtcaggtgcagctggtggagtcgtggggggaggcgtggtccagcctgggaggtccctcagactctcctgtttagcctctggattcaccttcagtagttatcctttgcacgtgggtccgtcaggcctccgaggcgaaggggctgggagtgggtgctagttatctctatttgatgganaacaaataaatacacagacgacgtccgtcggggcatcacatctaccaaagactaattagaagaacacgtctgtttcagacaaatnaacagcctaggagcgctaggagacgacgtctgttgtacttacgttggtttcgtttggtctaggtacggtcgggtacggggtaacttaccgttcgacgccgtacggtccgggggccgacgggaccctacccggtcggtacccgtaccgtcctccctcaccgtccctacccgaaccgaaccgggtcccctacggttcccgttcccttccccgtcgcccctacccttcccgacgacgaccgccgtaccgtcggtccggggacaaccggcggaccggtccggcggacgtcgacgtaccgg

SEQ ID NO: 327649 - DNA, 590 bp, Homo sapiens
  misc_feature: GZ8MTXP02JI9CA.10.53.E09.1.454.CMB.2.raw
  modified_base (199)..(199): a, c, t, g, unknown or other
  misc_feature (199)..(199): n is a, c, g, or t
  modified_base (250)..(250): a, c, t, g, unknown or other
  misc_feature (250)..(250): n is a, c, g, or t
  modified_base (352)..(352): a, c, t, g, unknown or other
  misc_feature (352)..(352): n is a, c, g, or t
  modified_base (356)..(356): a, c, t, g, unknown or other
  misc_feature (356)..(356): n is a, c, g, or t
  modified_base (367)..(367): a, c, t, g, unknown or other
  misc_feature (367)..(367): n is a, c, g, or t
  modified_base (380)..(380): a, c, t, g, unknown or other
  misc_feature (380)..(380): n is a, c, g, or t
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagctgggttttcctcgttgctcttttaagaggtgtccagtgtcaggtncagctggtggagtcgtgggggaggcgtggtccagccgtgggacggtccctnagactctcctgttagcctcgtggattccaccttcagttattactcctttgctacgtgggtcctcaggcctccgaggcaaggggctggagtgggtgctagttncctnatttgatgganacataatacgtanagagacctcggtcgggaccgatcacatctaccaagactaattagaagacacgtacttgtttactagtacaaagtcggaaacacgaccgtagagacgtacgtaggacggacgacggtactacggttagttactttacgtttcgtttacggtttgggtttacgtcggtacggttacgggtaccgggggtaacttaccgttacgtacgtacgg

SEQ ID NO: 327650 - DNA, 697 bp, Homo sapiens
  misc_feature: GZ8MTXP02FUIZU.10.53.E09.1.454.CMB.2.raw
  modified_base (254)..(254): a, c, t, g, unknown or other
  misc_feature (254)..(254): n is a, c, g, or t
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagcttgggttttcctcgttgcttcttttaagaggttgtccagtgtcaggtgcagcgtggtggagtcgtgggggaggcgtggtccagccgtgggacggtccctnagtactctctgtttagcctgtgattcaccttcagttagttactcctttgctacgttgggtccgtgaggtcctccgagggcgaaggggctaggggaggtggggtagctaggttactcccttacgtagtttgagttaggggaactaaacgtaattaaactacgtaacgaggtacgtaccgttacccggggttaccgggaccgtacttcccaacctactaccgtaaccgaaaacgtaacctaaagtttaagaaacgtaaaccgacgttaccgtttcgtttacgtaggtaaacctaaaagtacggtaaaccacggtaccgtagaaggtaacgcgtaggaacggacgtaccggtagttcgttagtttaacttacgtttggttttcgtttggtttcgtaacggtacgttacggggtacggggttaacttacccgttacggacgtaccgg

SEQ ID NO: 327651 - DNA, 773 bp, Homo sapiens
  misc_feature: GZ8MTXP02FW5NO.10.53.E09.1.454.CMB.2.raw
  modified_base (247)..(247): a, c, t, g, unknown or other
  misc_feature (247)..(247): n is a, c, g, or t
tcagcatagtagtgcacgaccggtgctcgatttagagagagtgtgttgggtttggggctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagcgtggtggagtcgtgggggagcgtggtccagccgtgggacgtccctnagactctccttgtttagcccttctggtacttcctaccttcagttagtttactcctttgcctacgttcggggtcccgtcgaggtcctccgagggtcgaagggggtctgggagggttcggggtggtactagtttacgtcttctagtttggagtacgggaactaaactaaattaaaactacgtaacgaaggtaacgtacccgttccgggttacgggggacccttacttacccaaccctaaaccttacctaaaccgtaaaacggtaaacctaaagtttaacggaaaacgaaaccgtaccgtacgtttcgttttacgaacgtaaaccgtaaaagtaccgaaacgaccggtacccgttaagaacgggtacggtacggtaacggaacggtaaccgtaccgggtacttagggttactttaaacgtttacgtttggttttaccggttttcgggttaccgtacggttaacccggttcggggttaaccggggtaaacctttacccggttaccgacggtaccgtacggggtccggggg

SEQ ID NO: 327652 - DNA, 605 bp, Homo sapiens
  misc_feature: GZ8MTXP02HWVYH.10.53.E09.1.454.CMB.2.raw
  modified_base (242)..(242): a, c, t, g, unknown or other
  misc_feature (242)..(242): n is a, c, g, or t
tcagcatagtagtgcacgaccggtgctcgatttagagagagtgtgttgggtttggggctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtctgggggagcgtggtccagccgtgggagtccctnagctctcctgttagcctctggattcaccttcagtgttactcctttgcactgggtccgtcaggctccaggcaaggggctgggagtgggtggctagttatcgtcagtttgagtggacgaacaaattaaatctaacaagacgaccgttccggttcgggggaccctacgttccaaccctataccctaccgaaaacgtacctaaatttagaaacgaaacaccgtacttagtttcctagacaaaatacgaacacgcctagacgagcgtaggacggacacggctgtaggttattacgttggttcgtttcggttctacggacgttccgggtacgggggtaacttacccgttcgacggtccgacggtcgggg

SEQ ID NO: 327653 - DNA, 555 bp, Homo sapiens
  misc_feature: GZ8MTXP02HQDOU.10.53.E09.1.454.CMB.2.raw
  modified_base (161)..(161): a, c, t, g, unknown or other
  misc_feature (161)..(161): n is a, c, g, or t
  modified_base (241)..(241): a, c, t, g, unknown or other
  misc_feature (241)..(241): n is a, c, g, or t
  modified_base (296)..(296): a, c, t, g, unknown or other
  misc_feature (296)..(296): n is a, c, g, or t
  modified_base (354)..(354): a, c, t, g, unknown or other
  misc_feature (354)..(354): n is a, c, g, or t
  modified_base (363)..(363): a, c, t, g, unknown or other
  misc_feature (363)..(363): n is a, c, g, or t
  modified_base (384)..(384): a, c, t, g, unknown or other
  misc_feature (384)..(384): n is a, c, g, or t
tcagcatagtagtgcacgaccggtgctcgatttagagagagtgtgttgggtttggggctgggagacgagcccagcactggaagtcgccggtgtttccattcggtgatcatcactgaacacagaggactcaccatggagtttgggctgagctgggttttccncgttgctcttttaagaggtgtccagtgtcaggtgcagctggtggagtctgggggagcgtggtccagcctgggagtccctnagactctcctgttctgcgtctggattcatcttagtaatctgcatgtctgggtccncaggtccaggccacgggctgggaatgggtggcagatatacaatatgatgaacagtaangtacatganctctcgagccattcacattcncagacgaacaacgtacaaagaaacattaggtagttatactaggacctaaagtcgaacacgccgtagagacgacggacggaacgtacgggtactagttacctacgtacgtaacggaacgggaacgggggaaaccgaaggaccgggaagtaccgaaaacggttctttacccgg

SEQ ID NO: 327654 - DNA, 649 bp, Homo sapiens
  misc_feature: GZ8MTXP02JDC2W.10.53.E09.1.454.CMB.2.raw
  modified_base (191)..(191): a, c, t, g, unknown or other
  misc_feature (191)..(191): n is a, c, g, or t
  modified_base (239)..(239): a, c, t, g, unknown or other
  misc_feature (239)..(239): n is a, c, g, or t
  modified_base (343)..(343): a, c, t, g, unknown or other
  misc_feature (343)..(343): n is a, c, g, or t
  modified_base (354)..(354): a, c, t, g, unknown or other
  misc_feature (354)..(354): n is a, c, g, or t
  modified_base (370)..(370): a, c, t, g, unknown or other
  misc_feature (370)..(370): n is a, c, g, or t
  modified_base (373)..(373): a, c, t, g, unknown or other
  misc_feature (373)..(373): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagctggggttttcctcgttgctcttttaagaggtgtccagtgtcaggtncagctggtggagtcgtgggggagcgtggtccagcctgggacgtccctnagactctcctgttagcctgtggattcaccttcagtagttatccctttgctacgtgggtccgtcaggctccgaggcaaggggctggagtgggtgctagttatctnatttgatgganaacaataaatactacnganacgtccggttcggggcctattccactactctaccaaagactaattagaaacgaactacgtacgttcgttacctagacctaaattacggaactacgacccgttaggaacgtacggaccgtaggaacgggtaaccgaaccggtacgtggtttacggttagtttaccgtttaggttttcggttttcggtttcgttcggtaaccggttccggggttaacgggggtaacttacccggttacgtacggtaccgtaccggtcgggggtacccgtaaccggggg

SEQ ID NO: 327655 - DNA, 624 bp, Homo sapiens
  misc_feature: GZ8MTXP02H1XF2.10.53.E09.1.454.CMB.2.raw
  modified_base (202)..(202): a, c, t, g, unknown or other
  misc_feature (202)..(202): n is a, c, g, or t
  modified_base (239)..(239): a, c, t, g, unknown or other
  misc_feature (239)..(239): n is a, c, g, or t
tcagcatagtagtgcacgaccggtgctcgatttagagagagtgtgttgggtttggggctgggagacgagcccagcactggaagtcgccggtgtttccattcggtgatcatcactgaacacagaggactcaccatggagtttgggctgagctgggttttcctgttgctcttttaagaggtgtccagtgtcaggtgcagctggnggagtcgtgggggagcgtggtccagcgtgggagtccnagctctctgttacgctctggattcaccttcagtagtttatcctttgctacgtgggtccgtcaggtcctccgaggcgaaggggctggggagtggggtgctagttatctcatttgatggagaacaaataaatactagagagaccgttcgttcggggcctagtccacatacactaaagaataacgttagaagaaactacgcttacgtttcgtagaactaaacgtagtaaaccacgtacccgtgaacggacgtaccgtaggaacggaccgtacggtcttacggtagtttacgttaccgtttaggtttacggtttttcggtcgttacgaccgttaaccgggtacgggggtaacctttaccggttacgacggtacgaaccggttccggggg

SEQ ID NO: 327656 - DNA, 742 bp, Homo sapiens
  misc_feature: GZ8MTXP02HMYFS.10.53.E09.1.454.CMB.2.raw
  modified_base (240)..(240): a, c, t, g, unknown or other
  misc_feature (240)..(240): n is a, c, g, or t
  modified_base (253)..(253): a, c, t, g, unknown or other
  misc_feature (253)..(253): n is a, c, g, or t
  modified_base (257)..(257): a, c, t, g, unknown or other
  misc_feature (257)..(257): n is a, c, g, or t
  modified_base (260)..(260): a, c, t, g, unknown or other
  misc_feature (260)..(260): n is a, c, g, or t
  modified_base (266)..(266): a, c, t, g, unknown or other
  misc_feature (266)..(266): n is a, c, g, or t
  modified_base (272)..(272): a, c, t, g, unknown or other
  misc_feature (272)..(272): n is a, c, g, or t
  modified_base (289)..(289): a, c, t, g, unknown or other
  misc_feature (289)..(289): n is a, c, g, or t
  modified_base (291)..(291): a, c, t, g, unknown or other
  misc_feature (291)..(291): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtggagtcgtgggggagcgtggtccagccgtgggacgtcccnagctctctgttancctntgntcactnagtatntcttgctacgtggtccncnggctccgaggcgagggcgtggaggtgggtgctagttatctctagtttgagtagggaataactaaaagttaaatacgttaacgagtaacgtaccgttcccggggttaccgggggacctacgttccaaccctacttacctaacccaaaaggtaacctaaagtttaacgaaacgtaaaccgtacgttacctttacgttaccgtacgtaaacgtaaaacgttacgaaaacgttaacggacccgtagggaaacgacggaccgtaagggaaccgggtaacgaaccgggtccgttagggtttaagtttaaccggttttaacggtttacgggtttttccggttttacggtttcggttaccgggtaccgggtttaccgggggttaaaccgggggttaaacctttaccggttaaccgtaacgggtcccgtacggggttccgggggacccggtaacccgggg

SEQ ID NO: 327657 - DNA, 791 bp, Homo sapiens
  misc_feature: GZ8MTXP02FME8B.10.53.E09.1.454.CMB.2.raw
  modified_base (239)..(239): a, c, t, g, unknown or other
  misc_feature (239)..(239): n is a, c, g, or t
  modified_base (262)..(262): a, c, t, g, unknown or other
  misc_feature (262)..(262): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggagcgtggtccagccgtgggacgtccctnagtactctcctgtttacgccctntggtattcaccttcagttagttatcctttgctacgtgggtcctcagacctccgaggcgaaggggtctgggaggtggggtggctaggtttatcgtctagtttgagttagggaataactaaaattaaaagtactaacgaggtacgtaacccgttccgggtttacgggggacccttaagttacccaacctacttaccctaaacccgtaaaaaggtaaccttaaaagttttaaacggaaaacgaaaccgtaaccggttacccgtttagttttacccgaacggtaaacctaaaaacgttaacggaaaaccgtaacgggtacccttaagggaaacgaaccgtagttacgggaacgggaaacccgtacggggtaccgtttaggttaggtttaacgtttaccggtttaggttttccgggtttttacggtttccgttaccggggttaaccgttaccgggggttaaccgggggttaaaacttaccccgtttaacggacggttacccgtaacggggttccgggggacccgtaaccggggg

SEQ ID NO: 327658 - DNA, 685 bp, Homo sapiens
  misc_feature: GZ8MTXP02FNT5O.10.53.E09.1.454.CMB.2.raw
  modified_base (172)..(172): a, c, t, g, unknown or other
  misc_feature (172)..(172): n is a, c, g, or t
  modified_base (238)..(238): a, c, t, g, unknown or other
  misc_feature (238)..(238): n is a, c, g, or t
  modified_base (252)..(252): a, c, t, g, unknown or other
  misc_feature (252)..(252): n is a, c, g, or t
  modified_base (256)..(256): a, c, t, g, unknown or other
  misc_feature (256)..(256): n is a, c, g, or t
  modified_base (266)..(266): a, c, t, g, unknown or other
  misc_feature (266)..(266): n is a, c, g, or t
  modified_base (335)..(335): a, c, t, g, unknown or other
  misc_feature (335)..(335): n is a, c, g, or t
  modified_base (350)..(350): a, c, t, g, unknown or other
  misc_feature (350)..(350): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagctgggttttcctcgttgctcttttaagnggtgtccagtgtcaggtgcagctggtggagtcgtgggggagcgtggtccagcctgggacgtccctnagactctctgttancctngattcacttnagtattatccttgcacgtgggtcctcaggcctcgaggcgaaggggctggaggtgggtgctagttatctntagtttgagtggaanaactaaattaaatactacgaggagtaccgttcccggggtttaccgggggacctatttacccgaaccctaacgttcctaacccgaaaacgtaaacctaaagtttaagaaacgtaaaccgaacgtactttcggtttactaggtaaccaaaacgtacgaaacgacgtaccgtaggaagtaacggcgtaacgggacgggaacgtacgggtacgttaggttacggttaacgtttacgtttacggttttcgggtttacggtttccgttacgggtaccgttcggggttaacgggggtaacttaccgttacggacgtaccgacgggtcgggacccggtacggg

SEQ ID NO: 327659 - DNA, 565 bp, Homo sapiens
  misc_feature: GZ8MTXP02I4OUQ.10.53.E09.1.454.CMB.2.raw
  modified_base (290)..(290): a, c, t, g, unknown or other
  misc_feature (290)..(290): n is a, c, g, or t
  modified_base (314)..(314): a, c, t, g, unknown or other
  misc_feature (314)..(314): n is a, c, g, or t
  modified_base (384)..(384): a, c, t, g, unknown or other
  misc_feature (384)..(384): n is a, c, g, or t
  modified_base (434)..(434): a, c, t, g, unknown or other
  misc_feature (434)..(434): n is a, c, g, or t
  modified_base (436)..(436): a, c, t, g, unknown or other
  misc_feature (436)..(436): n is a, c, g, or t
tcagcatagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactcctgcctgtgtctctgggcgagagggccacatcaactgcaagtccagccagtagttgtttatcagctccgacaataagaactacttagcttggtaccagcaagaaacccaggacngcctccaagctgctctatttacgnggcactccgtaccgggaactccccggggtccctgaccgtattcaggtcggcgaggcggggtctagggganaggtactttcactcttcaccatcacgcacgcctagcgagctaggaaacgngnggtcgcttagtttacttacgtgtacagtacaattaacttactaacgttaccctattacctacgtacgttccggacccgtacggaccgtaaaaggtcggaacaacgtacaaacgtaacgtggtacggtac

SEQ ID NO: 327660 - DNA, 606 bp, Homo sapiens
  misc_feature: GZ8MTXP02INCQ5.10.53.E09.1.454.CMB.2.raw
  modified_base (250)..(250): a, c, t, g, unknown or other
  misc_feature (250)..(250): n is a, c, g, or t
  modified_base (374)..(374): a, c, t, g, unknown or other
  misc_feature (374)..(374): n is a, c, g, or t
  modified_base (388)..(388): a, c, t, g, unknown or other
  misc_feature (388)..(388): n is a, c, g, or t
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagctgggttttcctcgttgcttcttttaagaggtgtccagtgtcaggtgcagctggtggagtcgtgggggaggcgtggtccagccgtgggacgtccctnagctctcctgttacgcctctgattcaccttcagttagttactcctttgctacgtcgggtccgtcgaggcctccgaggcgaggggctgggagtggggtgctagttactcctctatttgatggaanaactataaatacanagacgtctccgggttcgggacctataccgacactcaaccgaaagactaagttacgaaacacacgtacttagtttcagtaacaaatagaaaccagaccgtaggacgacgacgtggaacggacgtcgacgttggtactttaagttcgtttcggtttcgttttcggttcgtcggtaccggttccgggtacggggtaactttacccgttacgacggtaccgg

SEQ ID NO: 327661 - DNA, 675 bp, Homo sapiens
  misc_feature: GZ8MTXP02GRWIS.10.53.E09.1.454.CMB.2.raw
  modified_base (246)..(246): a, c, t, g, unknown or other
  misc_feature (246)..(246): n is a, c, g, or t
  modified_base (358)..(358): a, c, t, g, unknown or other
  misc_feature (358)..(358): n is a, c, g, or t
  modified_base (388)..(388): a, c, t, g, unknown or other
  misc_feature (388)..(388): n is a, c, g, or t
tcagcatagtagtgcacgaccggtgctcgatttagagagagtgtgttgggtttggggctgggagacgagcccagcactggaagtcgccggtgtttccattcggtgatcatcactgaacacagaggactcaccatggagtttgggctgagctgggttttcctcgttgcttcttttaagaggtgtccagtgtcaggtgcagctggtggagtcgtgggggaggcgtggtccagccgtgggacgtccctnagctctcctgttacgcctcgtggattccaccttcagttagttactccctttgcctacgtgggtcctcaggcctccgaggcgaaggggctgggagtggggtgctagttatctnatttgatggaagaacaaataaactactaanagagtacccgttccggttacggggcctattccacctactactaaccaaaagaacctaaagttacgaaaacgaaactaccgtacgttagtttacgagtaacctaaaagttacgaaacgacgtaccgagaaggaacggtcgtaaggaacggaccgaacgggtcgtaggttacgtttaacgtttacgttcggtttttaccggtttcgggtttaccgtacggttaccggttaacggggttaccggggtaaaccgtttacccgtacgtacggtaccggtacggtaccggggg

SEQ ID NO: 327662 - DNA, 740 bp, Homo sapiens
  misc_feature: GZ8MTXP02GPEQ1.10.53.E09.1.454.CMB.2.raw
  modified_base (242)..(242): a, c, t, g, unknown or other
  misc_feature (242)..(242): n is a, c, g, or t
  modified_base (361)..(361): a, c, t, g, unknown or other
  misc_feature (361)..(361): n is a, c, g, or t
tcagcatagtagtgcacgaccggtgctcgatttagagagagtgtgttgggtttgggggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtggagtcgtgggggagcgtggtccagccgtgggacgtccctnagactctcctgttagcctgtggattcaccttcagtacgctacggcatgctacgtcgggtcccaccaaacgtccgaggcaaggggtattgggagtggggtgctagtttcgttcagttcgnggagggctagtgttacaagttggtatcggacttcggaccgtccggtaggaacgggtcccgtattccgaaccgtactccgtaccgaagacgaacccgtaactacccgaaacggaaacctaacgtaaacgttggtttaaacgttacgggtaaccttacgtaaaaccgtacggtaacccgttaacggtacccgtagggaaacggacgtaacgggggttacttaacgttaaacgttacggttaaacgggtaaaccggggaaaagggggaaacggggggtaaacccgacgggggtaaccgggggttaacgttaaccggtaaaaccggtttaccgtttaccggtttaccgggtaaccgggttacgggtaccgggggtaaccccgg

SEQ ID NO: 327663 - DNA, 676 bp, Homo sapiens
  misc_feature: GZ8MTXP02FRSSW.10.53.E09.1.454.CMB.2.raw
  modified_base (175)..(175): a, c, t, g, unknown or other
  misc_feature (175)..(175): n is a, c, g, or t
  modified_base (244)..(244): a, c, t, g, unknown or other
  misc_feature (244)..(244): n is a, c, g, or t
  modified_base (592)..(592): a, c, t, g, unknown or other
  misc_feature (592)..(592): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagtcttgggttttcctcgttgcttcttttaagnggtgtccagtgtcaggtgcagcgtggtggagtcggtgggggagcgtggtccagccgtgggacgtccctnagtcctcttcgtgttagccctagtgtacttcaccttcagttagttactcctttgctacgttggtccgtcacggctcgaggcgaaggggctggtaggtgggtgctagtttactcgtagtagtttgaagtgggaaactaaactaaaacgttaaaataacctaacgtacggaacggtaacccggtttcccgggttaccgggggtaccctaactttacccaaaccctacttaaccaaacccgtaaaagaaaccttaaagtttaaacgaaaacggaacctacgttacgttacgtttacgagtaaacctaaagtacgaacacgaccgtaagacgacggcgaacggtacgacggnttagtacgttagttacgttggtttcgttcgttgtacgtcgtacggtacggtaactcgtcacgcgtaggtccggacgtcgtcccg

SEQ ID NO: 327664 - DNA, 688 bp, Homo sapiens
  misc_feature: GZ8MTXP02JV7C2.10.53.E09.1.454.CMB.2.raw
  modified_base (355)..(355): a, c, t, g, unknown or other
  misc_feature (355)..(355): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagcttgggttttcctcgttgctcttttaagaggtgtccagtgtcaggtgcagctggtggagtcgtgggggagcgtggtccagcctgggacggtccctcagcctctcctgttacgcctctggattccaccttcagttagttactcctttgcctacgtcgggtcctcgaggcctccgaggcgaaggggtctgggacggtgggtgctagttatctntatttgacgtggaagtaactaaataaactactaacaggtacgtaccgttccggtacggggacctacgttaccaaccgtactaccctaaaccaaaacgtaactaaatttaacgaaacgaaaccgtacgtaccgtttacgtttacctacgtaaaccgtaaaagttacgaaacgacgtacccgtaggaacgagtaccgtagggaacggaacgacggtacttggttatttacgtttacgtttcggttttcgtttcggttcgttacggtaccggttacgggttacggggtaacttaccgttacgacgtaccggtaccggtccggggaccgtaccgggg

SEQ ID NO: 327665 - DNA, 601 bp, Homo sapiens
  misc_feature: GZ8MTXP02I8FOL.10.53.E09.1.454.CMB.2.raw
  modified_base (174)..(174): a, c, t, g, unknown or other
  misc_feature (174)..(174): n is a, c, g, or t
  modified_base (192)..(192): a, c, t, g, unknown or other
  misc_feature (192)..(192): n is a, c, g, or t
  modified_base (241)..(241): a, c, t, g, unknown or other
  misc_feature (241)..(241): n is a, c, g, or t
  modified_base (260)..(260): a, c, t, g, unknown or other
  misc_feature (260)..(260): n is a, c, g, or t
  modified_base (301)..(301): a, c, t, g, unknown or other
  misc_feature (301)..(301): n is a, c, g, or t
  modified_base (339)..(339): a, c, t, g, unknown or other
  misc_feature (339)..(339): n is a, c, g, or t
  modified_base (342)..(342): a, c, t, g, unknown or other
  misc_feature (342)..(342): n is a, c, g, or t
tcagcatagtagtgcacgaccggtgctcgatttagagagagtgtgttgggtttgggggagacgagcccagcactggaagtcgccggtgtttccattcggtgatcatcactgaacacagaggactcaccatggagtttgggctgagcttgggttttcctcgttgctcttttaagnggtgtccagtgtcaggtncagctggtggagtcgtgggggagcgtggtccagccgtgggacgtccctnagctctcctgttacgcctntggattcaccttcagtagttatcctttgctactgggtcctnaggctccgaggcgaaggggctggagtgggtgctagttnctnatttgagtgagaacaataaatacacagataccgtccggttcggggcctagttccacctatcctacaaagactaattagaacaacacgtcttattacagtacaaatcgaaactagaccgtagacgagtcgtaggaacgacgtaccggcttaggtagtttactttacgtttggtttaccggttttcggttaccgttagtaccgttcggttacgggggtaacttcccgtagtacggaccgtacggtcggggacctaccgggg

SEQ ID NO: 327666 - DNA, 629 bp, Homo sapiens
  misc_feature: GZ8MTXP02I4SCR.10.53.E09.1.454.CMB.2.raw
  modified_base (231)..(231): a, c, t, g, unknown or other
  misc_feature (231)..(231): n is a, c, g, or t
  modified_base (315)..(315): a, c, t, g, unknown or other
  misc_feature (315)..(315): n is a, c, g, or t
  modified_base (344)..(344): a, c, t, g, unknown or other
  misc_feature (344)..(344): n is a, c, g, or t
  modified_base (349)..(349): a, c, t, g, unknown or other
  misc_feature (349)..(349): n is a, c, g, or t
  modified_base (367)..(367): a, c, t, g, unknown or other
  misc_feature (367)..(367): n is a, c, g, or t
tcagcatagtagtgcacgaccggtgctcgatttagagagagtgtgttgggtttgggggagctacaacaggcaggcagggggcagcaagatggtgttgcagacccaggtcttcatttctctgttgctctggatctctggtgccgtacggggacatcgtgatgacccagtctccagactccctgcctgtgtctctgggcgaggagggccaccatcaactgcaagtccagcagngttgttttatcagctaccgacaataagaactacttagcttggacagcaagaaaccaggacagcctcaagcagctctatttacgnggctatccgaccggagtcccccgggtccngactntcgagtggcgagcgggtntcgggactagtatttccaccttctaccaaccatcgacgtacacggcctagaccgaggcctaggaacgtacgtcggacgtaccgttaaggttttaactaacgttcgtaccgtaagtacccgtaaagtttaactttaaaccgttaaccgtaaaccccccttattaacccgtaaccgtacggttacccccgggtaccggtaccgggaaaaccgtaaggggtaaggaacgtaacctaaacgaaacccggtaacgtggtacgtaccg

SEQ ID NO: 327667 - DNA, 717 bp, Homo sapiens
  misc_feature: GZ8MTXP02G7ELN.10.53.E09.1.454.CMB.2.raw
  modified_base (237)..(237): a, c, t, g, unknown or other
  misc_feature (237)..(237): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggagcgtggtccagcctgggagtccctnagactctcctgtttacgcctctggattcaccttcagttagttatcctttgcacgtgggtcctcaggctccgaggcgaaggggctgggaggtggggtggctaggttactctctagtttgatggaataactaaataaatactaacagtacgtaccgtcccgggttacgggggacctatttccgaaccctacgtacctaacccgaaaacgtacctaaagtttagaaaacgtaaccgtaacgtacgttacgtttacgtacgtaaactaaaagttacgaaacctacgtacccttagggaacgtacgtacgtacgggaacgggaaccgtaaccgggtcgttaggttacgtttaaacgtttaacggtttcggttttaccgggttttacgggtttcgttacgggtaccggttcggggtttaaccgggggtaaactttacccgttaccgtaacggtaccgtaaccggtcgggggtacccgtaaccgggg

SEQ ID NO: 327668 - DNA, 717 bp, Homo sapiens
  misc_feature: GZ8MTXP02GLLEF.10.53.E09.1.454.CMB.2.raw
  modified_base (346)..(346): a, c, t, g, unknown or other
  misc_feature (346)..(346): n is a, c, g, or t
  modified_base (359)..(359): a, c, t, g, unknown or other
  misc_feature (359)..(359): n is a, c, g, or t
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagcttgggttttcctcgttgctcttttaagaggttgtccagtgtcaggtgcagctggtggagtcgtgggggaggcgtggtccagccgtgggacgtccctcgagactctccgttgttacgccctgtggatcacttcagtattactcctttgcactgggtcctgaggcctccgaggcgaaggggctgggagtggggngctagttatcctnatttcgattggaaagaactaagtaaactactaacgaagacgtaaccgttccgggttcgggggaccctaagttccaaccctaactacctaaaccgtaaaacgaaccttaaagtttagaaacgtaaaccgaacggtacttacgtttactacgtaacaaaacgttaacgaaaccaacggtcccttagggaacgtaacggaccggttaacggaacggggaaccgtaacgggtaccgttagggttacgtttaacgttttaacgtttacggtttttaccggggttttggtttaccttaacgggttaaaccgttccggggttaaccgggggtaactttacccgtttaccggtaaacgttacccgg

SEQ ID NO: 327669 - DNA, 721 bp, Homo sapiens
  misc_feature: GZ8MTXP02HROO3.10.53.E09.1.454.CMB.2.raw
  modified_base (197)..(197): a, c, t, g, unknown or other
  misc_feature (197)..(197): n is a, c, g, or t
  modified_base (247)..(247): a, c, t, g, unknown or other
  misc_feature (247)..(247): n is a, c, g, or t
  modified_base (269)..(269): a, c, t, g, unknown or other
  misc_feature (269)..(269): n is a, c, g, or t
  modified_base (284)..(284): a, c, t, g, unknown or other
  misc_feature (284)..(284): n is a, c, g, or t
  modified_base (355)..(355): a, c, t, g, unknown or other
  misc_feature (355)..(355): n is a, c, g, or t
  modified_base (359)..(359): a, c, t, g, unknown or other
  misc_feature (359)..(359): n is a, c, g, or t
tcagcatagtagtgcacgaccggtgctcgatttagagagagtgtgttgggtttgggggagacgagcccagcactggaagtcgccggtgtttccattcggtgatcatcactgaacacagaggactcaccatggagtttgggctgagtcttggggttttcctcgtttgcttacttttaagaggtgtccagtgtcaggtncagctgggtggagtcgtgggggagcgtggtccagccgtgggacgtccctnagacctctccttgttacgcctntagaacttcaccttnagttattactcctttgctacgtcggtcctcgaggtctccgaggacgaggggctggaggtgggtgctagttntctntattgatagggaataactaaaataaatacctaagagtacgtaccgttcccgggttaccgggggacctaacttccaaaccctacttaacccgtaaacgaaaacgtaaacttaacgtttaaagaaaacgtaaccgtacgttaccggtttctttaacctaggaaactaaacgtaacaaacggtacgtaaccgtaggaaggacggtaacgacgggaacggtacgtacggttacgtttaggttaacgtttacgtttaccggttttgggttttaccggtttggttaccgttacgggttaccggttacgggttaacggggtaaacctttcgtacgacggtacggtccggggttacggccggtaacccgg

SEQ ID NO: 327670 - DNA, 707 bp, Homo sapiens
  misc_feature: GZ8MTXP02FN5TP.10.53.E09.1.454.CMB.2.raw
  modified_base (243)..(243): a, c, t, g, unknown or other
  misc_feature (243)..(243): n is a, c, g, or t
  modified_base (274)..(274): a, c, t, g, unknown or other
  misc_feature (274)..(274): n is a, c, g, or t
tcagcatagtagtgcacgaccggtgctcgatttagagagagtgtgttgggtttggggctgggagacgagcccagcactggaagtcgccggtgtttccattcggtgatcatcactgaacacagaggactcaccatggagtttgggctgagctgggttttcctcgttgcttcttttaagaggtgtccagtgtcaggtgcatctggtggagtcgtgggggagcgtggtccagcccgggagtccctnagctctcctgttcgctcgtgacttcaccttnagttagttactcctttgcctacgtcgggtccctgacggtcctcgaggcgaaggggtctgggaggtggggtgctaggttactccttacgtagtttgagtggaaacgtaactaaaagtaaacttactacgaaggtacgtacccgttccggggttccggggacctaacttacctaacccgtaacttaccctaaacccgtaaaacgtaaacttaaacgtttaacggaaaaccgtaactaacgttccgtttacgtttacgtacggtaaacctaaaagtacgaaacacggtaccgtaggaacgagtacgtacggaacggaccgaacgggtcgttaggttacgttacgtttacgtttcgtttacggtttcggttcgtacggtacgttacgggtaacggggtaaccttaccgtacgtacgtccgtacggtcggggtaccgg

SEQ ID NO: 327671 - DNA, 650 bp, Homo sapiens
  misc_feature: GZ8MTXP02GPO87.10.53.E09.1.454.CMB.2.raw
  modified_base (331)..(331): a, c, t, g, unknown or other
  misc_feature (331)..(331): n is a, c, g, or t
  modified_base (611)..(611): a, c, t, g, unknown or other
  misc_feature (611)..(611): n is a, c, g, or t
tcagcatagtagtgcacgaccggtgctcgatttagagagagtgtgttgggtttgggggagctacaacaggcaggcaggggcagcaagatggtgttgcagacccaggtcttcatttctctgttgctctggatctctggtgccgtacggggacatcgtgatcgacccagtcctccagacctccctgcctgtcgtctcgtgggcgagacgggccaccatcaactgacaacgtccagccagtagttgttttactcagactaccgaacaaataagaactatagcttggaccagacaacgaaaccaggacacgccctactaagctgctatattacgnggacacgtccggtaacccgggtacgtccccccggggtaccctagacccgtattaccgaggtagggcgtacgggtcggggtacgtacggggaactagtactttaccgactcctaacaccctagtacagcacgcccgtagcgaggtcgtaagaaacgtgtaggtaccgtagttaagtttactaccgtagaactacgtactaacctttatttaaaccgacccgttaaccctacttacctaccgttacgttacccggacccggtaacggaaacgttaaaacggnggaaacgtaactaaccgtaaaacgtcgtagggtacgccg

SEQ ID NO: 327672 - DNA, 606 bp, Homo sapiens
  misc_feature: GZ8MTXP02GBJEZ.10.53.E09.1.454.CMB.2.raw
  modified_base (248)..(248): a, c, t, g, unknown or other
  misc_feature (248)..(248): n is a, c, g, or t
  modified_base (312)..(312): a, c, t, g, unknown or other
  misc_feature (312)..(312): n is a, c, g, or t
tcagcatagtagtgcacgaccggtgctcgatttagagagagtgtgttgggtttggggagctacaacaggcaggcaggggcagcaagatggtgttgcagacccaggtcttcatttctctgttgctctggatctctggtgcctacggggacatcgtgatgacccagtctccagactccctgcctgtgtctcgtgggcgagagggccaccatcaactgcaagtccagccagagtgttttatcagctccganaataagactacttagcttggaccagcaagaaaccaggacagccctctaagctgctcatttacgngggacagtctacccggggtaatccccggggtccctgaccgtattcgagttggcgtagcggggtcaggggaccaggtactttcacttcacaccatcagcacgctcgacgacgctagaacgtagtcggacggtactaggttttacttaccgtgttaccgagtcccttaacgtaactttacgtaaccggtacccctagtttaccaaacgttacgttacccgggtacccgttaacgggaaacccgtaaaacgggttggaaacgtaacgtaaccgaaaacgtaacgtcggtacggtacg

SEQ ID NO: 327673 - DNA, 790 bp, Homo sapiens
  misc_feature: GZ8MTXP02JNEMT.10.53.E09.1.454.CMB.2.raw
  modified_base (251)..(251): a, c, t, g, unknown or other
  misc_feature (251)..(251): n is a, c, g, or t
  modified_base (271)..(271): a, c, t, g, unknown or other
  misc_feature (271)..(271): n is a, c, g, or t
  modified_base (284)..(284): a, c, t, g, unknown or other
  misc_feature (284)..(284): n is a, c, g, or t
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagcgtggtggagtcgtgggggagcgtggtccagccgtgggacgtccctnagacctctcctgttagcctntggtatcaccttnagttagttactcctttgctacgttcgggtccgtcacgacctccgagggcgaagggggtctggggaggttcggggtggactaaggtttactcccgttactagtttgaagttagggaaagtaaacctaattaaaacgttaacctaaacgaaagggtaaccgtaacccggtttccccggggttaccgggggaacccgttacgttacccgtaaaccctaacgttacccctaaaaccgaaaacgtaacgtaaaacgtttaacgaaaaccgtaaaccgtaccgttaccgtttacgtttaccgtaacggtaaacctaaaaacgttacggaaaacccgtaacggtacccgttaggaacgggtaacgtacccggttaagggaaccggtaaccggtaacgggttccgttagggttacgtttaacgtttacgggtttcggttttacggtttcggttccgttaacgggtaccggttcggggtaaccggggtaactttcccgttacgtacggtacccgg

SEQ ID NO: 327674 - DNA, 715 bp, Homo sapiens
  misc_feature: GZ8MTXP02JG7JL.10.53.E09.1.454.CMB.2.raw
  modified_base (244)..(244): a, c, t, g, unknown or other
  misc_feature (244)..(244): n is a, c, g, or t
  modified_base (358)..(358): a, c, t, g, unknown or other
  misc_feature (358)..(358): n is a, c, g, or t
tcagcatagtagtgcacgaccggtgctcgatttagagagagtgtgttgggtttggggctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggagcgtggtccagccgtgggacgtccctnaagctctcctgttacgccttcgtggattcaccttcagttagttatcctttgctacgttcgggtccgtcacggcctccgagggcgaaggggctgggacggtggggtgcgtagttntcgtctagtttgagtaggaagtaactaaaagtaaactacgtaacaaggtaaccggtaccgttcccggggttaccgggggacctaagtttacccaaccctaacttacccgtaaccgaaaacgtaaccgttaaagtttaacggaaaacgtaaacctaacggttacgtttacgttttacgacggtaaacctaaaacgttacgaaaaccgtacggacccgttaaggaacgtacggtacgtaacgggaaccggaacgtacggtcgttacggttagttacgtttaccgttggtttcgtttcggttcgtacggtaccgtcgggtacggggtaaccttacccggtgaccgtacgtacggtcgggg

SEQ ID NO: 327675 - DNA, 783 bp, Homo sapiens
  misc_feature: GZ8MTXP02F4E9D.10.53.E09.1.454.CMB.2.raw
  modified_base (242)..(242): a, c, t, g, unknown or other
  misc_feature (242)..(242): n is a, c, g, or t
  modified_base (307)..(307): a, c, t, g, unknown or other
  misc_feature (307)..(307): n is a, c, g, or t
  modified_base (371)..(371): a, c, t, g, unknown or other
  misc_feature (371)..(371): n is a, c, g, or t
tcagcatagtagtgcacgaccggtgctcgatttagagagagtgtgttgggtttgggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcggtgggggaggcgtggtccagccgtgggacgtccctnagactctcctgttacgcctgtggtacttcaccttcagtagttactcctttgctacgtgggtcctnaggcctccgaggcgaaggggctgggaggtggggtgctaggtttatctctagtttgagtaggaanaactaaataaatactaagagtacgaccgttccgggttccggggacctacttaccgacctactaccgtaaaccaaagtaaacctaaagtttaacgaaaacgtaaccgtaacgttacgttacggtttacctacggtaaacctaaaacgtaacggtaaaaccgtaccggtacccggttaagggaacggtaacggtcggttaacgggaacgggtaaccggtacgggttaccgtttaggtttaaccggtttaagttttaccggttttagggtttttaccgggtttttacggggtttccgttaaccggggtttaacccgggtttaccgggggtttaaaccggggggtaaaccttttacccgggtttaacgaccgggttaccggtaccggggtaccgggggtacccggtaacccggggg

SEQ ID NO: 327676 - DNA, 756 bp, Homo sapiens
  misc_feature: GZ8MTXP02ITRYS.10.53.E09.1.454.CMB.2.raw
  modified_base (251)..(251): a, c, t, g, unknown or other
  misc_feature (251)..(251): n is a, c, g, or t
  modified_base (266)..(266): a, c, t, g, unknown or other
  misc_feature (266)..(266): n is a, c, g, or t
  modified_base (366)..(366): a, c, t, g, unknown or other
  misc_feature (366)..(366): n is a, c, g, or t
tcagcatagtagtgcacgaccggtgctcgatttagagagagtgtgttgggtttggggctgggagacgagcccagcactggaagtcgccggtgtttccattcggtgatcatcactgaacacagaggactcaccatggagtttgggctgagcgttgggttttcctcgttgcttcttttaagaggtgtccagtgtcaggtgcagcgtggtggagtcggtgggggagcggtggtccaggccgtgggacgtccctnagctctcctgttacncctctggtacttcacttcagttagttacttcctttgcacgtcgggtccgtcaggtcctccgagggacgaaggggctgggaggtggggtgacgtagtttanctctagtttagagtaggaagtaaactaaaagttaaaactcgtaaacgaggtacggtaccgttcccggggttaccgggggaccgtacttaccgaaccctacgttacctaaacccgaaagtaaacccgttaaaagtttaacgaaaacgaaacccgttaacggtactttacggttttacctaaagtaaaccgtaaaaagtttacggaaaaccgtaacggtacccgttaagaacggacgtaaccgtagggaaacgggtaaccgaacggtaccgtttggttaacgtttaagtttacgtttacggttttcgttttcggttacgttacggtacggtttaaccggggtaacggggtaacttttacccgtacggaacggtcggtaaacggtcccggggg

SEQ ID NO: 327677 - DNA, 851 bp, Homo sapiens
  misc_feature: GZ8MTXP02HPNPP.10.53.E09.1.454.CMB.2.raw
  modified_base (251)..(251): a, c, t, g, unknown or other
  misc_feature (251)..(251): n is a, c, g, or t
  modified_base (266)..(266): a, c, t, g, unknown or other
  misc_feature (266)..(266): n is a, c, g, or t
  modified_base (270)..(270): a, c, t, g, unknown or other
  misc_feature (270)..(270): n is a, c, g, or t
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagctgggttttcctcgttgcttcttttaagaggtgtccagtgtcaggtgcagctggtggagtcgtgggggaggcgtggtccagccgtggggacgtccctnagactctcctgttancctntgattcacttcagtagttatccttgctacgtgggtccgtcaggcctaccgaggaccgtaagggggtcttaggggaggttggggtcggacgtaggtttacttcccgttacgtaagtttttggaagttggggtaaaacgtaaacctaaagtttaaaactaacccgttaaacgaaacgggtaacggtaaccccgtttcccgggggttacccgggggtaccccgttaacgttacccgaaccctaacgtaccctttaaacccgaaaaaacgggttaaacccttaaagtttttaaacggaaaacgtaaaaccgtaccggtaccgttttacggttttaccgtaacggttaacgtaaaacgttacggaaaacgtaaccggtaccgttacgggaagtaacgggtaccgttaggggaaacggaaccggtaaccgggttgtttaccggttaaggttttaacgttttaacggttttacgggttttaccggttttacgggtttccggtttaacggggttaaacccggtttccgggggtttaaaccgggggtaaacctttacccccggtttaacggtaaccggttaaccccgggg

SEQ ID NO: 327678 - DNA, 592 bp, Homo sapiens
  misc_feature: GZ8MTXP02GFXD6.10.53.E09.1.454.CMB.2.raw
  modified_base (238)..(238): a, c, t, g, unknown or other
  misc_feature (238)..(238): n is a, c, g, or t
  modified_base (251)..(251): a, c, t, g, unknown or other
  misc_feature (251)..(251): n is a, c, g, or t
  modified_base (255)..(255): a, c, t, g, unknown or other
  misc_feature (255)..(255): n is a, c, g, or t
  modified_base (329)..(329): a, c, t, g, unknown or other
  misc_feature (329)..(329): n is a, c, g, or t
  modified_base (337)..(337): a, c, t, g, unknown or other
  misc_feature (337)..(337): n is a, c, g, or t
  modified_base (340)..(340): a, c, t, g, unknown or other
  misc_feature (340)..(340): n is a, c, g, or t
  modified_base (352)..(352): a, c, t, g, unknown or other
  misc_feature (352)..(352): n is a, c, g, or t
  modified_base (361)..(361): a, c, t, g, unknown or other
  misc_feature (361)..(361): n is a, c, g, or t
  modified_base (365)..(365): a, c, t, g, unknown or other
  misc_feature (365)..(365): n is a, c, g, or t
  modified_base (368)..(368): a, c, t, g, unknown or other
  misc_feature (368)..(368): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggagcgtggtccagccgtgggagtccctnagctctctgttancctntggattcaccttcagtagttactcctttgctacgtggggtcctcaggtctccgaggcaaggggctggagtgggngcagttanctntagttgatgganacaaataanctangancgtcggtcgggctattccactactactaccaaagactaattagaaagaccacgtcttacgttctagactaaatacgaacgacgcctagagacgcgtaggacgaacgacggactcggttagttactttacgttggtttcggtttacggtcgttacggtaccgttcggggttacgggggtaacttaccgttacgacgtaccgtacggtaccggggaccgtaccggg

SEQ ID NO: 327679 - DNA, 660 bp, Homo sapiens
  misc_feature: GZ8MTXP02JFQ0B.10.53.E09.1.454.CMB.2.raw
  modified_base (245)..(245): a, c, t, g, unknown or other
  misc_feature (245)..(245): n is a, c, g, or t
  modified_base (330)..(330): a, c, t, g, unknown or other
  misc_feature (330)..(330): n is a, c, g, or t
tcagcatagtagtgcacgaccggtgctcgatttagagagagtgtgttgggtttggggctgggagacgagcccagcactggaagtcgccggtgtttccattcggtgatcatcactgaacacagaggactcaccatggagtttgggctgagctgggttttcctcgttgcttcttttaagaggtgtccagtgtcaggtgcagctggtggagtcgtgggggagcgtggtccagccgtgggacgtccctnacgctctcctgttagcctctggtattcaccttcagttattacttccttgctacgttcgggtcctcaggcctccgaggcgaggggntggggaggtggggtggctagtttactcttactagtttgagtggaatactaaaagtaactacctaacgacggtaacgtcccgttcccgggttcgggggaccttacttacccgaacctactaccctaaccgtaaaacgtaaccttaaagttaacgaaacgtaaaccgtacggttcttacgtttaccgtagaactaaaacgtcgaaacacggtaccctaggaacgagtacgtaggacggaacgtcggtagtacgttagttacttacgttggtttcggtttcgtacgtgtacgtcggtacgggtaactaccgttgacgtacgtacggtaccggg

SEQ ID NO: 327680 - DNA, 539 bp, Homo sapiens
  misc_feature: GZ8MTXP02FLRCV.10.53.E09.1.454.CMB.2.raw
  modified_base (185)..(185): a, c, t, g, unknown or other
  misc_feature (185)..(185): n is a, c, g, or t
  modified_base (203)..(203): a, c, t, g, unknown or other
  misc_feature (203)..(203): n is a, c, g, or t
  modified_base (251)..(251): a, c, t, g, unknown or other
  misc_feature (251)..(251): n is a, c, g, or t
  modified_base (346)..(346): a, c, t, g, unknown or other
  misc_feature (346)..(346): n is a, c, g, or t
  modified_base (360)..(360): a, c, t, g, unknown or other
  misc_feature (360)..(360): n is a, c, g, or t
tcagcatagtagtgcacgaccggtgctcgatttagagagagtgtgttggggtttggggagctctgggagacgagcccagcactggaagtcgccggtgtttccattcggtgatcatcactgaacacagaggactcaccatggagttttgggctgagcttgggttttcctcgttgctcttttaaagnggtgtccagtgtcaggtncagctggtggagtcgtgggggagcgtggtccagcctgggacgtccctnagactctcctgttagctctggattcaccttcagtagttatcctttgcactgggtcctcaggctccgaggcaaggggctggagtgggtgcagttancctcattgatgganaacataaactactacagacgactccgtcggggcattcaccatctaccaaacactaaattagaacgaacaacgctgttactgacaaatagaacacgacctagagagcgtagagacgacggctggtatattacgtgttcgttggttctcgtactcggtacggggtataccgttacacgacg

SEQ ID NO: 327681 - DNA, 763 bp, Homo sapiens
  misc_feature: GZ8MTXP02HTQSB.10.53.E09.1.454.CMB.2.raw
  modified_base (243)..(243): a, c, t, g, unknown or other
  misc_feature (243)..(243): n is a, c, g, or t
  modified_base (280)..(280): a, c, t, g, unknown or other
  misc_feature (280)..(280): n is a, c, g, or t
  modified_base (383)..(383): a, c, t, g, unknown or other
  misc_feature (383)..(383): n is a, c, g, or t
tcagcatagtagtgcacgaccggtgctcgatttagagagagtgtgttgggtttgggggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtggagtcgtgggggagcgtggtccaggccgtgggacgtccctnagactctccttgttacgccttcgtggattccaccttnagttagttactcctttgctacgtcgggtccctgaggcctaccgaggcgaaggggctaggggaggtggggtgactagttactcgttctagtttgagtagggaanaactaaaattaaactacaacgacgtacgtaacccgttcccggggttaccgggggacctaactttacccaaacccgtattaccctaaaccgaaaaacgtaccgttaaaagtttaacgaaaacgtaaacctaacgttcttacggttttaccgagtaaaccgtaaaaagttcggaaaaccgtcgtacccgtagggaaacgtacggaccgtaggggaaaccgggaaccgtaccgggtcgttaagggttacgtttaacgtttacggttttcgggtttcgtttacgggttctacgggtaaccggtttaccgggggttaaccggggtaaaacttcccgttaacgacggtacccgtaccgggttaccgggggaaccgtaacccggggg

SEQ ID NO: 327682 - DNA, 685 bp, Homo sapiens
  misc_feature: GZ8MTXP02HWFBM.10.53.E09.1.454.CMB.2.raw
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtggagtcgtgggggagcgtggtccagccgtgggacgtccctcagactctcctgttacgcctctggacttcaccttcagttagttacttccctttgcctacgttggggtcccgtcgaggcctcccgaggccgaaggggctggggaggttggggtgactagtttactcctacgtattttgagttggaagaactaaagttaaaactactaaacgaggtaacgtacccgttccgggtttaccgggggacccgttaacttacccaacctaactacccttaaacccaaaaagtaaccttaaagtttaacgaaaacgtaaaccaccgtactttacggtttacttacgtaactaaaagtacgaaaccacgtaccgtagaagacgcgtaggaacgacgacggtcttaggtagttacgtttacgttggtttcgtttggttcgtgggtcgttacgggtacggggtaacttaccgttacgtacgtaccg

SEQ ID NO: 327683 - DNA, 647 bp, Homo sapiens
  misc_feature: GZ8MTXP02F0ECO.10.53.E09.1.454.CMB.2.raw
  modified_base (179)..(179): a, c, t, g, unknown or other
  misc_feature (179)..(179): n is a, c, g, or t
  modified_base (264)..(264): a, c, t, g, unknown or other
  misc_feature (264)..(264): n is a, c, g, or t
  modified_base (275)..(275): a, c, t, g, unknown or other
  misc_feature (275)..(275): n is a, c, g, or t
  modified_base (302)..(302): a, c, t, g, unknown or other
  misc_feature (302)..(302): n is a, c, g, or t
tcagcatagtagtgcacgaccggtgctcgatttagagagagtgtgttgggtttggggctgggagacgagcccagcactggaagtcgccggtgtttccattcggtgatcatcactgaacacagaggactcaccatggagtttgggctgagcttgggttttcctcgttgcttcttttaagnggtgtccagtgtcaggtgcagctggtggagtcgtgggggagcgtggtccaggcctgggacgtccctcagctctcctgttagcctntgattcacttnagtattatcctttgtactcgggtcctnaggcctcgaggccgaaggggtctgggaggtggggtgctagttatctctagtttgagtggaagaactaaataaactactacgagtacgtaccgttccggttcgggggacctattccacctatacctacaaaagtactaagttagaagaactacgtcttagttctagacaaatagaactacgacctagaacgacgacgtaggaacggtacgacggtacgttaggttagtttaacgtttacggttcggtttttaccggtttaggtttcgttacgggtacggttaccggggtaacgggggtaaaccttaccggttaccggacggtacgtaaccgggttcggggacccgg

SEQ ID NO: 327684 - DNA, 622 bp, Homo sapiens
  misc_feature: GZ8MTXP02FIMYR.10.53.E09.1.454.CMB.2.raw
  modified_base (200)..(200): a, c, t, g, unknown or other
  misc_feature (200)..(200): n is a, c, g, or t
  modified_base (249)..(249): a, c, t, g, unknown or other
  misc_feature (249)..(249): n is a, c, g, or t
  modified_base (267)..(267): a, c, t, g, unknown or other
  misc_feature (267)..(267): n is a, c, g, or t
  modified_base (365)..(365): a, c, t, g, unknown or other
  misc_feature (365)..(365): n is a, c, g, or t
  modified_base (499)..(499): a, c, t, g, unknown or other
  misc_feature (499)..(499): n is a, c, g, or t
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagcttgggttttcctcgttgctcttttaagaggtgtccagtgtcaggtncagctggtggagtcgtgggggagcgtggtccagccgtgggacgtccctnagactctctgttagcctngatcacttcagtgttatcctttgctacgtgggtccgtcacggtctccgaggcgaaggggctgggaggtgggtgctagttatcctctatttgatggaanaactaataaatactaacaggacgtaccgttcccgggttacggggacccgtacttaccacctactacctaccgaaaacaactaaagttagaaacgaaaccgaacgtcttacgtttactacgaacaaatacgaaanacgcctagagagacgtaggacggacgacggtactaggttagttactttacgttcgtttcggtttggttacgtaacggtaccgttacggggtacgggggtaacttaccgttaccgacgacccgg

SEQ ID NO: 327685 - DNA, 608 bp, Homo sapiens
  misc_feature: GZ8MTXP02FIC3B.10.53.E09.1.454.CMB.2.raw
  modified_base (247)..(247): a, c, t, g, unknown or other
  misc_feature (247)..(247): n is a, c, g, or t
  modified_base (256)..(256): a, c, t, g, unknown or other
  misc_feature (256)..(256): n is a, c, g, or t
  modified_base (331)..(331): a, c, t, g, unknown or other
  misc_feature (331)..(331): n is a, c, g, or t
  modified_base (411)..(411): a, c, t, g, unknown or other
  misc_feature (411)..(411): n is a, c, g, or t
tcagcatagtagtgcacgaccggtgctcgatttagagagagtgtgttgggtttgggggagctacaacaggcaggcaggggcagcaagatggtgttgcagacccaggtcttcatttctctgttgctctggatctctggtgccgtacggggacatcgtgatcgacccagtctccagacctccctgcctgtgtctcgtgggcgagacgggccaccatcaactgacaagtccagccagtagttgtttatcngctaccganaataagaactattagcgttgtaccagcaagaaaccaggaacacgcctaccgtaagctctcctactaagtttacgnggggtacacgtacccggtaaccccggggtaacgttcccccccggggtccctacggaaccgtacttcgaagggtcggacgngggtaccggtgtacgggatagtacttcactctacaccatcacgcactccagcgaagctaagaaacgtgtcggccggtatttaaggtttacttacgtcgtacacgtactattaagttaactaccctaaccctataccactacgtccgaccggtaacgaacgtaaggaacgagaacaacgaaacgtcgtacgtcgaccg

SEQ ID NO: 327686 - DNA, 744 bp, Homo sapiens
  misc_feature: GZ8MTXP02IA97W.10.53.E09.1.454.CMB.2.raw
  modified_base (241)..(241): a, c, t, g, unknown or other
  misc_feature (241)..(241): n is a, c, g, or t
tcagcatagtagtgcacgaccggtgctcgatttagagagagtgtgttgggtttgggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctgggtggagtcgtgggggagcgtggtccagccgtgggacgtccctnagctctcctgttagcctctggattcaccttcagttagttatcctttgctacgtcgggtcctgaggcctccgaggcaaggggctggaggtggtgctagtatctctatttgagtaggataactaaaataaatacctaacgaggacgtaccgttcccggggttaccggggccctaatttacccaaacccgtacttacccgtaacccgtaaaacgtaaaccttaaaagtttaaacgaaaacgtaaacccgtaaccggttacctttacgttttaccgtacggtaaaccgtaaaacgttaacggtaaaaccgtaacggtacccgttaggaaacgacggtaccgtacggaaacgggtaaccgtaccgggtacgttaggttacggtttaacgtttaacgtttacgggtttttcgggttttacggtttcggttacgtaccggtttaccgggttacgggggtaacttacccgttacgtacggtacgtacggtacggggtacccggtaccgggg

SEQ ID NO: 327687 - DNA, 760 bp, Homo sapiens
  misc_feature: GZ8MTXP02FWGC7.10.53.E09.1.454.CMB.2.raw
  modified_base (246)..(246): a, c, t, g, unknown or other
  misc_feature (246)..(246): n is a, c, g, or t
  modified_base (263)..(263): a, c, t, g, unknown or other
  misc_feature (263)..(263): n is a, c, g, or t
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggagcgtggtccagcctgggagtccctnagactctctgttagctntgattcacttcagtagttatcctttgctacgtgggtcctcacggctccgaggcgaaggggctgggaggtgggtgctagttactccgtactagtttgagttagggaataactaagtaaaacgtactaaacgaagtacgtaaccgtttcccgggggtttaccgggggacccgtaacgtttacccgaaccctaacttacccttaacccgaaaaacggaaacccttaaaagttttaacggaaaacgtaaaacccgtaaccgtaccgtttacgttttaccgttacggtaaccgtaaaacttacgggaaaaccgtaacgaaccgttaggaaacggtaacggaccggttacgggaaacgggtaaccggaaaccgggtacgttgggttacggtttaagtttaccgtttacgggtttttaccggttttacgggtttccgttaacggttaccggttacggggttaccggggggttaaactttacccgttaccggtacggtacccggg

SEQ ID NO: 327688 - DNA, 711 bp, Homo sapiens
  misc_feature: GZ8MTXP02JWTIF.10.53.E09.1.454.CMB.2.raw
  modified_base (269)..(269): a, c, t, g, unknown or other
  misc_feature (269)..(269): n is a, c, g, or t
  modified_base (381)..(381): a, c, t, g, unknown or other
  misc_feature (381)..(381): n is a, c, g, or t
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtggagtcgtgggggagcgtggtccagccgtgggacgtccctgagctctctgtttacgcctntggacttcaccttcagttagttactcctttgctacgtcgggtccgtcaggcctccgaggcgaaggggctggggagtggggtgctagtttatccgtactagtttgatgggaanaactaagtaaatactaacgaaggtacgtaccggttcccgggttacgggggacccgtacgttccacccgtactaccgtaaccctaaaagaacctaaacgtttaaggaaaccgtaaaccgtaaccgtaccgtttagtttaccgtagtaacgtaaaagttacgaaaacgtacgaccgtaggacggtagacgtacggaacggaacgtaacgggtcgttaggttacgtttaacgtttaacggtttcggttttcgggttttacggtttccgttaacggtaccggttaccgggggttacgggggttaacctttacccggtttacgacggtacccggg

SEQ ID NO: 327689 - DNA, 608 bp, Homo sapiens
  misc_feature: GZ8MTXP02GR31N.10.53.E09.1.454.CMB.2.raw
  modified_base (173)..(173): a, c, t, g, unknown or other
  misc_feature (173)..(173): n is a, c, g, or t
  modified_base (239)..(239): a, c, t, g, unknown or other
  misc_feature (239)..(239): n is a, c, g, or t
  modified_base (257)..(257): a, c, t, g, unknown or other
  misc_feature (257)..(257): n is a, c, g, or t
tcagcatagtagtgcacgaccggtgctcgatttagagagagtgtgttgggtttgggggagacgagcccagcactggaagtcgccggtgtttccattcggtgatcatcactgaacacagaggactcaccatggagtttgggctgagctgggttttcctcgttgctcttttaagnggtgtccagtgtcaggtgcagctggtggagtcgtgggggagcgtggtccagccgtgggacgtcctnagctctcctgttagcctngattcacttcagtagttatccgtttgctacgtgggtccgtcaggcctccgaggccgaaggggtctggggagtggggtgcgtagtttatctctagtttgagttgggataacaaattaaatacctagaggaacgtcgttaccggttcggggcctaattccacgatctaaccaaacgactaagttagaaacgaacacgtcgttgttacctagaactaaagtacgaacgtagaccgtaggagaacgcgtaggaggaacgacgcgtgtacgttagttacgtggtttcgttgttcgtacgtaccgttgggtacggggtaacttaccgtacgtcggacgtacggtcgggtacgaccgg

SEQ ID NO: 327690 - DNA, 634 bp, Homo sapiens
  misc_feature: GZ8MTXP02JGNCM.10.53.E09.1.454.CMB.2.raw
  modified_base (239)..(239): a, c, t, g, unknown or other
  misc_feature (239)..(239): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggagcgtggtccagccgtgggacgtccctnagactctcctgtttacgccttcgtggtacttccaccttcagttagttactcctttgctacgtcgggtccgtcacggcctccgaggcgaaggggctgggaggtgggtggctagttatctctatttgagtggaataactaaattaaaatactaacaggacgtaccgttcccggttacgggggacctaattccaacctactacctaaccaaaagaactaaagttacgaaagaacctacgtcttagttacagaacaaagtagaaacagcctagagagcgtagacggacacggtctgtattacgttacgttggtttacggtttcggttacgttcggtaccgttcggggtacggggtaacttaccgttacgacgtcgtacggtacggggaccgtaaccggg

SEQ ID NO: 327691 - DNA, 778 bp, Homo sapiens
  misc_feature: GZ8MTXP02G4O9W.10.53.E09.1.454.CMB.2.raw
  modified_base (404)..(404): a, c, t, g, unknown or other
  misc_feature (404)..(404): n is a, c, g, or t
  modified_base (419)..(419): a, c, t, g, unknown or other
  misc_feature (419)..(419): n is a, c, g, or t
tcagcatagtagtgcacgaccggtgctcgatttagagagagtgtgttgggtttggggctgggagacgagcccagcactggaagtcgccggtgtttccattcggtgatcatcactgaacacagaggactcaccatggagtttgggctgagcttgggttttcctcgttgcttcttttaaggaggtgtccagtgtcaggtgcaggcgtgggtggaggttcggtggggggagcggtggtccgaggccgtggggacggtccctcagtacctccttccttggtttacgcccttcgtggtactttcctaccttacgtagtttacgtttacttcccgttttgacctacgttcggggtccctcgacggtcctaccgagggacggtaaggggtcgtgggacgggttggggtcgnttaagtttatcgttnttatttaggaagttaggaaacgttaaacaaaattaaaacgtaccgtaaccgaagggtaaccgttaccgttacccggggtcggggtacctaacgttaccactaacgtacctaaacgaaaagtaactaaagtttacgaaacgaaccgtacgtaccgtttgtttaccaaggtaaacctaaaagtacgtaaaccgacgtacctaaggatacggacgtaggaacggttaccgagttactcggtttaacgtttaagtttaccggtttggttttacggtttttacggttcgtaacggttaccggtaacgggggtaccgggttaaacttaccggttacgaccggtacggttaccgggtacccggggg

SEQ ID NO: 327692 - DNA, 786 bp, Homo sapiens
  misc_feature: GZ8MTXP02IALII.10.53.E09.1.454.CMB.2.raw
tcagcatagtagtgcacgaccggtgctcgatttagagagagtgtgttgggtttggggctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagcgtggtggagtcgtggggggagcggtggtccagccgtgggacgtccctcagactctcctgttacgccctctggtacttccaccttcagttagtttactccctttgcctacgttcggggtccgtcgagggtcctacccgagggaccgaaagggggtctaggggagggtggggtggctaaggtttatcctatagtttgagtgggaataacaaaattaaaatacctaaacgaaggtaacgtacccgttccccgggttacgggggacccttacgttacccaacccgaacttacccgtaacccgaaaacgtaaaccttaaaagtttaaggaaaacgaaaccgtaaccggtacgtttacggtttacctacggtaaacctaaaagttacggaaaacgtacggacccgtaggaacggaacggtacgtagggaacgggaaccggaaccgggtaccgttgggttagtttaacgtttaaccggtttcgggttttaccggtttttcggggtttaccgttacgggttacccggttaaccggggttaaccgggggtaaaccttaccccgttacgacggtaccgtaccgggtacccggggg

SEQ ID NO: 327693 - DNA, 734 bp, Homo sapiens
  misc_feature: GZ8MTXP02HST12.10.53.E09.1.454.CMB.2.raw
  modified_base (218)..(218): a, c, t, g, unknown or other
  misc_feature (218)..(218): n is a, c, g, or t
  modified_base (243)..(243): a, c, t, g, unknown or other
  misc_feature (243)..(243): n is a, c, g, or t
  modified_base (399)..(399): a, c, t, g, unknown or other
  misc_feature (399)..(399): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgcgctgagcgttgggttttcctcgttgcttcttttaagaggtgtccagtgtcaggtgcagctgggtggagtcgtgggggagngtggtccagccgtgggacgtccctnacgtactctccttgttacgccttctggtacttcaccttcagttacgttactcctttgcctacgttggggtccctgtacggcctaccgagggtcgaagggggtcctggggtaggtggggttgactaggttactctcgttaagtttcgagttaggganaaacttaaataaaacgtctaccgaggaacgtaccgttcccgggttgggggacccttagtacccaacctataccctaacccgtaaaagacttaaagttagaaacgaacacggtacttacgtttctacggtaactaaaacgttagtaaaaccgcgttaccgtagaaccgtagacggtacggacggaaccggtaaccggtcgttacggttactttaaacggttttaccgttaggtttttcgggttttcgtttccgtacggttaccggttaccgggggttaacggggttaaaccttaccggtttacgacggtacccggtacggttccgggggaacccgg

SEQ ID NO: 327694 - DNA, 584 bp, Homo sapiens
  misc_feature: GZ8MTXP02F2O3A.10.53.E09.1.454.CMB.2.raw
  modified_base (264)..(264): a, c, t, g, unknown or other
  misc_feature (264)..(264): n is a, c, g, or t
  modified_base (346)..(346): a, c, t, g, unknown or other
  misc_feature (346)..(346): n is a, c, g, or t
  modified_base (349)..(349): a, c, t, g, unknown or other
  misc_feature (349)..(349): n is a, c, g, or t
  modified_base (362)..(362): a, c, t, g, unknown or other
  misc_feature (362)..(362): n is a, c, g, or t
  modified_base (381)..(381): a, c, t, g, unknown or other
  misc_feature (381)..(381): n is a, c, g, or t
tcagcatagtagtgcacgaccggtgctcgatttagagagagtgtgttgggtttgggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggaggcgtggtccaggccgtgggacggtccctcagactctcctgtttagccctntggattcaccttcagtattactctttgcacgtgggtcctcaggcctccgaggcgaaggggctgggaggtggggtgcagttanctnatttgatcggaanaacaaataaacactaacgngacgtacgtccggtcgggacctataccactactacaacaaagaactaattagaagacacgtcttcgttacagaacaaatagaacacgtactagagagcgtaggaacggacgacggtactagtacgttagttacgttgtttcgtttgttcgtacgtacgtcgggtacgggtaactaccgtcgacgcgacggtacgggacgacgg

SEQ ID NO: 327695 - DNA, 632 bp, Homo sapiens
  misc_feature: GZ8MTXP02FI314.10.53.E09.1.454.CMB.2.raw
  modified_base (156)..(156): a, c, t, g, unknown or other
  misc_feature (156)..(156): n is a, c, g, or t
  modified_base (235)..(235): a, c, t, g, unknown or other
  misc_feature (235)..(235): n is a, c, g, or t
  modified_base (256)..(256): a, c, t, g, unknown or other
  misc_feature (256)..(256): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagctgggttttccncgttgctcttttaagaggtgtccagtgtcagtgcagctgtgagtcgtggggagcgtggtccacccgtgggacgtccctnagactctcctgtttacgcctntggattccacttcagttcgttatcctttgctacgtgggtcctcaggcctccaggcaagggggctgggagtgggtaggcagttatctcatttgagtgagtacaataactacctacaggtacacgttcccggttcggggccatttccaacctattaccaacctaaacggacctaatttaaggaaacgaacaacgtcgttagtttctcgacaaacgtacgaaaccacgtaccgtagacggacgacgtaggaacggacgtacggtacgttagtaacgttaacgttacgtttacggtttcgtttacgttcgtacggttaccggtacgggtacgggtaacctaaccgtacgacggacgtacggtcgggaccgacggtacccg

SEQ ID NO: 327696 - DNA, 639 bp, Homo sapiens
  misc_feature: GZ8MTXP02FUWBC.10.53.E09.1.454.CMB.2.raw
  modified_base (247)..(247): a, c, t, g, unknown or other
  misc_feature (247)..(247): n is a, c, g, or t
  modified_base (260)..(260): a, c, t, g, unknown or other
  misc_feature (260)..(260): n is a, c, g, or t
  modified_base (263)..(263): a, c, t, g, unknown or other
  misc_feature (263)..(263): n is a, c, g, or t
  modified_base (272)..(272): a, c, t, g, unknown or other
  misc_feature (272)..(272): n is a, c, g, or t
  modified_base (331)..(331): a, c, t, g, unknown or other
  misc_feature (331)..(331): n is a, c, g, or t
tcagcatagtagtgcacgaccggtgctcgatttagagagagtgtgttgggtttggggctgggagacgagcccagcactggaagtcgccggtgtttccattcggtgatcatcactgaacacagaggactcaccatggagtttgggctgagcttgggttttcctcgttgcttcttttaaagaggtgtccagtgtcaggtgcagcgtggtggagtcgtgggggagcgtggtccagccgtgggagtccctnagctctctgttanctntgatcactnagtatatccttgctagtcggtcctcaggcctccgaggcgaaggggctagggagtggggngctagttatcgtctagtttgagtacgggaataactaaattaaatactacgaggtaacgacccgttccgggttacggggacctaacttaccacctaactacctaaccaaaagtaactaaagtttagaaaacgtaacacgtacgttacgtttacagtaaactaaagtacgaacaacggaccgtaggagacggaccgtaaggacggaacgacggtacgtagttcgttaatttacgttgtttacggtttcgttacgtacgtacgttaacgggtacggggtaacttaccgtcgaacgccgtaacggtccgggg

SEQ ID NO: 327697 - DNA, 689 bp, Homo sapiens
  misc_feature: GZ8MTXP02GHIKG.10.53.E09.1.454.CMB.2.raw
  modified_base (255)..(255): a, c, t, g, unknown or other
  misc_feature (255)..(255): n is a, c, g, or t
  modified_base (328)..(328): a, c, t, g, unknown or other
  misc_feature (328)..(328): n is a, c, g, or t
tcagcatagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagacctccctgcctgtgtctcgtgggcgagacgggccaccatcaactgacaagtccagccagtagttgttttatcagctaccganaataagaactacttagcttaggaccagcaacgaaaccgaggacacgccctactaagctgctactactttacgngggactacgtccgtaacccggggtaacgtcccccggggtaccctggacccgtattcgaaggttcgggcgacgggtcgggtacgtcggggaacctaggtactttccgaacctcgtaccaccacgttcaaagtccacgtcccgtacgacgacggtacgtaggaaacgtaggtcggcggttaccgtttaaggttttacttaaccgtcgttacgaacgtacctaaactttaactttaacgtaacccgttaacccttacgtttacccgtaaaccgttaacggttcccgggtacccgttaacgggaaacccgtaaaaggttaaggaaccgtaaactaccgtaaaacggtaccgttggtaccggtacg

SEQ ID NO: 327698 - DNA, 602 bp, Homo sapiens
  misc_feature: GZ8MTXP02GUJGI.10.53.E09.1.454.CMB.2.raw
  modified_base (192)..(192): a, c, t, g, unknown or other
  misc_feature (192)..(192): n is a, c, g, or t
  modified_base (242)..(242): a, c, t, g, unknown or other
  misc_feature (242)..(242): n is a, c, g, or t
  modified_base (262)..(262): a, c, t, g, unknown or other
  misc_feature (262)..(262): n is a, c, g, or t
  modified_base (349)..(349): a, c, t, g, unknown or other
  misc_feature (349)..(349): n is a, c, g, or t
  modified_base (363)..(363): a, c, t, g, unknown or other
  misc_feature (363)..(363): n is a, c, g, or t
tcagcatagtagtgcacgaccggtgctcgatttagagagagtgtgttgggtttgggggagacgagcccagcactggaagtcgccggtgtttccattcggtgatcatcactgaacacagaggactcaccatggagtttgggctgagctgggttttcctcgttgcttcttttaagaggtgtccagtgtcaggtncagctggtggagtcgtgggggaggcgtggtccagccgtgggaggtccctnagtactctcctgttacgctntgacttcaccttcagtacgttatcctttgctacgtggtcagtcaggctccgaggcaaggggctgggaggtgggtgctagtttatctntagtttgatggaanaactaaataaaatactacgagacgtaccttccgggttaccggggactacgttaccaccaactacctaacaaacgaactaaagtttacgaaagaaactacgacttgttacttacgactaaagtacgaacgacgacctagagagcgtagaagacgacgtagtgtacgttattacgttacgttgtttgttactcgtacgtacggtcggggaacttaccgtcgaacgtcacgtacgggaccgg

SEQ ID NO: 327699 - DNA, 663 bp, Homo sapiens
  misc_feature: GZ8MTXP02FI2A6.10.53.E09.1.454.CMB.2.raw
  modified_base (258)..(258): a, c, t, g, unknown or other
  misc_feature (258)..(258): n is a, c, g, or t
  modified_base (297)..(297): a, c, t, g, unknown or other
  misc_feature (297)..(297): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggagcgtggtccaggccgtgggaggtccctcagactctctgttagcctntggattcaccttcagtagttatccttgcactgggtcctnaggcctcgaggcgaaggggtctagggaggtggggtggactaggttatcctctaagttttgaacgtgggaacgaacaaaattaaaactactaacgaggacgtacgttcccgggttccgggggaccctagttaccacctaaacgtcctaaccgaaaagaactaaagtttaacgaaaagtaaccacggtacttgtttacgtagtaacaaaattacgaaacgtacgtccgtagggtaacgacgaccggtaggacgggacgtaacgggcttaggttaacgtagtttacgttggttttacggttggttacctgtaccgttcgggtaccgggtaattacccgtgtaacgccgtacggcggggtacgaaccggg

SEQ ID NO: 327700 - DNA, 610 bp, Homo sapiens
  misc_feature: GZ8MTXP02JMZB5.10.53.E09.1.454.CMB.2.raw
  modified_base (294)..(294): a, c, t, g, unknown or other
  misc_feature (294)..(294): n is a, c, g, or t
  modified_base (328)..(328): a, c, t, g, unknown or other
  misc_feature (328)..(328): n is a, c, g, or t
  modified_base (437)..(437): a, c, t, g, unknown or other
  misc_feature (437)..(437): n is a, c, g, or t
tcagcatagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatcgacccagtcctccagactccctgcctgtcgtctcgtgggcgagacgggccaccatcaactgacaagtccagccagtagttgtttatcagctccgaacaataagaactacttagcttaggaccagacaagaaaccnggacacgccctaccaagctgctcaacttttacgnggacaacgtccgtaaacccggggactccccccggggtccctaggaccctattcgaggtcggccgagggtcgggtacgtgggaactagtactttccacgtctaccgactntacgacgcacgcctgacgaggtactaggaagtagtcggacggtattaacggtttataacgtcgtacagtactacgttaacttacgtaccgtaccctattacctacgtacgttcccggaccgtacgggtaacctaaggcgaacgtaactacgaaaacgtcgttacggacgtacc

SEQ ID NO: 327701 - DNA, 784 bp, Homo sapiens
  misc_feature: GZ8MTXP02HS3AE.10.53.E09.1.454.CMB.2.raw
  modified_base (250)..(250): a, c, t, g, unknown or other
  misc_feature (250)..(250): n is a, c, g, or t
  modified_base (263)..(263): a, c, t, g, unknown or other
  misc_feature (263)..(263): n is a, c, g, or t
  modified_base (267)..(267): a, c, t, g, unknown or other
  misc_feature (267)..(267): n is a, c, g, or t
  modified_base (337)..(337): a, c, t, g, unknown or other
  misc_feature (337)..(337): n is a, c, g, or t
  modified_base (358)..(358): a, c, t, g, unknown or other
  misc_feature (358)..(358): n is a, c, g, or t
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctgggtggagtcgtgggggaggcgtggtccagccgtgggacgtccctnagactctctgttncctntggattcaccttcagtagttatcctttgctacgtcgggtccgtcaggcctccgaggcgaaggggctgggngtggggtgctagttactcctntagtttgagttggaagtaacaagttaaactactaaacgacgtaagtaacccgtttccggggttccggggaccgtaacttacccgacctacgttacctaaacccgtaaaacgtaaacttaaacgtttaacgaaaacgtaaaccgtacgtacgtttacgtttaccgttaacgtaaccgtaaaacgtaacggtaaaccgtaacggtacccgtagggtaaacggacggtacggttaacgggaaacgggaaacccggtacgggtaccggtttaacgggtttacgtttaaacggttttaaacggttttcgggtttttacggggtttttacggttttaccggtttaacgggttaacccggggtttacgggggtttaacccggggggttaaaaccttttaaaaccccggtttacggtaaaccggttacccgggg

SEQ ID NO: 327702 - DNA, 651 bp, Homo sapiens
  misc_feature: GZ8MTXP02HWIW8.10.53.E09.1.454.CMB.2.raw
  modified_base (245)..(245): a, c, t, g, unknown or other
  misc_feature (245)..(245): n is a, c, g, or t
  modified_base (262)..(262): a, c, t, g, unknown or other
  misc_feature (262)..(262): n is a, c, g, or t
  modified_base (266)..(266): a, c, t, g, unknown or other
  misc_feature (266)..(266): n is a, c, g, or t
  modified_base (460)..(460): a, c, t, g, unknown or other
  misc_feature (460)..(460): n is a, c, g, or t
tcagcatagtagtgcacgaccggtgctcgatttagagagagtgtgttgggtttggggctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtggagtcgtgggggagcgtggtcagccgtgggacgtccctnacgactctcctgttacncctntggattcaccttcagtagtttatcctttgcctacgtcgggtccgtcacggtcctccgaggacgaaggggcgtaggagtggggtgcgtagttatctctagtttgatgaagactaaataaatctaacgagacgtacgttccggtcggggactatccactactactacaaagaacttaaagtttagaaacgtaaacncggtacttagtttaccgtagtacaaagttacgaaactaggtaccctaggagacgttacgagggaacggaccgacggtctacggttagtttaacgtttacgttgggtttttacgtttaggttcgtacggtaccggttaaccggggtaacggggttaacttacccgtcgtaaccgtcgtacgggtaccggggg

SEQ ID NO: 327703 - DNA, 568 bp, Homo sapiens
  misc_feature: GZ8MTXP02JLM0V.10.53.E09.1.454.CMB.2.raw
  modified_base (258)..(258): a, c, t, g, unknown or other
  misc_feature (258)..(258): n is a, c, g, or t
  modified_base (374)..(374): a, c, t, g, unknown or other
  misc_feature (374)..(374): n is a, c, g, or t
  modified_base (463)..(463): a, c, t, g, unknown or other
  misc_feature (463)..(463): n is a, c, g, or t
  modified_base (506)..(506): a, c, t, g, unknown or other
  misc_feature (506)..(506): n is a, c, g, or t
tcagcatagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagacctccctgcctgtgtctcgtgggcgagacgggccaaccatcaactgacaagtccacgcagtagttgttttatcagtctaccgaanaaataacgaacttacttagcttacggtaccagacaagaaaccaggacagccctacgtaagctagctactatttacgcggactacgtccgtaacccgggagtccccccggggtaccngacccgtatccgagtcgggcacggcgggttctacggggctaacgtatttccactcctaccgcactcaagcagcctgcgagctagaagtncgcgtacttagttatctgacagcaacttatactacgtaccctnttacacgtcttcggacccgtgaaaccagtaacggacactaacgaaaacgtactcggagtacc

SEQ ID NO: 327704 - DNA, 714 bp, Homo sapiens
  misc_feature: GZ8MTXP02IG3DC.10.53.E09.1.454.CMB.2.raw
  modified_base (240)..(240): a, c, t, g, unknown or other
  misc_feature (240)..(240): n is a, c, g, or t
  modified_base (273)..(273): a, c, t, g, unknown or other
  misc_feature (273)..(273): n is a, c, g, or t
tcagcatagtagtgcacgaccggtgctcgatttagagagagtgtgttgggtttgggggagacgagcccagcactggaagtcgccggtgtttccattcggtgatcatcactgaacacagaggactcaccatggagtttgggctgagcgtggtttcgtcgttaggctctttaagaggtgtcagtgtcaggtgcagctgggtggagtctggggggagcgtggtccagccgtgggaggtccctnaagcctctctgtttagcctctggattcaccttnagttattactcttgctacgtcgggtccgtgcggcctaccgaggacggaacggggtcgtgggagggttggggtcgggacgttagttactctacgttagtttaggagtacgggaagtaaactaaaataaaactaaactaacgtagaacggtaccgttaccggttaccgggtaccgtacgtactacctaactacctaaccgtaaaacgtaaactaaacgttaaacgtaaaacgaaacgtaacgtacgttacgttacgtacgtaaacgtaaacgtaaacgaaacgaacgacgtacgagacgtacgtacggaacggacggtacgtacgtagttagttacgttacgtttacggtttcggtttcggttacggttacgttacgttacggtacggtaacgggtaaacgtaaccgttaccgtacggtaccggtacggtaccggggtaccgg

SEQ ID NO: 327705 - DNA, 652 bp, Homo sapiens
  misc_feature: GZ8MTXP02HRUK5.10.53.E09.1.454.CMB.2.raw
  modified_base (246)..(246): a, c, t, g, unknown or other
  misc_feature (246)..(246): n is a, c, g, or t
  modified_base (265)..(265): a, c, t, g, unknown or other
  misc_feature (265)..(265): n is a, c, g, or t
  modified_base (382)..(382): a, c, t, g, unknown or other
  misc_feature (382)..(382): n is a, c, g, or t
tcagcatagtagtgcacgaccggtgctcgatttagagagagtgtgttgggtttggggctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtggagtcgtgggggagcgtggtccagccgtgggacgtccctnagctctcctgttacgcctntggtacttcaccttcagttacgtttctcctttgctacgttgggtccctcgacggcctccgagggcgaaggggctagggagttggggtggctagtttatctcgtatttggactagganaactaaaattaaatactaacagtaacgtacccgttccggggtacggggaccctattaccgaacctattcctaaaaccgaaagtaacctaaaagtttacggaaaactaaaccgtagtaccgttgtttactacgaaactaaaagtcgaaacacgtccgtagaacggtacacgtaggaaggaccgtacggtcttaggttcgtttaattccgttgtttcgttgtctaggtacgtcgggtacggtaacttcgtcgaacgtcgtaacggtccgggg

SEQ ID NO: 327706 - DNA, 603 bp, Homo sapiens
  misc_feature: GZ8MTXP02GTVQZ.10.53.E09.1.454.CMB.2.raw
  modified_base (156)..(156): a, c, t, g, unknown or other
  misc_feature (156)..(156): n is a, c, g, or t
  modified_base (190)..(190): a, c, t, g, unknown or other
  misc_feature (190)..(190): n is a, c, g, or t
  modified_base (240)..(240): a, c, t, g, unknown or other
  misc_feature (240)..(240): n is a, c, g, or t
  modified_base (253)..(253): a, c, t, g, unknown or other
  misc_feature (253)..(253): n is a, c, g, or t
  modified_base (257)..(257): a, c, t, g, unknown or other
  misc_feature (257)..(257): n is a, c, g, or t
  modified_base (267)..(267): a, c, t, g, unknown or other
  misc_feature (267)..(267): n is a, c, g, or t
  modified_base (280)..(281): a, c, t, g, unknown or other
  misc_feature (280)..(281): n is a, c, g, or t
  modified_base (293)..(293): a, c, t, g, unknown or other
  misc_feature (293)..(293): n is a, c, g, or t
  modified_base (324)..(324): a, c, t, g, unknown or other
  misc_feature (324)..(324): n is a, c, g, or t
  modified_base (336)..(336): a, c, t, g, unknown or other
  misc_feature (336)..(336): n is a, c, g, or t
  modified_base (352)..(352): a, c, t, g, unknown or other
  misc_feature (352)..(352): n is a, c, g, or t
  modified_base (371)..(371): a, c, t, g, unknown or other
  misc_feature (371)..(371): n is a, c, g, or t
  modified_base (378)..(378): a, c, t, g, unknown or other
  misc_feature (378)..(378): n is a, c, g, or t
  modified_base (437)..(437): a, c, t, g, unknown or other
  misc_feature (437)..(437): n is a, c, g, or t
  modified_base (465)..(465): a, c, t, g, unknown or other
  misc_feature (465)..(465): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagctgggttttccncgttgctcttttaagaggtgtccagtgtcaggtncagctggtggagtcgtgggggagtcgtggtccagccgtgggacgtccctnagctctctgttancctnggatcacctnagtattatccttnntacgtggtccgntaggcctcgagcgaaggggctgggagtgggngactagttactntcatttgatacggaanaactaaataaactactaanacggtanaccgttccgggtcgggacctaatcgaccctatctaaaccaaagtactaaattagaaaanaacctatcgtattttcacggaataaaanaagtaacgacgtacgtagacgacgacgacggagacgacgtacgtagttagttacgttagtttcgtttcgtttcggttacgtacgtacgtacggtacggtaacgttacgtacgtacgtacgacggtacggacggtacgg

SEQ ID NO: 327707 - DNA, 717 bp, Homo sapiens
  misc_feature: GZ8MTXP02FKGWM.10.53.E09.1.454.CMB.2.raw
  modified_base (200)..(200): a, c, t, g, unknown or other
  misc_feature (200)..(200): n is a, c, g, or t
  modified_base (241)..(241): a, c, t, g, unknown or other
  misc_feature (241)..(241): n is a, c, g, or t
  modified_base (275)..(275): a, c, t, g, unknown or other
  misc_feature (275)..(275): n is a, c, g, or t
  modified_base (283)..(283): a, c, t, g, unknown or other
  misc_feature (283)..(283): n is a, c, g, or t
  modified_base (337)..(337): a, c, t, g, unknown or other
  misc_feature (337)..(337): n is a, c, g, or t
  modified_base (421)..(421): a, c, t, g, unknown or other
  misc_feature (421)..(421): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagctgggttttcctcgttgcttcttttaaagaggtgtccagtgtcaggtgcagctggnggagtcgtgggggagcgtggtccaggccgtgggacgtcctnagctctcctgttacgctgtgatcactcagtattntccttgcncgtggtcctcaggtcctcgaggcgaaggggctggaggttggtcgctaggttacnctatagtttgacgttgaacgtaacaaaataaaacgtaccaacaggtacgtaccgtcgggttaccggggactagttcccaaaccngttaacctaaacccgaaaagtacctaaagtttagaaaacgtaccgaactcgttacggtttacacgtaaacctaaagtacgaaaccctaggtacccttacgggaaaggtaacgccgtaggaaaccgggcgggaaaccgtacgttccgggttagtttaaaccgtttccggttaagggttttcggtttacccggggttagtcgggttaaaccggttaccccggggttagggggtaaaacctttaaaccccgtcggttaacgaccgttaccgggtaacgggggtcccctaaaaccggggg

SEQ ID NO: 327708 - DNA, 772 bp, Homo sapiens
  misc_feature: GZ8MTXP02FK3BL.10.53.E09.1.454.CMB.2.raw
  modified_base (240)..(240): a, c, t, g, unknown or other
  misc_feature (240)..(240): n is a, c, g, or t
  modified_base (258)..(258): a, c, t, g, unknown or other
  misc_feature (258)..(258): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggagcgtggtccaggccgtgggacgtccctnagactctctgttagcctntggatcacctcagtagttatcctttgcacgtgggtccgtcaggcctcgaggcgaaggggtctagggaggtggggtggacgtaggtttatcctacgtagttttgaagttcggaaagaaactaaaagttaaaactaaccgttaacgaggtaacgaaccgtttccggggtttccgggggaccctacgtttacccaaccgtaactacctaaacccaaaacgtaaaccgtaaagtttaagaaacgtaaaccacgtaccgtttaggtttacttacggtaacctaaaagtaacgaaaccgaacgtacccgttaagggtaacggaacgaccggtaggaaacgggtaacccggtaacgggtaccgtttaggggttaacgtttaaacgttttacccggttttagggtttttaccggggtttttcggtttaaccgttacggttaacccggtccggggtttaaccgggggtaaactttaacccgttcgtaacggtaccgtaacggtcgggggtaccgaacccgggg

SEQ ID NO: 327709 - DNA, 659 bp, Homo sapiens
  misc_feature: GZ8MTXP02JGK5J.10.53.E09.1.454.CMB.2.raw
  modified_base (268)..(268): a, c, t, g, unknown or other
  misc_feature (268)..(268): n is a, c, g, or t
  modified_base (284)..(284): a, c, t, g, unknown or other
  misc_feature (284)..(284): n is a, c, g, or t
tcagcatagtagtgcacgaccggtgctcgatttagagagagtgtgttgggtttgggggagctctgggagacgagcccagcactggaagtcgccggtgtttccattcggtgatcatcactgaacacagaggactcaccatggagtttgggctgagtcttggggttttcctcgttgcttcttttaagaggtgtccagtgtcaggtgcagctgggtggagtcgtgggggagcgtggtccagccgtgggacgtccctgagctctctgttacncctctgcttcaccttnagttattactcctttgctacgtcggtcctcgagctccgaggcgaaggggctgggaggttgggtgtagttatctctagttgagtaggaataactaaatactacgtaacgaaggtaccgtaccgttaccggggtccggggcctaattcccacctactacctaaccaaagtaactaagttaacgaaacgtactacgtctttagttaccgtaagaactaatacgtaacgagtaccgaggagacgagtaggaacggacgtcggtatttacggttaggttaacttaggtttcggttttcgtttacggttcgttacggtaaccggttacgggggtttaaccggggaactttacccggtacgtaccgggtacgtacccggggg

SEQ ID NO: 327710 - DNA, 646 bp, Homo sapiens
  misc_feature: GZ8MTXP02FI19A.10.53.E09.1.454.CMB.2.raw
  modified_base (242)..(242): a, c, t, g, unknown or other
  misc_feature (242)..(242): n is a, c, g, or t
  modified_base (261)..(261): a, c, t, g, unknown or other
  misc_feature (261)..(261): n is a, c, g, or t
  modified_base (354)..(354): a, c, t, g, unknown or other
  misc_feature (354)..(354): n is a, c, g, or t
tcagcatagtagtgcacgaccggtgctcgatttagagagagtgtgttgggtttggggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgtgggggaggcgtggtccaggccgtgggacggtccctnagactctcctgttagcctntggattcaccttcagtattatcctttgctacgtgggtcctcgaggcctccgaggcgaaggggctagggaggtggggtggctaggtttatcctntagtttgaacgtgggaacaactaaaattaaatactaacagacgtaccgttccgggttacggggacctacttacacctactcctaaccgaaaagtactaaagttagaaacgaactacgtattcgtttaccagtaaactaaatagaaaccacgtaccgtaggaagacgacgtaggacggaacgacggtacgtgtacgttaagttacgttggtttaccggtttggttaccgtacgtaaccggtcgggtacggggtaactacccgttagacgtcgacggtacggggccgaaccggg

SEQ ID NO: 327711 - DNA, 633 bp, Homo sapiens
  misc_feature: GZ8MTXP02HFKNC.10.53.E09.1.454.CMB.2.raw
  modified_base (236)..(236): a, c, t, g, unknown or other
  misc_feature (236)..(236): n is a, c, g, or t
  modified_base (275)..(275): a, c, t, g, unknown or other
  misc_feature (275)..(275): n is a, c, g, or t
  modified_base (296)..(296): a, c, t, g, unknown or other
  misc_feature (296)..(296): n is a, c, g, or t
  modified_base (341)..(341): a, c, t, g, unknown or other
  misc_feature (341)..(341): n is a, c, g, or t
tcagcatagtagtgcacgaccggtgctcgatttagagagagtgtgttgggtttggggagacgagcccagcactggaagtcgccggtgtttccattcggtgatcatcactgaacacagagactcaccatggagtttgggctgagctgggttttcctcgttgctcttttaagaggtgtccagtgtcaggtgcagctggtggagtcgtgggggagcgtggtccagcctgggagtccctnagactctcctgttagcctctgattcaccttcagtagttntcctttgctacgtgggtcctnaggcctccgaggcgaaggggctgggagtggggtgctagttatctntatttgactggaagacaaagtaactacaacagactacgtccggttacgggggcctaagttccaccactctaccaaaagtactaattagaagtaacacgtcttagttactagactaaagtagaacgtagaccgtagagagtcgtaggacggaacgtacgggtacgtagttaggttagtttaccgtttaggtttccgggttttaggtttccgttacggttaccggttaccgggttacgggggtaaattacccgtttacgacggtacgtaccggtacgggggtccgtaaccgggg

SEQ ID NO: 327712 - DNA, 631 bp, Homo sapiens
  misc_feature: GZ8MTXP02GAUDH.10.53.E09.1.454.CMB.2.raw
  modified_base (174)..(174): a, c, t, g, unknown or other
  misc_feature (174)..(174): n is a, c, g, or t
  modified_base (254)..(254): a, c, t, g, unknown or other
  misc_feature (254)..(254): n is a, c, g, or t
  modified_base (376)..(376): a, c, t, g, unknown or other
  misc_feature (376)..(376): n is a, c, g, or t
tcagcatagtagtgcacgaccggtgctcgatttagagagagtgtgttgggtttggggagctctgggagacgagcccagcactggaagtcgccggtgtttccattcggtgatcatcactgaacacagaggactcaccatggagtttgggctgagctgggttttcctcgttgcttnttttaagaggtgtccagtgtcaggtgcagctggtggagtcgtgggggaggcgtggtccaggtccgtgggacggtcccctnacgacttctccgtgtttacgccttctggtacttccaccttcagttagttacttccttgctacgttcgggtcgtcaggtctccgaggtcgaaggggtctggaggtgggtgctagttactcgtntagttgagtagaagtaataacgtaaatactagagtacgacgttccggttcgggccgtagttccacctactactaaccgaaaatactaagttagaaacgtacctacgtcttagttacctagtactaagtaacgaacgtacgtcctagagtaagtcgagacggaacgtacggtcgttaggtagttacttagttcggtttcgtttcggttctcggttacgttacgggtacggggtaacttccgtaacgcggtaaccgg

SEQ ID NO: 327713 - DNA, 501 bp, Homo sapiens
  misc_feature: GZ8MTXP01EDL1H.17.4.A04.1.454.CMB.2.raw
  modified_base (276)..(276): a, c, t, g, unknown or other
  misc_feature (276)..(276): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagagcctcctgcatagtgatggaaagcctattgattggtacctgcagaaggcaggccagtctccanatctctaatctatgaagtttccagtcgattctctggatgccagaataggttcagtggcagcgggtcaggcacagattcacactagaaaatcagccgggtggaggctgaggagtagttggggtttattacgtgcagtgactaaggttatttccttcgtggtaacgttcggcgaaagggaccgaaaggtaggaaagttcacaacgaacgtgtggcttgcaaccgtaa

SEQ ID NO: 327714 - DNA, 540 bp, Homo sapiens
  misc_feature: GZ8MTXP01BWO8F.17.4.A04.1.454.CMB.2.raw
  modified_base (272)..(272): a, c, t, g, unknown or other
  misc_feature (272)..(272): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccgcctccatctcctgcaagtctagtcagagcctcctgcatagtgatggaaatacctatttgattggtactgcagagcagccagtctcanatctactaatctatgtaagtttccagttcgattctccgtggagtgccagtaattaggttcagtgtcaggcgggtcaggcacagtattacacactagaaaatcgaggccgggtggagcgtagaggtagttagtttggggtttattacgtgtctagtgtacgtaaggttacgttttcccgttcggttcggtaacggttcggaccgtaagttcggaaccgtaagggttaggaaacttacaacgacgtaacgtggtcggctcgccgtaaccg

SEQ ID NO: 327715 - DNA, 520 bp, Homo sapiens
  misc_feature: GZ8MTXP01EBJ8D.17.4.A04.1.454.CMB.2.raw
  modified_base (308)..(308): a, c, t, g, unknown or other
  misc_feature (308)..(308): n is a, c, g, or t
  modified_base (419)..(419): a, c, t, g, unknown or other
  misc_feature (419)..(419): n is a, c, g, or t
tcagcgtagactagcacgaccggtgctcgatttagagtagtgatcaggacttctcagctcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagagcctcctgcatagtgatggaaagacctattgtattggtacctgcagaaggcaggccagtctcacatctctaatctatgagtttcagtcgattccnctggatgccaagatggttcaggtggcaggcgggtcaggcacagattcacactagaaaatcgaggccgggtggaggctaggaggggtattagtttaggggtttattacgtgntagtagtctaaggtttacttttccgtccggttggtacgttcggaccgttaaagggaaccgtaagggttaggaaattcaactaacgaacgtgtgctgctaac

SEQ ID NO: 327716 - DNA, 596 bp, Homo sapiens
  misc_feature: GZ8MTXP01CE02K.17.4.A04.1.454.CMB.2.raw
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccgcctccatctcctgcaagtctagtcagagcctctgcatagtgatggaaagtaccttattgattggtacctgacagaagcaggccagtctcacatctactaatctaatgtaagtttccagtcgtattctccgtggagtcgccaagtaattaggttcaggtggacgaggcggggtacagggacacagtatttacaacaactagaaaactcgaaggccgggtggagtgtaggaaggtagttacggttttagggggtttattacgtgtacgtagtgtaaccgtaaggtttacttttcccgttccgtagggtaaccgtttcgggacccgtaaacggggaaccgtaaagggttaagggaaacttcgaaaccggtaacgtaaaccgtggttacggcgttcggaaccgaaccgttaaccg

SEQ ID NO: 327717 - DNA, 562 bp, Homo sapiens
  misc_feature: GZ8MTXP01E0C5S.17.4.A04.1.454.CMB.2.raw
  modified_base (277)..(277): a, c, t, g, unknown or other
  misc_feature (277)..(277): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagagcctcctgcatagtgatggaaagcctatttgattggtacctgcagaaggcaggccagtctccanatctcctaatctatgaagtttccagtcgattctctggatgccagaataggttcagtggcaggcggggtcagggcacagatttcacactagaaaatcgagccgggtagaggctaggaggtagttagtttaggggtttattacgtgactagtgactaaggttacttttcccgttccggttgggtaaccgtttcgggaccgtaaacggggaacccgtaaagggtagggaaaacgttccgaacgaacggtaaacgtgggttcggacgttcggaaccgttaaccgtaacg

SEQ ID NO: 327718 - DNA, 570 bp, Homo sapiens
  misc_feature: GZ8MTXP01AL5F0.17.4.A04.1.454.CMB.2.raw
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagagcctctgcatagtgataggaaagacctatttgattggtacctgcagaagcaggcagtctcacatctactaatctatagtaagtttccagtcgtattctcgtggagtgaccagtaattagggttcaggtcgggcagggcggggtcagggcacagtattcacaactagaaaatcgaggccggggtggaggcgtaggtaagggtagtttaaggtttagggggtttaattacgtgtacgtagtgtacgtaaggtttacgttttccgttccgggtggtaacggttacggaccggaaacgggttaaaccgaaaggtaaggaaacttcgaacgaacgtaacgtgtggacttcgcgaaccgtaag

SEQ ID NO: 327719 - DNA, 539 bp, Homo sapiens
  misc_feature: GZ8MTXP01BZ4LI.17.4.A04.1.454.CMB.2.raw
  modified_base (235)..(235): a, c, t, g, unknown or other
  misc_feature (235)..(235): n is a, c, g, or t
  modified_base (266)..(266): a, c, t, g, unknown or other
  misc_feature (266)..(266): n is a, c, g, or t
  modified_base (522)..(522): a, c, t, g, unknown or other
  misc_feature (522)..(522): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccgcctccatctcctgcaagtctagtcagagcctcctgcatagtgatggaaanctattgatgactgcagagcagccagtctcantctctaatctatgtatttccagtcattctcctggatgccagtaattaggttcgagtgggcaggcggggtacagggcacagtattacacaactagaaaacgtcgacggccggggtaggaggacgtggaggtaggttagtttaggggtttattacgtgcgtagtgtactaaggttactttccgttcggtggtaacggttcggaccggtaacgggaccgtaagggtagttaaacgttcgaacgaacgtaacgtgtcggngttcgccgaaccgtaag

SEQ ID NO: 327720 - DNA, 619 bp, Homo sapiens
  misc_feature: GZ8MTXP01E1ETU.17.4.A04.1.454.CMB.2.raw
  modified_base (277)..(277): a, c, t, g, unknown or other
  misc_feature (277)..(277): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagagcctcctgcatagtgatggaaagcctatttgattggtacctgcagaaggcaggccagtctccanatctcctatctatagtagttacttcagtcttacttcctggtagtagtcgacgaaagttaggttcggtacgagggtcgacgacggggtcggacgacgtaccagtaagtttacttacaacctagtaaaagaacgtacggacggggtcgggaggacggtgaagggtaagggttagtttaggggttttaggtttaactggtcgtagtagttacgaacgtttaacggttttcctttcccggtagggtaacggtttaccgggttcccggaaacgggttaacggaaacggtaagggttaacttaaccgttacgaacgaacgttaacggtgcggttactcgaacctaacg

SEQ ID NO: 327721 - DNA, 561 bp, Homo sapiens
  misc_feature: GZ8MTXP01DMS9O.17.4.A04.1.454.CMB.2.raw
  modified_base (234)..(234): a, c, t, g, unknown or other
  misc_feature (234)..(234): n is a, c, g, or t
  modified_base (273)..(273): a, c, t, g, unknown or other
  misc_feature (273)..(273): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcaccctggacagccgcctccatctcctgcaagtctagtcagagcctcctgcatagtgatggaaanctattgattggtacctgacagaagcaggccagtctccanatctacctaatctatgtaagtttccagtcgattctctggagtcgcctagaattagggttcgaggtgggacgagggtcggggtcagggcaacgagtatttacacaacgttaagaaaagtcgaaggtccgggtaggaggcgtaggaggtagttaaggtttcggggtttaattacgtgctagttgtacgttaaggttacttttccgtcggtgggtaacgttcggacgtaagggaaccgtaaagggtacgaaacgttcacaacgtaacgtggtggcttgaaccaacgtaacg

SEQ ID NO: 327722 - DNA, 520 bp, Homo sapiens
  misc_feature: GZ8MTXP01EJ5YO.17.4.A04.1.454.CMB.2.raw
  modified_base (273)..(273): a, c, t, g, unknown or other
  misc_feature (273)..(273): n is a, c, g, or t
  modified_base (277)..(277): a, c, t, g, unknown or other
  misc_feature (277)..(277): n is a, c, g, or t
  modified_base (370)..(370): a, c, t, g, unknown or other
  misc_feature (370)..(370): n is a, c, g, or t
  modified_base (398)..(398): a, c, t, g, unknown or other
  misc_feature (398)..(398): n is a, c, g, or t
  modified_base (429)..(429): a, c, t, g, unknown or other
  misc_feature (429)..(429): n is a, c, g, or t
  modified_base (500)..(500): a, c, t, g, unknown or other
  misc_feature (500)..(500): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagagcctcctgcatagtgatggaaagccttatttgattggtacctgcagaaggcaggcagtcnccanatctactaatctatgtaagtttccagtcattctacgtgggagtgcccagtaagttaggttcaggtggcagggcgggtcaggcacagtattcanactagaaaatcgaggccgggtggacggntagagtagttagtttggggttattacgtgcngtgactaaggttctttccgtcgtggtcgtcggacgaacgggacgaagggtagaacgttcaagaaccgtagnggtgcttacgcaaccgtaag

SEQ ID NO: 327723 - DNA, 508 bp, Homo sapiens
  misc_feature: GZ8MTXP01D6GSN.17.4.A04.1.454.CMB.2.raw
  modified_base (314)..(314): a, c, t, g, unknown or other
  misc_feature (314)..(314): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagagcctcctgcatagtgatggaaagacctatttgattggtacctgcagaaggcaggccagtctccacatctcctaatctatgaagtttccagtcgattctccnggagtgccagaataggttcaggtgcagcgggtcagggcacagtatttcacactagaaaatcgaaggccgggtggaggcgtagaggtagttagtttggggtttattacgtgcatgactaaggttatttcgtcgtggtaacgttcggcgaagggaccgaaggtgaaacgttcacgaagaactgtgcttgcaactaa

SEQ ID NO: 327724 - DNA, 498 bp, Homo sapiens
  misc_feature: GZ8MTXP01BM7LC.17.4.A04.1.454.CMB.2.raw
  modified_base (267)..(267): a, c, t, g, unknown or other
  misc_feature (267)..(267): n is a, c, g, or t
  modified_base (271)..(271): a, c, t, g, unknown or other
  misc_feature (271)..(271): n is a, c, g, or t
  modified_base (370)..(370): a, c, t, g, unknown or other
  misc_feature (370)..(370): n is a, c, g, or t
  modified_base (493)..(493): a, c, t, g, unknown or other
  misc_feature (493)..(493): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccgcctccatctcctgcaagtctagtcagagcctctgcatagtgatggaacgacctattgattggtacctgcagagcagcagtcnccanatctctatctatgtagtttccagtcattctccgtggatgccagaataggttcagtggcagcgggtcaggcacagattcacactagaaaatcgagcgggngaggctagaggtagttagtttggggtttattacgtgcatgacgtaagttactttccgttcgtggtaacgtcggaccgaagggaccgaagggtagaacgttcacgaacgaacgtgtagcttgcncgtaa

SEQ ID NO: 327725 - DNA, 724 bp, Homo sapiens
  misc_feature: GZ8MTXP01DFV78.17.4.A04.1.454.CMB.2.raw
  modified_base (234)..(234): a, c, t, g, unknown or other
  misc_feature (234)..(234): n is a, c, g, or t
  modified_base (264)..(264): a, c, t, g, unknown or other
  misc_feature (264)..(264): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccgcctcatctcctgcaagtctagtcagacgcctctgcatagtgatggaaanctattgatgactgcagagcagcagtctcanatctactaatctatgtaactttccagtcgtattctccgtggagtcgaccagtaaagtacggtttcgagggtcgggcaaggggccggggtacgaacgggtaccaacgtaagttaactttaccgaaactaaaccgttaacggaaaaaaagttccggtaaacggggcccggggggttagggaacggggtacggttaaggggtaaagggttaaacggggtttaagggtttttaggggggtttttaaattaaccggttcgggaacttaagttagggttaaacggttaaaacggtttttaccgtttttacccggttcccgggttacggggttaacccggttaccggggttaacccgggaaaacggggttaaacccggtaaaaggggttaacggggaaaaacttaccgaaacgaaacccggtaaacggttaaggttcggccgttacggaaccgttaaccgttaaccg

SEQ ID NO: 327726 - DNA, 537 bp, Homo sapiens
  misc_feature: GZ8MTXP01C3S43.17.4.A04.1.454.CMB.2.raw
  modified_base (271)..(271): a, c, t, g, unknown or other
  misc_feature (271)..(271): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccgcctcatctcctgcaagtctagtcagagcctcctgcatagtgataggaaatcttatttgattggactgacagaaggcaggccagtcncacatctactaatctatgaatttcagtcattctctggagtgcagtaattaggttcaaggtcgggctaggggcgggtcgagggcacagtacttacactactaagaaaatcgaggccgggtggagctaggtaggtagttaggtttaggggtttaatacgtgctagtgtacgtaagttacgtttccgtcggtggtcggtcgacggtaagggaccgtaaagggtggaaacttcaacgaacgtacgtgacggtcttacgccgaaccgtaag

SEQ ID NO: 327727 - DNA, 512 bp, Homo sapiens
  misc_feature: GZ8MTXP01DB3CJ.17.4.A04.1.454.CMB.2.raw
  modified_base (343)..(343): a, c, t, g, unknown or other
  misc_feature (343)..(343): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagagcctcctgcatagtgatggaaagacctattgtattggtacctgcagaaggcaggccagtctccacatctctaatctatgaagtttccagtcgattctctggagtgcagatagttcagtggcaggcgggtnagggcacagatttcacactagaaaatcgaggccgggtggagctagaggtagttagtttggggtttattacgtgcagtgactaaggttattttccgtcgtggtaacgttcggacgaacgggaccgtaaagggtggaaacttcaacaacgaacgtgtggcttgcaacgtaa

SEQ ID NO: 327728 - DNA, 593 bp, Homo sapiens
  misc_feature: GZ8MTXP01B75M5.17.4.A04.1.454.CMB.2.raw
  modified_base (273)..(273): a, c, t, g, unknown or other
  misc_feature (273)..(273): n is a, c, g, or t
  modified_base (276)..(276): a, c, t, g, unknown or other
  misc_feature (276)..(276): n is a, c, g, or t
  modified_base (280)..(280): a, c, t, g, unknown or other
  misc_feature (280)..(280): n is a, c, g, or t
  modified_base (420)..(420): a, c, t, g, unknown or other
  misc_feature (420)..(420): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagagcctcctgcatagtgataggaaagtaccttatttgattggtacctgcagaagcgacgctntcncatntctactatctatagtacttcagtcgtattctcgtggagtcgacagtaagttacggtcgagggtcggcgacgggtcgggtacgacggacacgtattacttacaactacgtaaagaaactcggacgggtcggggaggacgtntagggaggttaggttagggttttaggggtttactacgtgactgtcgtaacgttagttttacctttccggtacgggtggtaaccgggttccggaacggaaacggaccgtaaagggtacggttaaacttccgaacggtaacgtacgtgggtacgcttacgaaccgttcgttaacg

SEQ ID NO: 327729 - DNA, 539 bp, Homo sapiens
  misc_feature: GZ8MTXP01ALLTE.17.4.A04.1.454.CMB.2.raw
  modified_base (235)..(235): a, c, t, g, unknown or other
  misc_feature (235)..(235): n is a, c, g, or t
  modified_base (276)..(276): a, c, t, g, unknown or other
  misc_feature (276)..(276): n is a, c, g, or t
  modified_base (308)..(308): a, c, t, g, unknown or other
  misc_feature (308)..(308): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccgcctccatctcctgcaagtctagtcagagcctcctgcatagtgatggaaanccttattgtattggtacctgcagaaggcaggccagtctcanatctactaatctatgaatttccagtcgattcnctggagtgccagaatagggttcagtggcaggcgggtacagggcacagtattcacactagaaaatcgaggccgggtggaggcgtagaggtaggttagttggggtttattacgtgcagtgtacgtaaggttactttccgttccggttggtaaccggttcggaccgtaaacgggaaccgtaaagggtaggaaacgttcaacgaacgaacgtgtacggcgttcgcgaacgtaacg

SEQ ID NO: 327730 - DNA, 537 bp, Homo sapiens
  misc_feature: GZ8MTXP01DXQXR.17.4.A04.1.454.CMB.2.raw
  modified_base (278)..(278): a, c, t, g, unknown or other
  misc_feature (278)..(278): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagagcctcctgcatagtgataggaaagtcctatttgattggtacctgcagaagcaggccagtctccanatctactaatctatgtaacgtttccagtcgattctcgtgggagtgaccagtaattaggttcgaggtggctagggcggggtcagggtcacagtatttcaactactagaaaactcgaggccgggtggagcgtagaggtagttaggtttggggtttattacgtgctagtgtacgtaaggttacttttccgttcggtggtaacgttcggacgaacggacgaagggtagaaagttcacgaagaacgtgtggcttgcaacgtaag

SEQ ID NO: 327731 - DNA, 507 bp, Homo sapiens
  misc_feature: GZ8MTXP01EOH87.17.4.A04.1.454.CMB.2.raw
  modified_base (213)..(213): a, c, t, g, unknown or other
  misc_feature (213)..(213): n is a, c, g, or t
  modified_base (270)..(270): a, c, t, g, unknown or other
  misc_feature (270)..(270): n is a, c, g, or t
  modified_base (300)..(300): a, c, t, g, unknown or other
  misc_feature (300)..(300): n is a, c, g, or t
  modified_base (383)..(383): a, c, t, g, unknown or other
  misc_feature (383)..(383): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccgcctccatctcctgcaagtctagtcagancctctgcatagtgataggaaatcttattgattggactgacagagcagcagtctcatntctactaatctatgtaagttcagtcattcnctggatgccagaattaggtcagtggcaggcgggtcaggcactagtacttacaacactaagaaaactcgaggcgggtaggacgngtaggaggtagttaagtttggggtttaattacgtgctagtgtacgtaaggttctttccgtcgtggtaacgttcggacgaaggacgaaggtagaacttcactaacgagtgtggcttgcaactaag

SEQ ID NO: 327732 - DNA, 524 bp, Homo sapiens
  misc_feature: GZ8MTXP01BZ1N0.17.4.A04.1.454.CMB.2.raw
  modified_base (275)..(275): a, c, t, g, unknown or other
  misc_feature (275)..(275): n is a, c, g, or t
  modified_base (349)..(349): a, c, t, g, unknown or other
  misc_feature (349)..(349): n is a, c, g, or t
  modified_base (355)..(355): a, c, t, g, unknown or other
  misc_feature (355)..(355): n is a, c, g, or t
  modified_base (524)..(524): a, c, t, g, unknown or other
  misc_feature (524)..(524): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagagcctctgcatagtgataggaaatctattgattggtacctgacagaagcaggccagtctccantctactaatctatgtaagtttccagtcgattctcgtggatgaccagtaattaggttcaggtgggcaggcgggtnaggcanagtattcacactagaaaatcgaggcgggtggagcgtagaggtagttaggtttggggtttattacgtgtctagtgtacgtaaggttactttccgttcggtggtaacggttcggacggtaacgggacgtaaggtaagaagttcacgaagtacgtgtggcgttcgcaacgtn

SEQ ID NO: 327733 - DNA, 506 bp, Homo sapiens
  misc_feature: GZ8MTXP01EN75E.17.4.A04.1.454.CMB.2.raw
  modified_base (235)..(235): a, c, t, g, unknown or other
  misc_feature (235)..(235): n is a, c, g, or t
  modified_base (272)..(272): a, c, t, g, unknown or other
  misc_feature (272)..(272): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagagcctctgcatagtgatggaaanctatttgattggtacctgcagaagcagccagtctcanatctcctaatctatgaagtttccagttgattctctggatgccagaataggttcagtggcaggcgggtcagggcacagtattcacactagaaaatcgagccgggtggagctagaggtagtagtttggggtttattacgtgcatgactaaggttactttccgttcgtggtaacgttcggaccgtaaagggaccgaaggtaggaaattcacaacgaactgtgcgttgccaacgtaac

SEQ ID NO: 327734 - DNA, 622 bp, Homo sapiens
  misc_feature: GZ8MTXP01ESQOT.17.4.A04.1.454.CMB.2.raw
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagagcctcctgcatagtgataggaaagtaccttatttgtattggtacctgacagaaggcaggccagtcctccacatctacctaattctatagtagtttccagtcgattctcgtggagtgaccagtaagttaggttcagggtggacgagggcggggtcagggcacgagtactttacgactaacttaggaaaactcgaacgggtccggggtaggaggtcgtaggtaaggttaaggtttaggtttaggggtttaattcgtagtctaagtggtacgttaaaggtttcttttaccgtccggttgggtaaccggttcgggaaccgtaaacggggaaccgtaaaggggttaacgaaaacgttccgaaacgtaaccggtaagttcgggtcggtccgttacggaaccgttaacccgttaag

SEQ ID NO: 327735 - DNA, 547 bp, Homo sapiens
  misc_feature: GZ8MTXP01ARJ8G.17.4.A04.1.454.CMB.2.raw
  modified_base (393)..(393): a, c, t, g, unknown or other
  misc_feature (393)..(393): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagagcctcctgcatagtgatggaaagcctatttgattggtacctgcagaaggcaggccagtctcacatctcctaatctatgtaagtttccagtcgattctcctggatgccagtaatagggttcaggtggcaggcgggtcagggcacagattcacactagaaaatcgaggccgggtggacgggngtagaggtaggttagtttaggtttagttacgtgtgtagtagtacgtacgttacgtttccgttccggttcggtaacggtcggttaccggaacggacgtaacggtaaggaacgttacgacgaacgtacgtcgtcggtcgttcgtccgaacgtaacg

SEQ ID NO: 327736 - DNA, 541 bp, Homo sapiens
  misc_feature: GZ8MTXP01DVO44.17.4.A04.1.454.CMB.2.raw
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcaccctggacagccgcctcatctcctgcaagtctagtcagagcctctgcatagtgataggaaatctattgattggactgacagagcagcagtctcatatctactaatctatagtaagttccagtcattctcgtggatgacagatgtcagtgcagcgggtcaggcacagtattacactactagaaaatcgaggccgggtaggaggcgtaggtaaggtagtttaggtttaggggtttattacgtgtacgtagtagtacgtaaggtttacttttacccgttcgtcgggtaacgttcggacgtaaacggaccgtaaggtaaggaaacttcgaacgtaacgtaacgtggttacggcgttgtaaccttaaccgttaag

SEQ ID NO: 327737 - DNA, 587 bp, Homo sapiens
  misc_feature: GZ8MTXP01C3ZQ2.17.4.A04.1.454.CMB.2.raw
  modified_base (581)..(581): a, c, t, g, unknown or other
  misc_feature (581)..(581): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccgcctccatctcctgcaagtctagtcagacgcctcctgcatagtgataggaaagtaccttattgatggtactgcagagcaggccagtctacacactctactatctatgaactttcagtcgattctctggagtgacctagtaacttaggttcgaaggtgggactagggccgggtacgacgggcacgtagtactttacgaactaacgttaagaaaacgtcgaagggtccggggtaggaagcgtagggtaggttaaggttaacggtttggggtttaattacggtgtacgtaagttcgtacgtaaggtttccgttttaccgtccggttagggtaaccggttcggaacggtaaacggaccgtaaagggtgaaacgttcacgaacgacgtgtaggcttgaaccncgtaac

SEQ ID NO: 327738 - DNA, 626 bp, Homo sapiens
  misc_feature: GZ8MTXP01BXJ6V.17.4.A04.1.454.CMB.2.raw
  modified_base (273)..(273): a, c, t, g, unknown or other
  misc_feature (273)..(273): n is a, c, g, or t
  modified_base (315)..(315): a, c, t, g, unknown or other
  misc_feature (315)..(315): n is a, c, g, or t
  modified_base (333)..(333): a, c, t, g, unknown or other
  misc_feature (333)..(333): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagagcctctgtatagtgataggaaataccttatttgtatggtactgacagaagcaggcagtcnccacatctctaatctatgtaagtttccagtcattctcgtggntgccagagtaagggttcnggtgcagggtcgggtcagggcactagtactttacaactactaagtaaaagtcgaacgggtccggggtagggaggcgtagggtaagggttaagttaagggggttttaggggttttaatttaaccgtggtaacgtaagttggtaaccgtttaaaggtttacgttttacccgttccgggttacgggtaccgggttaaccggtacggaaacggggtaaccgttaaagggtttaaagaaacttacgaacgttaacggtaaacgttggtcggtctacggaccctaacttaacgtttccg

SEQ ID NO: 327739 - DNA, 540 bp, Homo sapiens
  misc_feature: GZ8MTXP01DPO5M.17.4.A04.1.454.CMB.2.raw
  modified_base (280)..(280): a, c, t, g, unknown or other
  misc_feature (280)..(280): n is a, c, g, or t
  modified_base (353)..(353): a, c, t, g, unknown or other
  misc_feature (353)..(353): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagagcctcctgcatagtgatggaaagtcctatttgtattggtacctgacagaaggcaggccagtctccanatctactaatctatgtaacgtttccagtcgattctccgtggagtgccagtactaggttcagtggcagcgggtnaggcacagtattcactactagaaatcgaggccgggtggaggcgtaggaggtaagttaggtttggggtttaattacgtgtactagtagaactaaagtataactacgtcttaaccgtattacgtttcggacgtaacggggaccaagttcgttaggaagtagtaacgaaacgtacgttaggtggaactcg

SEQ ID NO: 327740 - DNA, 716 bp, Homo sapiens
  misc_feature: GZ8MTXP01D7IJ2.17.4.A04.1.454.CMB.2.raw
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagagcctcctgcatagtgataggaaagtccttattgactggtacctgcaggaagcaggccagtctccacactctactaatctatagtaacgtttcagtcgattctctggagtgaccagtaagttaggttcgaggtcgggacgacgggtcggggtacgaagggccaaccgtagttaactttaccaacgtaactaaggtaaaaacgttcggaacgggtcccgggggtagggacgggtacgtagggtaaggggttaagggttttaaagggtttttaggggggtttttaaactttaccggttaggtaccgtaagttcggttaaacggtttaaacggggttttaaccgttttttccccggtttaccgggttcggggttaacccgggtttaccggggaacccggtaaacggggttaaacccggtaaaggggtaacgggttaaaacttccggaaccgtaaccggtaaaccgttgggttaccggacgttacggtaacccgttaacccttaaccg

SEQ ID NO: 327741 - DNA, 537 bp, Homo sapiens
  misc_feature: GZ8MTXP01EAJG4.17.4.A04.1.454.CMB.2.raw
  modified_base (236)..(236): a, c, t, g, unknown or other
  misc_feature (236)..(236): n is a, c, g, or t
  modified_base (273)..(273): a, c, t, g, unknown or other
  misc_feature (273)..(273): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagagcctcctgcatagtgatggaaanacctattgattggtactgcagaagcagccagtctcanatctctaatctatgaagtttccagtcgattctccgtggagtgccagaatagttcagtggcagcgggtcaggcacagtattcacactagaaaatcgaagcgggtggaggctaggaggtagttagtttaggggtttatacgtgctagtgtacgtaaggttactttccgttccggtgggtaacggttcgggaccgtaaacgggacgtaaagggtaggaaacgttcgaacgtaacgtaacgtcggtaggcgttagtccgaacgtaacg

SEQ ID NO: 327742 - DNA, 507 bp, Homo sapiens
  misc_feature: GZ8MTXP01ANE90.17.4.A04.1.454.CMB.2.raw
  modified_base (311)..(311): a, c, t, g, unknown or other
  misc_feature (311)..(311): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagagcctcctgcatagtgatggaaagacctatttgattggtacctgcagaaggcaggccagtctccacatctcctaatctatgaagtttccagtcgattcnctggagtgccagaataggttcagtggcaggcgggtcagggcacagatttcacactagaaaatcaggccgggtgggaggctgaggagtagtttggggtttattacgtgcagtgacgtaaggttattttccgttccgtggtcggttcggccgaagggaccgaagggtgaagttcacaacgactgtggcttgcgcctaa

SEQ ID NO: 327743 - DNA, 665 bp, Homo sapiens
  misc_feature: GZ8MTXP01BNEW5.17.4.A04.1.454.CMB.2.raw
  modified_base (281)..(281): a, c, t, g, unknown or other
  misc_feature (281)..(281): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagagcctcctgcatagtgataggaaagtaccttattgtattggtacctgcagaaggcaggccagtcctcanatctactaatctatgtaatttccagtcgatttctccgtggagtcgacctagtaagttagggttcaggttgggacgaggtccggggtacaagggccacgtagtactttaccaactaacgtaaggaaaaacgttccggaacgggtcccgggggtagggaacgggtcgtaagggtagggttaaggtttaagggttttagggggttttaacttacgttagtcgtaagttacggtacttaaaggggttttcctttttacccggttccggttacggggttaaccggtttccgggaacccggtaaacggggttaccgtaaagggtacggttaaacgttacgaaccgtaacggtaacgtgggttacgcgttacggaacgttaaccgttaacg

SEQ ID NO: 327744 - DNA, 548 bp, Homo sapiens
  misc_feature: GZ8MTXP01D73DH.17.4.A04.1.454.CMB.2.raw
  modified_base (279)..(279): a, c, t, g, unknown or other
  misc_feature (279)..(279): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagcccggcctccatctcctgcaagtctagtcagagcctcctgcatagtgataggaaagtcctatttgtattggtacctgcagaagcaggccagtctcanatctacctaatctatgaacgtttccagtcgtattctccgtggagtcgccagtaattaggttcagtggacgaggcggggtcaggcacagtattacactactagaaaacgtcgaggtccggggtaggaggtcgtagaggtaaggttaggtttggggtttaattacgtgtctagtgtactaaggttactttccgttcgtggtaacgttcggaccgtaaagggaccgaaggtagaaagttcaacgtaacgacgtgtaggcttgcaacgtaacg

SEQ ID NO: 327745 - DNA, 606 bp, Homo sapiens
  misc_feature: GZ8MTXP01DB1IS.17.4.A04.1.454.CMB.2.raw
  modified_base (277)..(277): a, c, t, g, unknown or other
  misc_feature (277)..(277): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagagcctcctgcatagtgataggaaagtacctatttgattggtacctgcagaagcagccagtctcanatctacctaatctatgtaagtttccagtcgtattctccgtgggagtcgacccagtaattagggttcaggtgggacgaggcggggtacagggacactagtactttacaactaacttagaaaactcgaacggccggggtaggaggacgtaggaggtagttagtttaggggtttaattacgtgtacgtagtggtacttaaggttacttttcccgttccggtggtaaccggtttcggaccggtaaacgggaacccggtaaagggtaacggttaaaacgttccgaacgaacggtaacgtggtacgggtacttacggaaccgttaaccgttaacg

SEQ ID NO: 327746 - DNA, 653 bp, Homo sapiens
  misc_feature: GZ8MTXP01ASHK2.17.4.A04.1.454.CMB.2.raw
  modified_base (281)..(281): a, c, t, g, unknown or other
  misc_feature (281)..(281): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagagcctcctgcatagtgataggaaagtacctatttgtattggtacctgcagaaggcaggccagtctccanatctactaatctatgtaagtttccagtcgtattctccgtggagtgaccagtaattagggtttcgaggttgggaccgagggtccggggtacgagggaccacgtagtactttacaacgtaacgtaagtaaaacgtcgacgggtccgggggagggtagacgtagggaaggtaaggttaggttttagggggttttattacgtagtacgtagttacggtacgtaaggtttaccgtttttcccggttaccgggttcgggttaaccgggttaccgggttaccgggtaaacggggaacccggtaaaggggtacggttaaaacgttcgaccggaaccgtaacgttgggtacggtccgttacggtaacccgttaacgttccg

SEQ ID NO: 327747 - DNA, 565 bp, Homo sapiens
  misc_feature: GZ8MTXP01AMODI.17.4.A04.1.454.CMB.2.raw
  modified_base (267)..(267): a, c, t, g, unknown or other
  misc_feature (267)..(267): n is a, c, g, or t
  modified_base (270)..(270): a, c, t, g, unknown or other
  misc_feature (270)..(270): n is a, c, g, or t
  modified_base (276)..(276): a, c, t, g, unknown or other
  misc_feature (276)..(276): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccgcctccatctcctgcaagtctagtcagacgcctcctgcatagtgatggaaatctattgatggactgcagagcagcagtctcantcnctaatntatgtaacttcagtctattctcgtggatgccagtaataggttcagtggcaggcgggtacaggcacgtagtattacaactacgtaagaaaacgtcgaaggtccggggtagggacggtgtaggaggtaggtttaaggtttaggggtttattacgtgtacgtagttgtacgttaagttacgttttcccgttcggtgggtaaccgttcgggaccggaaacgggttaccgtaaaggttaacgaaacgttcgaaccgtaacggtacgtaaggtggcttacgccgttaacgtaacg

SEQ ID NO: 327748 - DNA, 550 bp, Homo sapiens
  misc_feature: GZ8MTXP01D1PGT.17.4.A04.1.454.CMB.2.raw
  modified_base (271)..(271): a, c, t, g, unknown or other
  misc_feature (271)..(271): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagagcctcctgcatagtgatggaaatctattgtatggactgacagaagcaggcagtctcanatctactatctatgtaagttcagtctattctcgtggagtcgcagaacttaggttcgaggtgcaggccgggtcagggcacgagtacttacaacactaagtaaaactcgaggccggggtggagtcgtaggaaggttaggttaggtttggggtttaattacgtggctagtgtacgtaacggtttctttccgtcggtgggtaacgttcggacggtaaacgggaccgtaagggtaagaacgttcaacgtaacgtaacgtggacgtcgttacgtaaccgctaacg

SEQ ID NO: 327749 - DNA, 542 bp, Homo sapiens
  misc_feature: GZ8MTXP01BM1MX.17.4.A04.1.454.CMB.2.raw
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcaccctggacagccgcctccatctcctgcaagtctagtcagagcctcctgcatagtgataggaaagtaccttatttgtattggtacctgacagaaggcaggccagtctccacatctactaatctatgtaagtttcagtcgtattctccgtggagtgaccagtaattaggtcgagtgggcaggcgggtcaggcacagtatttacgacactaagaaacttcgaggtccggggtaggaggtcgtaggtaggtaggttagtttaggggtttattacgtgactagtgtacgtagttctttccgtcgtggtcgtcggacgaaacgggttacgaaaggtagaacgttcacgaacgaacgtggcgtcacggtcaacgtaac

SEQ ID NO: 327750 - DNA, 528 bp, Homo sapiens
  misc_feature: GZ8MTXP01BG0G2.17.4.A04.1.454.CMB.2.raw
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagagcctcctgcatagtgatggaaagcctattgattggtacctgcagaggcaggccagtctcacatctcctaatctatgtaagtttccagtcgattctctggatgccagaataggtcagtgcagcggggtacagggcacagtatttcactactagaaaactcgaggccgggtaggaggcgtagaggtagttagtttggggtttattacgtgcagtgtacgtaggttacttttccgttccggtggtaacgttcgggaccgtaagggaccgtaagggtggaaattcgacgaacgaacgtgtggacttcgcgaacgtaacg

SEQ ID NO: 327751 - DNA, 545 bp, Homo sapiens
  misc_feature: GZ8MTXP01AQYDE.17.4.A04.1.454.CMB.2.raw
  modified_base (277)..(277): a, c, t, g, unknown or other
  misc_feature (277)..(277): n is a, c, g, or t
  modified_base (281)..(281): a, c, t, g, unknown or other
  misc_feature (281)..(281): n is a, c, g, or t
  modified_base (310)..(310): a, c, t, g, unknown or other
  misc_feature (310)..(310): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagagcctctgcatagtgatggaaagtcctatttgattggtacctgcagaagcaggcccagtctccanatcncctaatctatgaagtttccagtcgattcncgtggatgccagattagggttcagtggcaggcgggtcaggcacagattacacactagaaaatcaggccgggtggaggcgtagaggagttagttaggggtttattacgttgctagtgtacgtaaggttactttccgttccggtggtaaccggttccggacggtaaacgggaccgaaagggttacggaaagttcgaaccgaacgtaaccgtgtcggcgttacggtccgaaccgtaac

SEQ ID NO: 327752 - DNA, 516 bp, Homo sapiens
  misc_feature: GZ8MTXP01E15X7.17.4.A04.1.454.CMB.2.raw
  modified_base (511)..(511): a, c, t, g, unknown or other
  misc_feature (511)..(511): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcaccctggacagccggcctccatctcctgcaagtctagtcagagcctctgcatagtgatggaaagactatttgattggtacctgcagaggcaggccagtctcacatctcctaatctatgaagtttccagtcgattctccgtggagtgccagtataggttcagtggcaggcgggtcaggcacagattcacactagaaatcgagccggggtggaggctagaggtagttagtttggggtttattacgtgtcgatgtactaaggttacttttcccgtccggtgggtaacgttccgggaccgtaaagggacccgaagggtagaacgttcacaacgactgtgcttgcnctaac

SEQ ID NO: 327753 - DNA, 725 bp, Homo sapiens
  misc_feature: GZ8MTXP01D1FLT.17.4.A04.1.454.CMB.2.raw
  modified_base (281)..(281): a, c, t, g, unknown or other
  misc_feature (281)..(281): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagagcctcctgcatagtgataggaaagtacctatttgtattggtacctgacagaagcaggccagtctccanatctactaatctatgtaacgtttccagtcgtattctccgtggagtcgccaagtaagttagggttcgaggttgggaccgagggtccggggtacgaggggacctaacgtaagttaactttacgaaacctaaccgttaaaggtaaaaaacgttccgaaacggggtcccgggggttaggggaaccgggtacgtagggtaagggttaagggtttaagggtttttagggggtttttaaactttaaccggttggtaccttaagttaggtaacccgtttaaagggttttaaccgtttttacccggtttccgggttcggggttaaccgggtttaccggggaacccggtaaacgggggttaaacccgtaaaggggtaacggttaaaacgttccgaaaccgtaaccggtaaaccgttgggttacgggaccttacggaacccgttaaccgttaacg

SEQ ID NO: 327754 - DNA, 601 bp, Homo sapiens
  misc_feature: GZ8MTXP01ACGDB.17.4.A04.1.454.CMB.2.raw
  modified_base (277)..(277): a, c, t, g, unknown or other
  misc_feature (277)..(277): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagacctccactctctctgtcccgtcacccctggaccagccgcctccatctcctgcaagtctagcagcgcctctgcatagtgatggaaatcttattgtatggtacctgacagaaggcaggccagtcctcanactctacctaatctatgtaagtttccagtcgtatttcgcgtggagtcgaccagtaacttaggttcgaggtcgggacagggtccggggtacacgggcacgtagtactttacgaactaacgtagaaaacgttcggaacgggtccggggtagggacggtacgtaggaggtaggtttaggtttaggggtttatacgtgacgtagtgtacgtaagttcgtttccgttcggtggtaaccggtcggttacggaaacggaaccggtaaggtaggaaacgttcgaaccgtaacggtaacgtgggtcggtccgttcggccgttaacgttaaccg

SEQ ID NO: 327755 - DNA, 596 bp, Homo sapiens
  misc_feature: GZ8MTXP01EXB35.17.4.A04.1.454.CMB.2.raw
  modified_base (281)..(281): a, c, t, g, unknown or other
  misc_feature (281)..(281): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagagcctcctgcatagtgataggaaagaccttatttgattggtacctgacagaaggcaggccagtctccanatctacctaatctatgtaatttccagtcgatttctccgtggagtcgccagtaatagggttcagggtggcaggcgggtacagggcacagtattcacactagaaaactcgtaacggcggggtagagggctagggaggtaggttaggtttaggggtttattacgtggtacagtgtacgtaaggttacttttcccgttccgggtagggtcgtttccgggaccggtaaacgggggttaaccgtaaaggggtaaggttaaacgttcgaaccggtaacggtaaacgttgggttacggcgttacggtaaccgttaaccgttcg

SEQ ID NO: 327756 - DNA, 579 bp, Homo sapiens
  misc_feature: GZ8MTXP01C1KHE.17.4.A04.1.454.CMB.2.raw
tcagcgtagactagcacgaccggtgctcgatttagagtagtgatcaggacttctcagttcatcttctcaccatgaggctccctgctcagctcctggggctgctaacgctctggatccctggatccagtgcggatattgtgatgacccagactccactctctctgtccgtcacccctggacagccggcctccatctcctgcaagtctagtcagagcctcctgcatagtgataggaaagtaccttatttgtatggtacctgacaggaaggcaggcagtctccacatctcctaatctatgtaagttccagtcgtattctcgtggagtgcagtagttaaggttcaaggtggcaggcgggtcaggcacagtattacacactagaaagtcgacggcgggtaggaggcgtaggaaggtagttaggggtttaggggtttattacgtgtactagtgtacgtaaggtttacgttttccgttccggtcgggtaccggttaacgggtaccgaaaggggtaaccggaaagggtaacgggaacttaccgacgaacgtaacgtgtcggtctaggacctaaccgttaacgttccg

SEQ ID NO: 327757 - DNA, 616 bp, Homo sapiens
  misc_feature: GZ8MTXP01BIQBZ.17.4.A04.1.454.CMB.2.raw
  modified_base (286)..(286): a, c, t, g, unknown or other
  misc_feature (286)..(286): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtccacccctggacagccgcctccatcctcctgcaagtctagtcagacgcctcctgcatagtgataggaaagtacttatttgtattggtacctgacaggaaggcaggccagtcctccanactctactaatctatagtaacgttccagtcgtattctccgtggagtcgacctaaggtaaacgttacgggttcgaagggtcgggacgacgggtcggggtacagggacacgtagtacttacaacgtaacgtaagaaaacgtcgacgggtcgggtaggagcgtaggaggttagttaggtttaggggtttatacgtgtcgtagttgtacgttaaggtttccgtttccgttccggtagggttaaccggttcggaaccggtaaacgggaccgtaaagggttacgaaacgttcgaaacgtaacgtaacgttggtacggcttacgtccttaacgttcg

SEQ ID NO: 327758 - DNA, 695 bp, Homo sapiens
  misc_feature: GZ8MTXP01BTPNJ.17.4.A04.1.454.CMB.2.raw
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccgcctcatctcctgcaagtctagtcagagcctctgcatagtgataggaaagtacttattgtattggtacctgacaggaagcaggccagtctccacatctactaatctatgtaacgtttccagtcgtattcgtccgtggtagtcgaccgagtaagttacggttcagggtcgggcgacgggtccggggtacacggggtaccaacgtacgttatttaccgaaactaaccgtaaggtaaaaaacgttccggaaacggggtcccgggggttagggacgggtacgttagggtaagggttaggtttaacgggttttagggggttttaattacgtagtacgtagttacggtacgtaaggtttccgtttttacccggtccggttggggtaaccgggtttccgggaacccgggtaaaacggggttaaacccgggtaaaggggttaacggaaacgttaccgttaacggaaaccggtaaaccggtgggtacgggtacgttacggaacccttaaccggttaaccg

SEQ ID NO: 327759 - DNA, 736 bp, Homo sapiens
  misc_feature: GZ8MTXP01C41NJ.17.4.A04.1.454.CMB.2.raw
  modified_base (182)..(182): a, c, t, g, unknown or other
  misc_feature (182)..(182): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagacctccactctctctgtccgtcacccctggacngccggcctccatctcctgcaagtctagtcagagcctcctgcatagtgataggaaagtaccttatttgtattggtacctgacaggaaggcaggccagtcctccacatctactaatctatgaacgttcagtctattcgtccgtggtagtcgaccagtaacgttagggtcgtaagggtgggacgtaacggggtccggggtacacggggacaacgtaagttaactttaccgaaacgtaaccgttaaaggaaaaaacgttccggtaacggggacccgggggttagggacggggtaccggtaagggtaaggggtttaaggtttaaggggttttaagggggtttttaaattaccggttaggtaccgtaagtcggttaaacgttaacggttttaaccgtttttacccggttcccgggttacggggttaacccgggtttcccgggaaacccgggtaaacgggggaaacccgttaaaagggggtaacgggttaaaacttccggaaaccgtaaccggttaaacgttgggtacgggtccgttacggtaacccgaaccgtttaaccg

SEQ ID NO: 327760 - DNA, 608 bp, Homo sapiens
  misc_feature: GZ8MTXP01D9FSX.17.4.A04.1.454.CMB.2.raw
  modified_base (227)..(227): a, c, t, g, unknown or other
  misc_feature (227)..(227): n is a, c, g, or t
  modified_base (277)..(277): a, c, t, g, unknown or other
  misc_feature (277)..(277): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagagcctctgcatagtnataggaaagtaccttattgtattggtacctgacagagcaggcagtctcanactctctaatctatagtacttccagtctattctccgtggagtcgctagtaagttaggttcaggtggacgaggcgggtacgagggctacgtacgtatttcaactaacgtaagtaaaacgtcgacgggtccggggtagggacggtcgtagggaaggttaagtttaggtttaggggtttaattacgtggtactagttgtaacgttaagtttacgttttccgttccggtggtaaccggttcggaacggtaaacgggttaccggtaaaggtacggttaaacgttaccacgtaaccggtaaactgggtacggtccttacgtaaccgaaccgttaacg

SEQ ID NO: 327761 - DNA, 629 bp, Homo sapiens
  misc_feature: GZ8MTXP01EVFC0.17.4.A04.1.454.CMB.2.raw
  modified_base (275)..(275): a, c, t, g, unknown or other
  misc_feature (275)..(275): n is a, c, g, or t
  modified_base (278)..(278): a, c, t, g, unknown or other
  misc_feature (278)..(278): n is a, c, g, or t
tcagcgtagactagcacgaccggtgctcgatttagagtagtgatcaggacttctcagttcatcttctcaccatgaggctccctgctcagctcctggggctgctaatgctctggatcctggatccagtgcggatattgtgatgacccagactccactctctctcgtccgtcaccctggacagccgcctcatctcctgcaagtctagtcagacgcctctgctatagtagataggaaagtaccttatttgtattggtacctgacagaagcagcagtcncanatctactaagtctatgtaacgtttccagtcgtattccgtacgttgggagtcgacctaaggtaaagttacgggttcgaaggtcgggactacgggtcggggtacagggtacccagtaagtatttacaactaacgtagaaaactcgaaggtccgggtaggagtcgtaggtaaggtaggtttaggtttaggggtttattacgtgtactagttagtacgttaaacggtttcgttttccgttaccgtagggtaaccgttacgggttaccggaaacgggttaaccgtaaagggtaacgggttaaacttcgaaaccgtaacggtaacgttggtacggcttacgaaccgttaacgtaacg

SEQ ID NO: 327762 - DNA, 635 bp, Homo sapiens
  misc_feature: GZ8MTXP01CJNNE.17.4.A04.1.454.CMB.2.raw
  modified_base (493)..(493): a, c, t, g, unknown or other
  misc_feature (493)..(493): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccactctctgacagtctagtcagacgtcctctgactagtagtagagtaggaaacgtaccttagtttgtagttacggtactgacgaaggaacggcgacggcctagtcctaccaactacttcctacttaatcttagtacgtaacgtttccagtacgtacttctccgtggtagtcgacagtaagttacgttcgaggtcggctacgggcggtacgagaccagagttacttacactataaagaaacgttcgagggtccgggtaggaccgtgtaggaaggttatttaggggtttacggggtttatacggngtacgtagtacgtaacggttagtttccgtttaccggtcgggtacgttaaccggtcggaaacgggtaaacggttaacgtaagggtaacaacgttccgaacgtaacggtacgttggtccggtacgttacgtaaccgttaacgtg

SEQ ID NO: 327763 - DNA, 600 bp, Homo sapiens
  misc_feature: GZ8MTXP01BITCP.17.4.A04.1.454.CMB.2.raw
  modified_base (272)..(272): a, c, t, g, unknown or other
  misc_feature (272)..(272): n is a, c, g, or t
  modified_base (275)..(275): a, c, t, g, unknown or other
  misc_feature (275)..(275): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagagcctcctgcatagtgataggaaagacttatttgtattggtacctgcagagcagcagtcncantctactatctatgtattcagtcgattctcgtggtagtgaccagtaattacggttcgaggtgggcgagggtcgggtacgacgggacacgagtattacacaactagtaaaatcgaggccgggtggacgcgtaggaggtaggttaggtttaggggtttacttacgtgacgtagttacgtacgttaacggttacttttcccgtttccggtagggttaaccggtttcgggacccggtaaacggggaacccggtaaagggtaaggaaacgttcgaaaccgtaaacggtaaaccggttggtacgggtacgttacgaaccgttaacccgtaag

SEQ ID NO: 327764 - DNA, 605 bp, Homo sapiens
  misc_feature: GZ8MTXP01EH4UK.17.4.A04.1.454.CMB.2.raw
  modified_base (279)..(279): a, c, t, g, unknown or other
  misc_feature (279)..(279): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagagcctcctgcatagtgatggaaagaccttattgtattggtacctgcagaaggcaggccagtctccanatctactaatctatgtaagtttccagtcgattctctggatgccagaataggtcagtgcagcgggtcaggcacagtattacacactagaaaattcgaaggccgggtggagggagtaggtaggttaagggtttaggtttaggggtttaattacgtgtacgtagttaggtacgttaacggtttacgttttacccggtttccggttacgggttaaccggttaccgggttaaccgggtaaacggggttaaacggtaaacggggtaacggttaaacgttaccgaaacgtaacggtaacgtggtcggtacgttacgtaaccgttaaccgtaag

SEQ ID NO: 327765 - DNA, 572 bp, Homo sapiens
  misc_feature: GZ8MTXP01CMPZ8.17.4.A04.1.454.CMB.2.raw
  modified_base (279)..(279): a, c, t, g, unknown or other
  misc_feature (279)..(279): n is a, c, g, or t
  modified_base (364)..(364): a, c, t, g, unknown or other
  misc_feature (364)..(364): n is a, c, g, or t
  modified_base (458)..(458): a, c, t, g, unknown or other
  misc_feature (458)..(458): n is a, c, g, or t
  modified_base (551)..(551): a, c, t, g, unknown or other
  misc_feature (551)..(551): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagacgcctctgcataggtgataggaaatccttatttgattggtacctgcagaggcaggccagtctccanatcctactaatctatagtaatttccagtcattctccgtggagtgacctagtaagttagggttcagggtcggcgagggccgggtanagggacacagtacttacacactaagaaactcgacggtccgggtagggaggtcgtaggtaggtaggttaggttttaggggtttaattacgtagtntagtgtactacggtttactttccgttccggtggtaacggttcggacggtaacgggaccgtaaaggtggaaattcgttacgaacgtaacgtggnggtcgttacgccgaactaacg

SEQ ID NO: 327766 - DNA, 566 bp, Homo sapiens
  misc_feature: GZ8MTXP01BW8QL.17.4.A04.1.454.CMB.2.raw
  modified_base (282)..(282): a, c, t, g, unknown or other
  misc_feature (282)..(282): n is a, c, g, or t
  modified_base (292)..(292): a, c, t, g, unknown or other
  misc_feature (292)..(292): n is a, c, g, or t
  modified_base (379)..(379): a, c, t, g, unknown or other
  misc_feature (379)..(379): n is a, c, g, or t
  modified_base (527)..(527): a, c, t, g, unknown or other
  misc_feature (527)..(527): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccgcctccatctcctgcaagtctagtcagacgcctcctgcatagtgagtaggaaagtccttattgtattggtacctgacagaaggcaggccagtcctcanactctctatntactagtagtacttacacgtctacttcgtggtaggtacgtcgacgtaaagttagttgttcgagggtgacgcgggtcgagacgactanagtttacacgaactagtaaaagacgtaggccgggtggagagtagtagggagttaagtttggggtttagtactgcgatgtagttaagttcgttttcttcccggtgggtcgttcgggttcgaaacgggaacggtaacgaagggttaacanacccgtaagacgtaagttcgggcttacgcgaaccctaag

SEQ ID NO: 327767 - DNA, 554 bp, Homo sapiens
  misc_feature: GZ8MTXP01C25LZ.17.4.A04.1.454.CMB.2.raw
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagagcctcctgcatagtgatggaaagctattgtattggtacctgcagaaggcaggccagtctccacatctacctaatctaatgaagtttccagtcgatttctctggatgccagtaattaggttcaggtgggactagggcgggtcagggcacagtatttcactacgtaagaaaagtcgaaggccggggtaggacgggcgtagaggtagttagtttgggggtttaattacgtgctagtgtacgtaaggtttactttccgtccggttgggtaacgttcggacgaaacgggaccgtaagggtagaaagttcaacgaacgtaactggtacggcttagcgaaccgtaacg

SEQ ID NO: 327768 - DNA, 763 bp, Homo sapiens
  misc_feature: GZ8MTXP01C32IB.17.4.A04.1.454.CMB.2.raw
  modified_base (180)..(180): a, c, t, g, unknown or other
  misc_feature (180)..(180): n is a, c, g, or t
  modified_base (283)..(283): a, c, t, g, unknown or other
  misc_feature (283)..(283): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcaccctggacngccgcctccatctcctgcaagtctagtcagacgcctcctgcatagtgagtaggaaagtacttatttgtattggtacctgacaggaaggcaggccagtcctcanatctactaatctatgaacttccagtcgtattctcgtggagtgacctagtaagttagggttcgaaggttcgggacgtacggggccggggttacgaacgggtaccaacgtaaggttaactttaccaaacgtaaacgtaaacgggtaaaaaacgttccgggaacgggggtacccgggggttaaggggaacggggtaccggttaaagggggtaaaggggtttaaagggggtttttaaacggggttttttacggggggtttttaaatttaacccgggttaggttaacccgttaaggtttacgggtaaccggttttaaacgggttttacccgtttttacccggttaccgggttacggggttaacccggtttacccggggaaaccggtaaacggggttaaacccggtaaagggtaacggttaaaacgttcgaaaccgtaacggtaagttaacgggtcggtacgttacggtaaccttaaccgttaacg

SEQ ID NO: 327769 - DNA, 608 bp, Homo sapiens
  misc_feature: GZ8MTXP01AVHUL.17.4.A04.1.454.CMB.2.raw
  modified_base (357)..(357): a, c, t, g, unknown or other
  misc_feature (357)..(357): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagacgcctctgcatagtgataggaaagtaccttattgtattggtacctgcagaagcaggccagtctccacatcctacctaatctatgtaacgtttccagtcgattctctggatgccagtaattaggttcaggtggcgaggcgggtanagggacacgagtactttacaactacgtaagaaaacgtcgaacggtccggggtaggacgggtgtaggagggtaggtttaggtttaggggtttaattacgtgtacgtagttaggtacgttaaggtttacgttttccgttaccggttgggtaaccggtttacgggaccggtaaacggggaaccgtaaagggtaacggttaaacgttcgaaccgtaacggtaacgtgggtacggtcgacgtccgaaccgttaacg

SEQ ID NO: 327770 - DNA, 649 bp, Homo sapiens
  misc_feature: GZ8MTXP01DY3F5.17.4.A04.1.454.CMB.2.raw
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagagcctcctgcatagtgataggaaagtcttattgtattggtacctgacagaaggcaggccagtcctccacactcctactaatctatagtaacgtttccagttcgattctcgtggatgccagtaagttaggttcaggtgcgaggcgggtacagggacacgtagtactttacgaactaacgtaagtaaaacgttcgacgggtaccggggtagggacgggtcgtagggaagggttaaggtttaagggttttagggggttttaattaacgttgtacgttaagttacggtaacgtttaaacggttttaccgtttttcccgttccgggttcgggttaaccgggtttaccgggaccgggtaaacggggttaaccgtaaaggggttaaggaaacttccgaaacgtaacggtaaacgtggtacggtcgttacgtccgaaccttaacg

SEQ ID NO: 327771 - DNA, 557 bp, Homo sapiens
  misc_feature: GZ8MTXP01BSBAL.17.4.A04.1.454.CMB.2.raw
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagagcctcctgcatagtgatggaaagacctatttgtattggtacctgcagaaggcaggccagtctccacatctcctaatctatgaagtttccagtcattctcctggagtgccagtaataggttcagtggcagcggggtcagggcacagatttcacactagaaaatcaggccgggtggaggctgaggtagtagtttggggtttattacgtgcagtgacgtaaggttacttttccgttcggttggtaaccggtttcgggaccggtaaacggggacccgtaaaggggtcggaaaagttccgaaccgtaaccgtaaaccgtggtgggccgttacggtaaccaacccgtaac

SEQ ID NO: 327772 - DNA, 581 bp, Homo sapiens
  misc_feature: GZ8MTXP01CJ590.17.4.A04.1.454.CMB.2.raw
  modified_base (266)..(266): a, c, t, g, unknown or other
  misc_feature (266)..(266): n is a, c, g, or t
tcagcgtagactagcacgaccggtgctcgatttagagtagtgatcaggacttctcagttcatcttctcaccatgaggctccctgctcagctcctggggctgctaatgctctggatcctggatccagtgcggatattgtgatgacccagactccactctctctgtccgtcaccctggacagccgcctcatctcctgcaagtctagtcagagcctctgcatagtgatggaaatcttattgattggtactgacagagcagcagtctcanctctactatctatagtacgtttcagtcgtattcgtcgtggatcgactagtaattaggttcagggtcggacgtacgggcgggtacacgggacacgtagtacttacacgtaactagaaaacgtcgaacgggtccgggtaggaggacgtaggaggtaagtttagggtttaggggtttacttaacgtgtacgtagtacggtacgttaagtttacgttttccgttcggtggttaaccggttcgggacggaaacggggacgtaaagggtcggttaaacttcgaacgtaacgtaacgtggtcgacttcgaaccttaacgtaa

SEQ ID NO: 327773 - DNA, 585 bp, Homo sapiens
  misc_feature: GZ8MTXP01DTI45.17.4.A04.1.454.CMB.2.raw
  modified_base (181)..(181): a, c, t, g, unknown or other
  misc_feature (181)..(181): n is a, c, g, or t
  modified_base (285)..(285): a, c, t, g, unknown or other
  misc_feature (285)..(285): n is a, c, g, or t
  modified_base (360)..(360): a, c, t, g, unknown or other
  misc_feature (360)..(360): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacngccgcctccatctcctgcaagtctagtcagagtcctcctgctatagtgataggaaagtaccttatttgattggtaccctgacaagaaggcaggccagtctccantctctaatctatgtaagtttccagtcattctctggagtcgccagtaattaggttcgagtggcgaggccggggtanacggcacagtactttacacatagaaaatcgaaggccgggtaggagcgtaggtaggtagttaggtttaggggtttattacgtggactagtacgtacgtagtttcgtttaccgttccgggtggtaacggttacgggacggtaaacgggaaccgtaaagggtacgaaacgttcgaaaccgtaacggtaaacgtcgggtacggtacgttacggaaccgttaaccttaag

SEQ ID NO: 327774 - DNA, 550 bp, Homo sapiens
  misc_feature: GZ8MTXP01AOP1Q.17.4.A04.1.454.CMB.2.raw
  modified_base (214)..(214): a, c, t, g, unknown or other
  misc_feature (214)..(214): n is a, c, g, or t
  modified_base (276)..(276): a, c, t, g, unknown or other
  misc_feature (276)..(276): n is a, c, g, or t
  modified_base (360)..(360): a, c, t, g, unknown or other
  misc_feature (360)..(360): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagcccggcctccatctcctgcaagtctagtcagngcctctgcatagtgatggaaagcctatttgattggtacctgcagaagccaggccagcctcanacggtcctgatctatgtaacgtttccaaaccggtttctactgggaacgttgccaagtagttaggttcaggtggcagggcgggtnaggggacagtacttcacactagaaatcgaaggtccgggtggaggcgtaggtagtagttgggttttaggggtttagttagttaggtctagttagaactaaagtatacgtgtccgttaccgtacgtacgtttcgggacgggacgtacgcgtaggagacgttacgaacgaatcgtgactcgctaacgttgtcg

SEQ ID NO: 327775 - DNA, 631 bp, Homo sapiens
  misc_feature: GZ8MTXP01BGV6R.17.4.A04.1.454.CMB.2.raw
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccgcctccatctcctgcaagtctagtcagacgcctcctgcatagtgataggaaagtctattgtattggtacctgcagaaggcaggccagtctaccactactcctactaatctatagtaagtttccagttcgattctcgtggagtcgacctaggtaattagggttcgaggtcgggacgagggtcggggtacgagggacacgtagtactttacgaactaacgtaagtaaaaacgtcgaacgggtccggggtagggacgggtcgtagggaagggttaagtttaagggttttaggggtttaacttacggtgacgtagttagtacgttaaggtttaccgttttccgtcgggttggtaaccggttcggaccggaaacgggttaccgtaaagggtacgaaacgttccgaacgtaacgtaacgtggtggtaccgttacgaaccgttaacccgttaag

SEQ ID NO: 327776 - DNA, 594 bp, Homo sapiens
  misc_feature: GZ8MTXP01BRO3F.17.4.A04.1.454.CMB.2.raw
  modified_base (273)..(273): a, c, t, g, unknown or other
  misc_feature (273)..(273): n is a, c, g, or t
  modified_base (362)..(362): a, c, t, g, unknown or other
  misc_feature (362)..(362): n is a, c, g, or t
  modified_base (397)..(397): a, c, t, g, unknown or other
  misc_feature (397)..(397): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagagcctcctgcatagtgataggaaagtactattgtatggtacctgcagagcagcagtctcanatctactaatctatgtaacgtttcagttcgattctctggagtgaccgagtaagttagggttcagggtgggacaggcgggtacagggcanagtattacacactagaaatcgagccgggtggacgngtagaggtaggttagtttagggggtttattacgtgtacgtagtaggtacgttaaggttacgtttttcccgttccgggtcgggtaaccggtttccgggttacccggtaaacggggttaaccgtaaacggggttaaggaaacgttacgaaccgtaacggaaccgttggtcggacgttacggaaccgttaaccgttaacg

SEQ ID NO: 327777 - DNA, 611 bp, Homo sapiens
  misc_feature: GZ8MTXP01D60QT.17.4.A04.1.454.CMB.2.raw
  modified_base (363)..(363): a, c, t, g, unknown or other
  misc_feature (363)..(363): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcaccctggacagccggcctccatctcctgcaagtctagtcagagcctctgcatagtgatggaaagcctattgattggtacctgcaagaaggcaagtcacctagtcctacactacttccctacttaactcttaagtacgttaacgtttaccaggtctactttcccctggtagtagtcgacgaagtagttcggtanagggtcgacgtacgggcgtacgagtacactattacttacaactaagttaaagaaacgtcgaacggggcgggtagggacgtagtagggagggtaaagtttcgggtttagggtttatcgtgacgtagttacgattaagggtttccttttccgtggggtaacgttaccggttccggaaaccggttaagggaaaccgtaagggttaacgttaacttaccaacgacgtaactgggaccttgtccgaacgtaac

SEQ ID NO: 327778 - DNA, 568 bp, Homo sapiens
  misc_feature: GZ8MTXP01A6R1Y.17.4.A04.1.454.CMB.2.raw
  modified_base (237)..(237): a, c, t, g, unknown or other
  misc_feature (237)..(237): n is a, c, g, or t
  modified_base (274)..(274): a, c, t, g, unknown or other
  misc_feature (274)..(274): n is a, c, g, or t
  modified_base (309)..(309): a, c, t, g, unknown or other
  misc_feature (309)..(309): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtcccgtcacccctggacagcccgcctccatctcctgcaagtctagtcagcgcctcctgcatagtgatggaaanctattgattggacctgcagaagcaggccagtctccanatcctactaatctatgtaatttccagtcgatttcnccgtggagtgaccagaagttagttcaggtgggcaggcgggtacaggcacagtattcacactagaaatcgaggccgggtggaggctagaggtagttaggttaggggtttattaacgtgcagtagtacgtaaggttacttttaccgttcggttaggtaacggttacgggaccggtaaagggttaaccgtaaagggtagttaaaacgttcgttaaacgtaacgtaaacgttcggtcggtacgttcgaaccgttaacctaacg

SEQ ID NO: 327779 - DNA, 530 bp, Homo sapiens
  misc_feature: GZ8MTXP01BDYL3.17.4.A04.1.454.CMB.2.raw
  modified_base (283)..(283): a, c, t, g, unknown or other
  misc_feature (283)..(283): n is a, c, g, or t
  modified_base (365)..(365): a, c, t, g, unknown or other
  misc_feature (365)..(365): n is a, c, g, or t
  modified_base (530)..(530): a, c, t, g, unknown or other
  misc_feature (530)..(530): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagacgcctcctgcatagtgataggaaagtaccttatttgtattggtacctgcagaaggcaggccagtctccanatctacctaatctatgtaacgtttccagttcgtattctccgtggatgccagtaattagggttcaggtggcaggtcggggtanagggcacagtattcaacactagaaactcgaggcgggtggaggctagaggtagttaggttggggtttatacgtgctagtgtacgtagttactttccgttcggtggtaacgttcggacgacgggacgaaggtaggaacttcacgaagacgtgcgcttacgcaacgtn

SEQ ID NO: 327780 - DNA, 672 bp, Homo sapiens
  misc_feature: GZ8MTXP01AGVQZ.17.4.A04.1.454.CMB.2.raw
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcaccctggacagccgcctcatctcctgcaagtctagtcagctcctctgctatagtgaagtaggaaacgtccttatttgtagttcggtacctgacgaaggaacggcgacggccacgtcctaccatacttctacctaatctagtagtacgttcagtcgtattcgtcgtggagtcgaccagtaacgttacggttcgagggtcgggactacggggtcgggtaacgacgggtacacgtaagttactttaccgaacgtaacgttaaaggaaaacgtcggaacggggtaccggggttagggacgggtacgtaggggtaaggttaggggtttagggtttaggggtttaacttacggtgtacgtagtacggtaacgttaaggtttcctttccggttcgggtgggttaaccggttcgggaaccggtaaacggggaaccgtaagggtaacggttaacgttccggaacgaacggtaacgtcgggttacggcgttaccggtaaccgaactttaacg

SEQ ID NO: 327781 - DNA, 665 bp, Homo sapiens
  misc_feature: GZ8MTXP01BYVUX.17.4.A04.1.454.CMB.2.raw
  modified_base (286)..(286): a, c, t, g, unknown or other
  misc_feature (286)..(286): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcaccctggacagccgcctccatctcctgcaagtctagtcagacgcctctgcatagtgagtaggaaagtaccttatttgtattggtacctggacaggaaaggcaggccagtctaccanatcctactatctatgtaacgttcagtcgtattctccgtggagtcgacctagtaagttaggtcgaggtcggcgacggtcggggtacagggctaacgtagtactttacaagacctaagaaaacgtcgaaggtccggggtaggacggtcgtaggtaagggttaggtttaaaggttttagggggttttaacttaacgtacggtcgttaaagttcgggtaaaccgtttaacggttttaacctttttcccggttacccgggttacgggttaaccggtttacccgggttaaccgggtaaaacggggttacccgtaaagggtaacgggttaaacttccgaaacgtcggtaaaccgttggtacggcttacggtaaccaaccgttaacg

SEQ ID NO: 327782 - DNA, 627 bp, Homo sapiens
  misc_feature: GZ8MTXP01CEDAU.17.4.A04.1.454.CMB.2.raw
  modified_base (272)..(272): a, c, t, g, unknown or other
  misc_feature (272)..(272): n is a, c, g, or t
  modified_base (417)..(417): a, c, t, g, unknown or other
  misc_feature (417)..(417): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcaccctggacagccgcctcatctcctgcaagtctagtcagagcctcctgcatagtgactggaaatacctatttgattggacctgacagagcaggcagtcacanactctactagtctatagtacttcagtcgtacttctcgtggagtcgacagaagttaggttcgagggtggacgacgggtcgggtacgacgggtcacgtagtacttacactaacgtagaaaacgtcgacggtccggggtggaacgggngtaggtaggttaaggggtttaggtttacgggtttaattacgtagtacgtagttacggttaacgttacggttttccgtttaccggttaccggttcgggttaaccggttaccgggttaacgggtaaacgggttaacggtaaacgggtaacgttaacgttacgttaaccgtaacgtacgttcggcgtacgttacgtaacccgttaacgtaacg

SEQ ID NO: 327783 - DNA, 610 bp, Homo sapiens
  misc_feature: GZ8MTXP01EN2IJ.17.4.A04.1.454.CMB.2.raw
  modified_base (356)..(356): a, c, t, g, unknown or other
  misc_feature (356)..(356): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctcatctcctgcaagtctagtcagacgtcctcctgctatagtgataggaaagtaccttattgtattggtacctgacaggaaggcaggccagtctccactatctactaatctatgtaacttcagtcgtattctctggatgccagtaattaggtcagtggcaggcgggtanaggcactagtattacactaacgtaagtaaacgtcgacgggcgggtagggagtacgtaggtaaggtaggtttaggtttaggggtttaattacgtagtacgtagtagtacgttaagtttaccgttttaccgttcggtacgggtaaccggttcggaaccgggtaaagggttaaaccggtaaagggtaacggttaaacgttaccgaaacggtaacgtaacggtcggtacggtcgttacggtaaccttaacgttaaccg

SEQ ID NO: 327784 - DNA, 556 bp, Homo sapiens
  misc_feature: GZ8MTXP01CXC59.17.4.A04.1.454.CMB.2.raw
  modified_base (277)..(277): a, c, t, g, unknown or other
  misc_feature (277)..(277): n is a, c, g, or t
  modified_base (416)..(416): a, c, t, g, unknown or other
  misc_feature (416)..(416): n is a, c, g, or t
  modified_base (446)..(446): a, c, t, g, unknown or other
  misc_feature (446)..(446): n is a, c, g, or t
  modified_base (543)..(543): a, c, t, g, unknown or other
  misc_feature (543)..(543): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctcgtccgtcaccctggacagccgcctcatctctgcaagtctagtcagacgcctctgcatagtgagtaggaaactcttatttgattggacctgacaaggaagcgacgcacgtaccncactactctaactacttatagttacgttaacttccagtcgtattcgtggtaggagtccagtagtaaagttcgtgacggtcgagacgggcgagagtacaagtatactacactaagaagtaaacgcgacggtcgggagagngtagagttagttagggttacgttattaggnatgtagtacgttacgttccttcggtcggtacggtaacggtacggaacggaacggaacggtaaggaagttaaccgacggaacgaacgtggtcgtgtcnctaacgttcgtaa

SEQ ID NO: 327785 - DNA, 643 bp, Homo sapiens
  misc_feature: GZ8MTXP01AMSZS.17.4.A04.1.454.CMB.2.raw
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccgcctccatctcctgcaagtctagtcagacgcctcctgactatagtgagtaggaaagtccttatttgtattcggtacctgacaggaacgcaggccagtcctaccactactctactaatctatgtaacgttccagtcgtattctcgtggatcgaccagtaagttagggttcagggtggacgagggtccgggtcagggacctacgtagtacttacaactaacgtaagtaaaacgttcgaacgggtccggggtaggagggtcgtagggtaggttagggtttaggttttagggggtttaacttacgttgtacgtagttacggtacggttaacggtttaccgttttcccggttacgggttcgggttaaccggttccgggaccggtaaacggggaccgtaaagggttacggaaacgttaccgacggaacgtacgtcggtcggccgttcgtaaccttaacgttaacg

SEQ ID NO: 327786 - DNA, 657 bp, Homo sapiens
  misc_feature: GZ8MTXP01EOIX8.17.4.A04.1.454.CMB.2.raw
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagacgcctctgcatagtgataggaaagtcttattgtattggtacctgacaaggaaggcaggccagtcctaccactattcctacctaattctaattagtaaacgtttccaagttcgtattcgtcgtaggatcgcctaaggtaacgttagggttcgagggtgggcgtagggtccggggtacagggacaactagtacttacactaactaagaaaactcgaacgggcggggtaggacggtcgtaggtaggttaggtttaggtttagggggtttaattacgtgtacgtagttcggtaacgttaaggtttccttttacccggttcgggtcgggttaacccggttacgggaaaccggtaaacggggttaaccgtaaagggtaacggttaaacgttacgaaaccgtaacggtaaacgttgggtacggccgttacggtaaccgttaaccgttaacg

SEQ ID NO: 327787 - DNA, 660 bp, Homo sapiens
  misc_feature: GZ8MTXP01BWT17.17.4.A04.1.454.CMB.2.raw
  modified_base (283)..(283): a, c, t, g, unknown or other
  misc_feature (283)..(283): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagcccggcctccatctcctgcaagtctagtcagagcctcctgcatagtgatggaaagtacctatttgtattggtacctgacagaaggcaggccagtctccacntctacctatctatgtaagtttccagtcgattctcgtggagtcgccaagtaagttagggtttcaggttcgggacgtacgggccggggttacgaaggggtccaacgtagttactttaccgaactacgtaaagaaaacgttcggacgggtccgggggtagggacgggtcgtagggtaaggttaggtttaggttttagggggttttaacttacgttagtacgtagttaggtacgttaaacggttttccgttttacccgtttccgggttcgggtaaccggtttaccgggaccggtaaacggggaccgtaaaggggtacggttaaacgttccgaaccgtaacggtaacgttcgggtcgggtcgttacggccgttaaccttccg

SEQ ID NO: 327788 - DNA, 680 bp, Homo sapiens
  misc_feature: GZ8MTXP01CK05T.17.4.A04.1.454.CMB.2.raw
  modified_base (492)..(492): a, c, t, g, unknown or other
  misc_feature (492)..(492): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctcgtccgtcacccctggacacgccggcctccactctcctgactaagtctagtcagacgtcctcctgctagtagtgagtaggaaacgtaccttatttagtagttcggtacctgacgaaggaacggcgaacggccaagtcctaccaactacttaccttacctaaattcttaagtttacgttaacgtttccagttcgtactttcgtaccgttgggtacgtcgacccgtaagttaaacgttacgggttcgacgggtggaccggtacgggtcgggtacgacgggacacgtagtacttacactaacgtagaaacgtcggacggtcgggtaggacgngtaggtaggttagtttagggtttaggggtttactacgtgtacgtagtagtaacgttaggttttaccgttttccgtaccgggttcggtaacgggtttacggaccgggtaaacgggttacggtaaacgggtaggttaaacgttcgaacgtaacgtaacgtcggtacgggtcttaccggtcaacgtttccg

SEQ ID NO: 327789 - DNA, 497 bp, Homo sapiens
  misc_feature: GZ8MTXP01ENZLD.17.4.A04.1.454.CMB.2.raw
  modified_base (192)..(192): a, c, t, g, unknown or other
  misc_feature (192)..(192): n is a, c, g, or t
  modified_base (269)..(269): a, c, t, g, unknown or other
  misc_feature (269)..(269): n is a, c, g, or t
  modified_base (272)..(272): a, c, t, g, unknown or other
  misc_feature (272)..(272): n is a, c, g, or t
  modified_base (308)..(308): a, c, t, g, unknown or other
  misc_feature (308)..(308): n is a, c, g, or t
  modified_base (346)..(346): a, c, t, g, unknown or other
  misc_feature (346)..(346): n is a, c, g, or t
  modified_base (383)..(383): a, c, t, g, unknown or other
  misc_feature (383)..(383): n is a, c, g, or t
  modified_base (474)..(474): a, c, t, g, unknown or other
  misc_feature (474)..(474): n is a, c, g, or t
  modified_base (493)..(493): a, c, t, g, unknown or other
  misc_feature (493)..(493): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcaccctggacagccgctccatcncctgcaagtctagtcagagcctctgcatagtgataggaaatacctatttgattggacctgacagaagcaggcagtcncanatctactaatcgtatagtaagtttccagtcgattcnctggatgccagtaactaggttcagtggacaggcgggtnaggcacagtattcacatagaaaatcgaagcggtgagntagagtagttagtttggggtttatagtgactagtgataaggttacttttcgtcgtggaacgttcggacaagggacgaaggtacgaaagttnaacaagaatgtgcttagcnctaa

SEQ ID NO: 327790 - DNA, 642 bp, Homo sapiens
  misc_feature: GZ8MTXP01BSFJB.17.4.A04.1.454.CMB.2.raw
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctcgtccgtccacccctggacagcccggcctccatctcctgcaagtctagtcagagcctcctgcatagtgagtaggaaagtacttatttgtattcggtacctgacgagaacggcgaggccagtcctaccactactaccttacctaaattctaagtagtaaacgtttccgaagttccgtaatttccgtaccgtgggtagtcgaccgtaggtaaagttacgggttcgtagggtgggacgacggggtccgggtacgacggggacacgtaagtactttacgaactacgttaagaaaacgtccgaagggtccgggtggagtcgtaggtaggtagtttaggttttaggggtttacttacgtagacgtagtacggtacgttaggtttaccttttccgtcggtcggtaacggttcggacggtaacggaaccgtaaagggtacgttaagttccgaagtaacgaacgtggtacggcttcgccgttaacctg

SEQ ID NO: 327791 - DNA, 506 bp, Homo sapiens
  misc_feature: GZ8MTXP01CBZGB.17.4.A04.1.454.CMB.2.raw
  modified_base (235)..(235): a, c, t, g, unknown or other
  misc_feature (235)..(235): n is a, c, g, or t
  modified_base (273)..(273): a, c, t, g, unknown or other
  misc_feature (273)..(273): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccgcctccatctcctgcaagtctagtcagagcctcctgcatagtgatggaaancctattgattggtacctgcagaaggcaggcagtctcanatctctaatctatgaagtttccagtcattctctggatgcagaataggtcagtgcagcggtcaggcacagattcacactagaaaatcgaggccgggtggaggctaggaggtaggttagtttaggggtttattacgtgcagttgactaaggttactttccgttcggtggtaacgttcggacgaacgggaccgaaggtagaaagttcacaacgaactgtgacttgtcgaactaacg

SEQ ID NO: 327792 - DNA, 628 bp, Homo sapiens
  misc_feature: GZ8MTXP01BXSAK.17.4.A04.1.454.CMB.2.raw
  modified_base (280)..(280): a, c, t, g, unknown or other
  misc_feature (280)..(280): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtcccgtcacccctggacagcccggcctccatctcctgcaagtctagtcagcgcctctgcatagtgataggaaatccttatttgtattggacctgacagaaggcagccagtctccanatctactaatctatgtaatttccagttcattctcgtggactgcctaggtaacgttaggttcagggtcgggacgagggtcgggtacaagggaccaacgtagtactttacgaactaacgtaacggtaaaaacgttcggaacgggtccgggggtagggacgggtacgtagggtaagggttaagggtttaggttttagggggtttaacttacggtagtacgtagttacggtacgttaaggtttacttttcccggtcggttcgggtaaccggttcggttaccggaaacgggttaaccgtaaagggtaggaaacgttcgacgaacgtacgtggtcggcttcgcttaacgtaacg

SEQ ID NO: 327793 - DNA, 621 bp, Homo sapiens
  misc_feature: GZ8MTXP01A3Y6X.17.4.A04.1.454.CMB.2.raw
  modified_base (182)..(182): a, c, t, g, unknown or other
  misc_feature (182)..(182): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctcgtccgtcacccctggacngccgctcatctctgcagtctagtcagagcctctgcatagtgagtaggaaagtctatttgtattggtacctgacagaaggctaggccagtctccacatcctactatctatagtaacgtttcagtctattctcgtggtagtacgccgtagtaagttacgggttcgaggtcgggacgacgggtcggggtacaagggtccaacgtagtactttacaacgtaacttaagaaaacttcggacgggtaccggggtagggagtcggtagtagggtaggtttaggtttacggggtttaatacgtgtactagtggtaacgtacggtttactttcccgttcggtggtaaccggtttcggaacccgggtaaacgggacggtaaacgggtacggaaagttccgaaacgtaaccggaacgttggtcgggacttacggaaccgaactttaaccg

SEQ ID NO: 327794 - DNA, 695 bp, Homo sapiens
  misc_feature: GZ8MTXP01BWQWD.17.4.A04.1.454.CMB.2.raw
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagacgcctcctgcatagtgataggaaagtactatttgtattggtacctgacgagaggcaggccagtctccactatctactatctatgtaactttccagtcgattctccgtaggatcgccagtaaagttacgggttcagggtcgggacgtacgggtccgggtagacggaccacgtaagttaactttacgaactaacgtaagtaaaaacgtccgaagggtcccgggggtagggacggtcgttagggaagggttaaggtttaggtttacgggggttttaattacgttaggaccttaaggttacgtaacgtttaagggtttacctttttacccggttccggttacggggttaaccggtttaccgggaaccgggtaaaccggggttaaaccggtaaacgggtaacgggttaaaacgttaccgttaaccggtaaccggtaaacggtaaccggttacgggtaccgttacgtaacccggttaacgttaacccg

SEQ ID NO: 327795 - DNA, 621 bp, Homo sapiens
  misc_feature: GZ8MTXP01EJTLB.17.4.A04.1.454.CMB.2.raw
  modified_base (274)..(274): a, c, t, g, unknown or other
  misc_feature (274)..(274): n is a, c, g, or t
  modified_base (278)..(278): a, c, t, g, unknown or other
  misc_feature (278)..(278): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcaccctggacagccgcctccatctcctgcaagtctagtcagacgcctcctgcatagtgataggaaagtctatttgtattggtacctgacagaagcaggccagtcnccanatctacctatctatgtaagttcagtcgtattctcctggagtcgaccagtaattacgggttcaggtcggacgtacgggtcggggtaccagggtaccacgtagtatttacaactactaagtaaaactcggaacggtccggggtagggacggagtaggtaaggtaaggtttaggtttagggggtttattacgtagctagtcggtacgttaaggtttaccttttccgtccggttcggtaacggtttcgggacccggtaaacgggttaaccggaaagggtaacgttaaaacgttccgaacgtaaaccggtacgttcggtacggtcgttacgaaccttaaccgttaacg

SEQ ID NO: 327796 - DNA, 559 bp, Homo sapiens
  misc_feature: GZ8MTXP01BDJ7F.17.4.A04.1.454.CMB.2.raw
  modified_base (278)..(278): a, c, t, g, unknown or other
  misc_feature (278)..(278): n is a, c, g, or t
  modified_base (282)..(282): a, c, t, g, unknown or other
  misc_feature (282)..(282): n is a, c, g, or t
tcagcgtagactagcacgaccggtgctcgatttagagtagtgatcaggacttctcagttcatcttctcaccatgaggctccctgctcagctcctggggctgctaatgctctggatcctggatccagtgcggatattgtgatgacccagactccactctctctgtccgtcaccctggacagccgctcatctcctgcaagtctagtcagacgcctcctgactatagtagatacgggaaatctatttgtatcggtacctgacaggaacggcaggccagtcnccanatctactaagtctatgtaagtttccagtctattctaccgtggagtcgaccaaggtattacggttcaaggtcgggacagggtcgggtacaggtcactagtacttcgacaacgtagaaaacgtcgaacggtccgggtagacgtgtagtagggtagttaggtttaggggtttataggtgtacagtagtacgtaagttactttcggtcgtggtaacgtcgacgtaaaggaccgtaaggtacgaacgttcaacgaactacggtgtcggcttcgcaaccgtaa

SEQ ID NO: 327797 - DNA, 666 bp, Homo sapiens
  misc_feature: GZ8MTXP01DT13V.17.4.A04.1.454.CMB.2.raw
  modified_base (282)..(282): a, c, t, g, unknown or other
  misc_feature (282)..(282): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctcgtccgtccaccctggacagccgcctcatctctgactaagtctagtcagacgtccctcctgactataggtagagtaggaaatcttattgtatggtactgacagagcaggcagtcctcanctctactatctatagtacttcagtctattcgtccgtggagtcgacctaggtaacttaggttcgaggtggacgcggtcggggtacagggacctatagtacttacgaactaacgtagaaaacgtcgaacgggtccggggtaggacgtagttaggaagggttaagtttaggggttttaggggtttaacttacgtacggtactaaggttaggttaaccggtttaaggttttcccgtttttacccggttccggggttaacgggggttaaccggtttaccggggaaaccggtaaaccgggggttaacccgtaaaaggggtacgttaaaccgttacgttaaccgtaacggtaacgtttgggcgtaccgttacggaacccgttaaccctttg

SEQ ID NO: 327798 - DNA, 531 bp, Homo sapiens
  misc_feature: GZ8MTXP02ILY77.17.4.A04.1.454.CMB.2.raw
  modified_base (279)..(279): a, c, t, g, unknown or other
  misc_feature (279)..(279): n is a, c, g, or t
  modified_base (389)..(389): a, c, t, g, unknown or other
  misc_feature (389)..(389): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagagcctcctgcatagtgatggaaagacctatttgtattggtacctgcagaaggcaggccagtctccanatctctaatctatgaagtttccagtcgattctctggatgccagataggttcagtggcagcggggtcagggcacagatttcacactagaaaatcaagccgggtaggagggngtagagtagtagttaggtttagttagtagtgagtgtagtagttacgtttcgttcgttacggtacggttacggtacggaacggaacgaacggtacggtaacgtacgaacgaacgtaacgtacgtacgtacgtcgtacactacg

SEQ ID NO: 327799 - DNA, 529 bp, Homo sapiens
  misc_feature: GZ8MTXP02F20R1.17.4.A04.1.454.CMB.2.raw
  modified_base (236)..(236): a, c, t, g, unknown or other
  misc_feature (236)..(236): n is a, c, g, or t
  modified_base (311)..(311): a, c, t, g, unknown or other
  misc_feature (311)..(311): n is a, c, g, or t
  modified_base (347)..(347): a, c, t, g, unknown or other
  misc_feature (347)..(347): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagagcctcctgcatagtgatggaaanactatttgtattggtacctgcagaaggcaggccagtctccacatctcctaatctatgaagtttccagtcgattcnctggagtgccagattaggttcagtggcaggcgggtnagggcacagtattcacactagaaaatcgaggcgggtaggagcgtaggaggtagtagtttaggggtttattacgtgtacagtgtacgtaaggttactttccgttacggtcggtacgttcggaccgaacgggaccgaaggtacggaaactcgaacgaacgaacgtggtacggctacgacactac

SEQ ID NO: 327800 - DNA, 566 bp, Homo sapiens
  misc_feature: GZ8MTXP02G1E2P.17.4.A04.1.454.CMB.2.raw
  modified_base (236)..(236): a, c, t, g, unknown or other
  misc_feature (236)..(236): n is a, c, g, or t
  modified_base (275)..(275): a, c, t, g, unknown or other
  misc_feature (275)..(275): n is a, c, g, or t
  modified_base (343)..(343): a, c, t, g, unknown or other
  misc_feature (343)..(343): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagagcctcctgcatagtgatggaaanacctatttgtattggtacctgcagagcaggcagtctcanatctctaatctatgtaagtttccagtcgattctctggagtgcagattaggttcagtggcagcggggtnagggcacagtattcacactagaaaatcgaaggccgggtaggaggcgtaggaggtagttaggtttagggggtttaattacgttgacgtagtagtacgtaaggtttacttttccgttccggttagggtaaccggtttccgggaccggtaaacggggtaaccgtaaagggtacggtaaaacgtacgaacgaacggtaacgtacggtaggacgtcgaccgacctacg

SEQ ID NO: 327801 - DNA, 493 bp, Homo sapiens
  misc_feature: GZ8MTXP02GMU0K.17.4.A04.1.454.CMB.2.raw
  modified_base (312)..(312): a, c, t, g, unknown or other
  misc_feature (312)..(312): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagagcctcctgcatagtgatggaaagcctatttgtattggtacctgcagaaggcaggccagtctccacatctcctaatctatgaagtttccagtcgatttcnctggatgccagataggttcagtggcagcgggtcagggcacagatttcacactagaaaatcagccgggtggagctgaggatagttggggtttattacgtgcatgctaaggttatttccgtcgtggtacgttcggacgaacggaccgaaggtagaaactcacaacgaactgtggctgcactac

SEQ ID NO: 327802 - DNA, 544 bp, Homo sapiens
  misc_feature: GZ8MTXP02JBEGL.17.4.A04.1.454.CMB.2.raw
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagagcctcctgcatagtgatggaaagacctattgtattggtacctgcagaaggcaggccagtctccacatctcctaatctatgtaatttccagtcgattctctggatgcagattaggttcagtggcagcgggtacagggcacagtattcacactagaaaatcaggccggggtggaggctaggagtagttagtttaggggtttattacgtagacgtagtagacgtaaggttacttttccgttcggtacggtacggtttcggaccgaaacggggtaaccgtaaagggtacggtaaaactacgaacgaacggaactaggtcggactcgacacctacg

SEQ ID NO: 327803 - DNA, 492 bp, Homo sapiens
  misc_feature: GZ8MTXP02JN9O4.17.4.A04.1.454.CMB.2.raw
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagagcctcctgcatagtgatggaaagacctatttgtattggtacctgcagaaggcaggccagtctccacatctcctaatctatgaagtttccagtcgattctcctggagtgccagataggttcagtggcagcggtcaggcacagatttcacactgaaaatcagcgggtggaggctagaggatagttgggttattacgtgcatgctaaggttatttctccgtggtacgttcggacctaagggaccaaggtcggaaatcgaacaacgaactgtggctgcaccta

SEQ ID NO: 327804 - DNA, 486 bp, Homo sapiens
  misc_feature: GZ8MTXP02G1Q0L.17.4.A04.1.454.CMB.2.raw
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagagcctcctgcatagtgatggaaagacctatttgtattggtacctgcagaaggcaggccagtctcacatctcctaatctatgaagtttccagtcgattctctggatgccagataggttcagtggcagcgggtcagggcacagattcacactagaaaatcaagccgggtggaggctgaggatagttggggttattacgtgcatgactaaggtatttcgttcgtggtacgttcggcaacggggacaaggtagaactcacaagactagtgctgcacta

SEQ ID NO: 327805 - DNA, 539 bp, Homo sapiens
  misc_feature: GZ8MTXP02HCSWI.17.4.A04.1.454.CMB.2.raw
  modified_base (274)..(274): a, c, t, g, unknown or other
  misc_feature (274)..(274): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcaccctggacagccggcctcatctcctgcaagtctagtcagagcctctgcatagtgatggaaagacctattgtattggtacctgcagaagcaggccagtctccanatctcctaatctatgaagtttcagtcgattctctggatgcagattaggttcagtgcagcggtcaggcacagattcacactagaaaatcgaaggccgggtaggaggcgtaggaaggtagttaggtttaggggtttattacgtgtacgtagtgacgtaaggtttacttttaccgttcggtcggtacgttacggaccggtaaacgggaccgtaaaggtacggaaaactacgaacgaacgaaacgtaggtcggactcggaccaactacg

SEQ ID NO: 327806 - DNA, 588 bp, Homo sapiens
  misc_feature: GZ8MTXP02H0V20.17.4.A04.1.454.CMB.2.raw
  modified_base (281)..(281): a, c, t, g, unknown or other
  misc_feature (281)..(281): n is a, c, g, or t
  modified_base (349)..(349): a, c, t, g, unknown or other
  misc_feature (349)..(349): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagagcctcctgcatagtgataggaaagtaccttatttgtattggtacctgcagaagcaggccagtctccanatctacctaatctatgtaatttccagtcattctctggatgccagattaggttcagtggcaggcgggtnagggcacagtattacactactaagaaaactcgaaggtccggggtaggaggtcgtaggaaggtaagtttaggtttagggggttttaattacgtgtacgtagtagtacgtaaaggtttacttttcccgttcggttgggtaccggttcggtaaccggaaacggggtaaaccgtaaagggtacggaaaacgttaccgaaacgtaacggtaacgttaggtacggtacgtacggacctaactacg

SEQ ID NO: 327807 - DNA, 530 bp, Homo sapiens
  misc_feature: GZ8MTXP02I8SEH.17.4.A04.1.454.CMB.2.raw
  modified_base (277)..(277): a, c, t, g, unknown or other
  misc_feature (277)..(277): n is a, c, g, or t
  modified_base (311)..(311): a, c, t, g, unknown or other
  misc_feature (311)..(311): n is a, c, g, or t
  modified_base (392)..(392): a, c, t, g, unknown or other
  misc_feature (392)..(392): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagagcctcctgcatagtgatggaaagcctattgtattggtacctgcagaaggcaggccagtctccanatcctcctaatctatgaagtttccagtcgattcnctggatgccagataggttcagtggcagcggggtcaagggcacagtattcacactagaaaatcaaggccgggtagggacggngtaggaaggtattagtttggggtttattacgtgacagtgacgtaaggttatttccgttcgtggtacggtttcggacgaaacgggtaccgaagggtaggaaaacgtcgaacgaacgaacgtgtcggactcggacactac

SEQ ID NO: 327808 - DNA, 535 bp, Homo sapiens
  misc_feature: GZ8MTXP02G1MW8.17.4.A04.1.454.CMB.2.raw
  modified_base (310)..(310): a, c, t, g, unknown or other
  misc_feature (310)..(310): n is a, c, g, or t
  modified_base (346)..(346): a, c, t, g, unknown or other
  misc_feature (346)..(346): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagagcctcctgcatagtgatggaaagacctatttgtattggtacctgcagaaggcaggccagtctcacatctcctaatctatgaatttcagtcgatttcncctggagtgccagtataggttcagtggcagcgggtnaggcacagattcacactagaaaatcgagccgggtggaggctggaggtatagtttggggtttattacgtgctagtgtacgtaaggttactttccgttacggttggtacggttcggaccgtaaacgggtaccgtaagggttacggaaactacgaacgaacgtaacgtaggtcggacgtacgacgacctacg

SEQ ID NO: 327809 - DNA, 664 bp, Homo sapiens
  misc_feature: GZ8MTXP02IXI7A.17.4.A04.1.454.CMB.2.raw
  modified_base (236)..(236): a, c, t, g, unknown or other
  misc_feature (236)..(236): n is a, c, g, or t
  modified_base (267)..(267): a, c, t, g, unknown or other
  misc_feature (267)..(267): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagagcctcctgcatagtgatggaaancctattgtatggtacctgcagaaggcagtcnctagtcctacactctcctactactactatagttacttcagtactacttccgtcgtaggtacgtcgacgtagttagttcggttactagggtcggacgacgggtcgggacgacggaccagtaagttacttcgaaacctaagtaaacgtaaaacgtcggaacggggtccgggtagggaaccgtggttaaagggaaggtaagttttagggggtttaagggttttaaactcgttacggattacggtagtaacgttaaacgggttttacctttccccgttcggggtaaccgggtttaccgggtttacccggaaaccggggtaaaaccgggtaaaccggtaaggggtaaacggttaaactaaccgaacgtaacggtaacgttggtacggctacggaccctaacg

SEQ ID NO: 327810 - DNA, 565 bp, Homo sapiens
  misc_feature: GZ8MTXP02HY96Z.17.4.A04.1.454.CMB.2.raw
  modified_base (271)..(271): a, c, t, g, unknown or other
  misc_feature (271)..(271): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccgcctccatctcctgcaagtctagtcagagcctctgcatagtgatggaaagcctattgtatggtacctgcagaagcaggcagtctcanatctcctaatctatgtaagttcagtcgattctctggagtgcagtataggttcagtgcagcggtcaggcacagattcacactagaaaatcgaggaccgggtaggaggcgtaggaaggtagttaaggttttagggggtttaacttaacgtgtactaagtaggtacgtaaagggttaactttttaccgtttccggtacgggtaccggtttacgggaccgtaaacgggaaccgaaagggttacggaaaacttaccgaaacgaacgtaaacgtggtacggactacggacctaaccgtag

SEQ ID NO: 327811 - DNA, 533 bp, Homo sapiens
  misc_feature: GZ8MTXP02GWO6L.17.4.A04.1.454.CMB.2.raw
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagagcctcctgcatagtgatggaaagacctatttgtattggtacctgcagaaggcaggccagtctccacatctacctaatctatgtaagtttccagttcgatttctccgtggagtgccagtattagggttcagtggccaggcggggtacaggcacagtatttcactactaagaaaatcgaggccggggtggaggcgtaggaggtattaggtttggggtttattacgtgcagtgacgtaaggttactttcgttcgtggtacgttcggacgtaacgggaccgtaaggtacggaactacgacaacgaactgtcgctcgacactacg

SEQ ID NO: 327812 - DNA, 559 bp, Homo sapiens
  misc_feature: GZ8MTXP02HJN61.17.4.A04.1.454.CMB.2.raw
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccgcctccatctcctgcaagtctagtcagagcctcctgcatagtgataggaaagtaccttatttgtattggtacctgcagaaggcaggccagtctccacatctactaatctatgaatttccagtcattctccgtggatgaccagtattaggttcaggtggcaggcggggtcagggcacgagtattcaacactagaaaatcgaggccgggtggagcgtaggaggtattaggtttaggggttattacgtgacgtagtagtacgtaaggtttcttttaccgtcgttacgggtaccgttaccggaaccggtaaacgggtaaaccgtaaacggtaggaaaacgtacgaacgaacgtaacgtggtacggctacgactactacg

SEQ ID NO: 327813 - DNA, 507 bp, Homo sapiens
  misc_feature: GZ8MTXP02GE10R.17.4.A04.1.454.CMB.2.raw
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagagcctcctgcatagtgatggaaagacctattgtattggtacctgcagaaggcaggccagtctccacatctctaatctatgaagtttccagtcgattctctggatgccagattaggttcagtggcagcgggtcaggcacagatttcacactagaaaatcaaggccgggtggaggcgtaggaggattagttggggttattacgtgcatgactaaggttatttccgttcgtggtacgttcggaccgtaagggaccaaggtagaaactcaacgaacgaacgtgtacggctcgacactac

SEQ ID NO: 327814 - DNA, 525 bp, Homo sapiens
  misc_feature: GZ8MTXP02GA5JY.17.4.A04.1.454.CMB.2.raw
  modified_base (236)..(236): a, c, t, g, unknown or other
  misc_feature (236)..(236): n is a, c, g, or t
  modified_base (279)..(279): a, c, t, g, unknown or other
  misc_feature (279)..(279): n is a, c, g, or t
  modified_base (348)..(348): a, c, t, g, unknown or other
  misc_feature (348)..(348): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagagcctcctgcatagtgatggaaanacctatttgtattggtacctgcagaaggcaggccagtctccanatctcctaatctatgaatttccagtcgattctcctggatgccagattaggttcagtggctaggcgggtnaggcacagtattcacactagaaaatcgaagccgggtggaggcgtaggtaggattagttagggggtttattacgtagacgtagtgtacgtaaggttatttccgttcggtggtacgttcggacgtaaacgggacgaaggtacgaaactacgacaacgaacgtcggtaggctcgcactac

SEQ ID NO: 327815 - DNA, 554 bp, Homo sapiens
  misc_feature: GZ8MTXP02GXQ06.17.4.A04.1.454.CMB.2.raw
  modified_base (233)..(233): a, c, t, g, unknown or other
  misc_feature (233)..(233): n is a, c, g, or t
  modified_base (274)..(274): a, c, t, g, unknown or other
  misc_feature (274)..(274): n is a, c, g, or t
  modified_base (306)..(306): a, c, t, g, unknown or other
  misc_feature (306)..(306): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcaccctggacagccgcctcatctcctgcaagtctagtcagagcctcctgcatagtgatggaaancctattgtattggtacctgcagaaggcaggccagtctccanatctctaatctatgaagtttccagtcgattcncgtggatgccagattagggttcagtggcaggcgggtcaggcacagtatttcacactagaaaatcgaggccgggtaggaggcgtaggaggtaagttaggtttaggggtttaattacgtgacgtagtgacgtaaggttattttccgttcgttcggtacggttaccgggaccgtaaacggggtaaccgtaaacgggtaggtaaaacgtcgaacgaacgtaaacgtaggtacggcgtacggtaccacctacg

SEQ ID NO: 327816 - DNA, 571 bp, Homo sapiens
  misc_feature: GZ8MTXP02IF232.17.4.A04.1.454.CMB.2.raw
  modified_base (387)..(387): a, c, t, g, unknown or other
  misc_feature (387)..(387): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagagcctctgcatagtgatggaaagctattgtattggtactgcagaagcaggcagtctcacatctctaatctatgtaagtttccagtcgattctccgtggagtgccagattaggttcagtggcgagcggggtcaggcacagatttacacactagaaaatcgaggcgggtagggacgngtaggaggtagttaggtttaggggtttattacgtgctagtagtacgttaaaggtttcgttttaccgttcgggttacggtaccggtttacgggaccggtaaacgggtaaaccgaaagggttacggaaaacgttcgaaaccgtaaccggtaaacgtcgggtacggtacgtacggtacaaccctacg

SEQ ID NO: 327817 - DNA, 552 bp, Homo sapiens
  misc_feature: GZ8MTXP02H7XRH.17.4.A04.1.454.CMB.2.raw
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagagcctcctgcatagtgatggaaagccttattgtattggtacctgcagaaggcaggccagtctcacatcctctaatctatgtaagtttccagttcatttctccgtggagtgccagattaggttcagtggcaggcgggtcagggcacagatttacacactagaaaatcgaggccggggtggaggcgtaggaggtagttaggtttaggggtttattacgtgactagtgtacgtaaaggtttactttccgttccggttacggtacggtttcggaccgtaaacggggaaccgtaaaggtaggaaacgtcgaacgaacgtaacgtggtacggcgtcggactacacg

SEQ ID NO: 327818 - DNA, 635 bp, Homo sapiens
  misc_feature: GZ8MTXP02IIXOL.17.4.A04.1.454.CMB.2.raw
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcaccctggacagccgcctccatctcctgcaagtctagtcagacgcctctgcatagtgataggaaacgtaccttattgtattggtacctgacaagaaggcaggccagtcctccacatcctacctaatctatgtaatttccagtcgtattctccgtggagtcgacctaagtagttacgggttcagggttggaccgtagggccggggtacaagggtaccaacgtaagtaactttacccaaactaacgttaaagaaaaacgtccggaacgggtcccgggggtagggacgggtcgtagggaagggtagtttaagggttttaggggtttaattacgtgtactagtacgtacgttaacggtttacttttcccgttcggtacggttaccggttaccgggaccgaaacgggtaaccgtaaagggtacgaaactacgaaccgaacgtaacgtggtacggactcggacctacctacg

SEQ ID NO: 327819 - DNA, 514 bp, Homo sapiens
  misc_feature: GZ8MTXP02JBC9B.17.4.A04.1.454.CMB.2.raw
  modified_base (311)..(311): a, c, t, g, unknown or other
  misc_feature (311)..(311): n is a, c, g, or t
  modified_base (346)..(346): a, c, t, g, unknown or other
  misc_feature (346)..(346): n is a, c, g, or t
  modified_base (435)..(435): a, c, t, g, unknown or other
  misc_feature (435)..(435): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagagcctcctgcatagtgatggaaagacctattgtattggtacctgcagaagcaggccagtctccacatctcctaatctatgaagtttccagtcgatttcncctggagtgccagattaggttcagtgcagcgggtnagggcacagtattcacactagaaaactcgaaggcgggtggaggcgtggaggattagttggggtttattacgtgctagtgtcgaaggttnttttccgtcgtggtacgttcggacgaaacgggaccgaagggtagaaactcgacgaacgaacgtgtcggctcgcactacg

SEQ ID NO: 327820 - DNA, 556 bp, Homo sapiens
  misc_feature: GZ8MTXP02IYCOJ.17.4.A04.1.454.CMB.2.raw
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctcatctcctgcaagtctagtcagacgcctcctgcatagtgataggaaagtaccttatttgtattggtacctgcaagaggcaggccagtctccacatctaccttttaactatgtaacgtttccagtcatttctcgtggatgccagtattaggtcagtggcaggcgggtgaggcaacagtattcacactaagaaaatcgaaggcgggtaggaggcgtaggaggtagttaggtttaggggtttattacgtgactagtagtacgtaaacggtttcttttccgtacggtcggtacgttcggaccggtaacgggtaccgaaggtacggaaactcgaaacgaacggaacgtggtacggtactcgtacgacttacg

SEQ ID NO: 327821 - DNA, 510 bp, Homo sapiens
  misc_feature: GZ8MTXP02JID3J.17.4.A04.1.454.CMB.2.raw
  modified_base (278)..(278): a, c, t, g, unknown or other
  misc_feature (278)..(278): n is a, c, g, or t
  modified_base (501)..(501): a, c, t, g, unknown or other
  misc_feature (501)..(501): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtcccgtcacccctggacagccggcctccatctcctgcaagtctagtcagagcctcctgcatagtgatggaaagcctatttgtattggacctgcagaaggcaggccagtctccanatctcctaatctatgaagtttccagtcatttctcctggatgccagattagggttcagtggcagcgggtcaggcacagatttcacactagaaaatcgaggccgggtaggagcgtaggaggattagttgggtttattagtgcagtgacgtaagttatttccgttcgtggtacgttcggaccgaacggacgaacggtagaacgtcaacgaacgaacgtaggcgtcncgacactac

SEQ ID NO: 327822 - DNA, 526 bp, Homo sapiens
  misc_feature: GZ8MTXP02FZSLU.17.4.A04.1.454.CMB.2.raw
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagagcctcctgcatagtgatggaaagacctatttgtattggtacctgcagaaggcaggccagtctccacatctcctaatctatgaagtttccagtcgattctctggagtgccagataggttcagtggcagcgggtcagggcacagattcacactagaaaatcaagccgggtggaggctagaggatagttggggtttattacgtgcatgcgtaaaggttattttaccgttccggtggtacggtttcggaccgtaaacggggaccgaaagggtaggaaaacgtcgaacgaacgaaacgtgtacggcgtgaccacctac

SEQ ID NO: 327823 - DNA, 528 bp, Homo sapiens
  misc_feature: GZ8MTXP02GJS69.17.4.A04.1.454.CMB.2.raw
  modified_base (234)..(234): a, c, t, g, unknown or other
  misc_feature (234)..(234): n is a, c, g, or t
  modified_base (274)..(274): a, c, t, g, unknown or other
  misc_feature (274)..(274): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcaccctggacagccgcctccatctcctgcaagtctagtcagagcctcctgcatagtgatggaaanactattgtattggtacctgcagaaggcaggccagtctcanatctcctaatctatgaagtttccagtcgattctctggatgccagattaggttcagtggcagcgggtcaggcacagtattcacactaagaaaatcgaaggccggggtggaggcgtaggaggtagttagtttaggggtttattacgtgactagtagtacgtaaggttacttttaccgttcggtaggtaccgttcggaccgtaaacgggaccaagggtacgaaagtcaacgaacgaactacgtggactcgacactac

SEQ ID NO: 327824 - DNA, 574 bp, Homo sapiens
  misc_feature: GZ8MTXP02INI9H.17.4.A04.1.454.CMB.2.raw
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagagcctcctgcatagtgatggaaagacctatttgtattggtacctgcagaaggcaggccagtctccacatctcctaatctatgtaagtttccagtcgattctctggagtgccagattaggtcagtggcagcggggtcagggcacagatttcacactagaaaatcagccgggtaggaggcgtaggaggtagttagtttaggggtttattacgtgacgtagtagtacgtaaagggttcttttacccgttcggttacggtaaccggtttcgggaaccgtaaacggggtaaccgaaagggttacgggtaaaacttaccgaaacgtaacggaaacgtggttacgggcttacggacctaacccgtaacg

SEQ ID NO: 327825 - DNA, 554 bp, Homo sapiens
  misc_feature: GZ8MTXP02H32OV.17.4.A04.1.454.CMB.2.raw
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagagcctcctgcatagtgatggaaagacctattgtattggtacctgcagaggcaggcagtctcacatctctaatctatgaagtttccagtcgattctctggagtgccagattaggttcagtggcagcggtcaggcacagattcactactagaaaatcaggccgggtaggaggtctagaggagttagtttggggtttattacgtgtacgtatgtacgtaaggttagttttccgttccgttcgggtacggtttccgggtaccgtaaacgggtaacccgtaaagggtacggtaaaacgttacgaaccgtaacgtaaccgtaggtcggtaccgtacgcgtaccctaag

SEQ ID NO: 327826 - DNA, 519 bp, Homo sapiens
  misc_feature: GZ8MTXP02HT9BK.17.4.A04.1.454.CMB.2.raw
  modified_base (312)..(312): a, c, t, g, unknown or other
  misc_feature (312)..(312): n is a, c, g, or t
  modified_base (319)..(319): a, c, t, g, unknown or other
  misc_feature (319)..(319): n is a, c, g, or t
  modified_base (386)..(386): a, c, t, g, unknown or other
  misc_feature (386)..(386): n is a, c, g, or t
  modified_base (413)..(413): a, c, t, g, unknown or other
  misc_feature (413)..(413): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgaacccagactccactctctctgtccgtcacccctggacagccggcctccatctcctgcaagtctagtcagagcctctgcatagtgatggaaatcctatttgtattggtacctgcagaaggcaggccagtcctcacatctacctaatctatgtaagtttccagtcattcnctgagtnaccagtatagttcagtggcagcgggtcaggcacagtattcacactagaaaatcgagcgggtgagcgngaggattagttagggtttattagtcgngatagacgtaaggttactttccgttcgtacggtacgtttcggaccgtaaacgggaccgtaagggtacgaaacgtacaactaacgaacgtggtcggctcgcacctag

SEQ ID NO: 327827 - DNA, 544 bp, Homo sapiens
  misc_feature: GZ8MTXP02H6IKX.17.4.A04.1.454.CMB.2.raw
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagagcctcctgcatagtgatggaaagcctattgtattggtacctgcagagcaggccagtctcacatctcctaatctatgtaagtttccagtcgattctctggatgccagatagttcagtggcagcggtcaggcacagattacacactagaaaatcgaaggccgggtggagcgtgaggtagtagtttagggtttagttagtagtcgagtagtacgtaaggttaacgtttacgtttccgttcggtacggttacggtaccggtaacgggaaccggtaaacggtaaggaaacgtaacgaacgaacgtaaccgtacggtaggtacgtcggacgactacg

SEQ ID NO: 327828 - DNA, 564 bp, Homo sapiens
  misc_feature: GZ8MTXP02HULBS.17.4.A04.1.454.CMB.2.raw
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagagcctcctgcatagtgatggaaagaccttatttgtattggtacctgcagaaggcaggccagtctccacatctactaatctatgtaatttccagttcgattctcgtggagtgaccagtagttaggtcaggtggcagggtcggggtcagggcacgagtattcaactactagaaaatcgaggccggggtaggaggcgtggaggtagttaggtttggggtttattacgtgcgagtgtacgtaaggtttacttttccgttcggtcgggtaccggtttcgggaccggaaacgggtaaccgtaaagggtacggtaaactacgaacgaacgtaacgtggtacggcgtacgactacgtacg

SEQ ID NO: 327829 - DNA, 505 bp, Homo sapiens
  misc_feature: GZ8MTXP02IAOK4.17.4.A04.1.454.CMB.2.raw
  modified_base (273)..(273): a, c, t, g, unknown or other
  misc_feature (273)..(273): n is a, c, g, or t
  modified_base (361)..(361): a, c, t, g, unknown or other
  misc_feature (361)..(361): n is a, c, g, or t
  modified_base (408)..(408): a, c, t, g, unknown or other
  misc_feature (408)..(408): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagagcctctgcatagtgatggaaagcctattgtatggtacctgcagaagcaggccagtctcanatctactaatctatgtaatttccagtcattctcgtggagtcgaccagtattaggttcaggtggcaggcgggtcaggcacagattacanactagaaaatcgagcgggtgagctagaggattagttgggttatacgngcagtgactaaggttatttccgttcgtggtacgttcggaccgaaacggaccgaaggtagaaactcaacgaacgaactaggtcggactcgacactacg

SEQ ID NO: 327830 - DNA, 545 bp, Homo sapiens
  misc_feature: GZ8MTXP02FYCAZ.17.4.A04.1.454.CMB.2.raw
  modified_base (281)..(281): a, c, t, g, unknown or other
  misc_feature (281)..(281): n is a, c, g, or t
  modified_base (317)..(317): a, c, t, g, unknown or other
  misc_feature (317)..(317): n is a, c, g, or t
  modified_base (354)..(354): a, c, t, g, unknown or other
  misc_feature (354)..(354): n is a, c, g, or t
  modified_base (394)..(394): a, c, t, g, unknown or other
  misc_feature (394)..(394): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagagcctcctgcatagtgataggaaataccttatttgtattggtacctgcagaaggcaggccagtctccanatctacctaatctatgtaagtttccagtcgtattcncgtggatgccagtattaggttcagtggcaggcgggtnaggcacagtattcacactagaaaatcgaggccgggtgagngtaggaggtattaggtttaggggtttattacgtgactagtgtacgtaaaggtttctttccgttcggtacggtacggttccggacgtaacgggtacgtaagggtacgtaaacgtcgaacgaacgtaacgtggtacggctacggaccactacg

SEQ ID NO: 327831 - DNA, 504 bp, Homo sapiens
  misc_feature: GZ8MTXP02FTQQ1.17.4.A04.1.454.CMB.2.raw
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagagcctcctgcatagtgatggaaagacctatttgtattggtacctgcagaaggcaggccagtctccacatctcctaatctatgaagtttccagtcgattctctggagtgccagattagggttcagtggcagcgggtcaggcacagatttcacactagaaaatcaagccggggtggaggcgtgaggattagttggggtttattacgtgcatgctaaggttatttaccgttcgtggacgttcggaccgaacgggaccaaggtaggaaactcacaacgaactgtcggctgcactac

SEQ ID NO: 327832 - DNA, 577 bp, Homo sapiens
  misc_feature: GZ8MTXP02HV0Q2.17.4.A04.1.454.CMB.2.raw
  modified_base (391)..(391): a, c, t, g, unknown or other
  misc_feature (391)..(391): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcaccctggacagccgcctccatctcctgcaagtctagtcagacgcctctgcatagtgatggaaagtacctattgtattggtacctgcagaaggcaggccagtctccacatctacctaaatctaatagtaacgtttccaagttcgattctctggatgcagataggttcagtggcagcggtcaggcacagattcacactagaaatcgaggccgggtaggacggngtaggaaggtagttaggtttagggtttattacgtagtacgtagtagtacgttaacggtttacttttccgttacggttacgggttaccggttacgggaccggtaaacgggaaccggtaaacgggtaacgtaaacgtaccgaaaccgtaacggtaacgtacggtacggtacgtacgacctaacgtacg

SEQ ID NO: 327833 - DNA, 745 bp, Homo sapiens
  misc_feature: GZ8MTXP02JZ9BX.17.4.A04.1.454.CMB.2.raw
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagacctccactctctctgtcccgtcacccctggacagccggcctccatctcctgcaagtctagtcagacgccctctgcatagtgataggaaagtaccttatttgtattggtacctgacaggaaggacgacgctacgtcctaccactactcctaacctaacttacttagttacggttaaccgtttaccgtacggttacttactttcgtccggtaggtagtcgaccgtagtaacggttacggttcgtagggtcggacgaggggtccgggtacgacgggtaccaacgtaacgttactttaccgaaaccgttaacgtaaaagtaaaacgtaccgggaacgggggttaccgggggtaagggacgggtacggttaaggggtaaaggttaaggttttaaggggttttagggggttttaaacttacggttagtacgtaggttacggtaacggtttaaacggttttccgttttacccggttaccggggttacgggttaccgggttacccgggtaaacggaaaccgggggtaaaccgtaaggggtaaacgtaaacgtaaccgaaaccgtaacggtaacggtggtacggtccgtacgacccgtactacg

SEQ ID NO: 327834 - DNA, 535 bp, Homo sapiens
  misc_feature: GZ8MTXP02F6W8G.17.4.A04.1.454.CMB.2.raw
  modified_base (357)..(357): a, c, t, g, unknown or other
  misc_feature (357)..(357): n is a, c, g, or t
  modified_base (366)..(366): a, c, t, g, unknown or other
  misc_feature (366)..(366): n is a, c, g, or t
  modified_base (392)..(392): a, c, t, g, unknown or other
  misc_feature (392)..(392): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcaccctggacagccggcctccatctcctgcaagtctagtcagagcctcctgcatagtgatggaaagacctatttgtattggtacctgcagaaggcaggccagtctccacatcctacctaatctatgaagtttccaagtcgtattctctggatgaccagattaggttcagtggcagcgggtcagggcanagattacanactagaaaatcaggcgggtgggaggngtaggaggtaagttagtttaggggtttattacgtagtacgagtgacgtaaggttactttccgttcgtacggtacgttcggaccgaaacgggacgaacggtagaaacgtcaacgaacgaacgtacgtacggcgtcgacactacg

SEQ ID NO: 327835 - DNA, 596 bp, Homo sapiens
  misc_feature: GZ8MTXP02IFJNV.17.4.A04.1.454.CMB.2.raw
  modified_base (237)..(237): a, c, t, g, unknown or other
  misc_feature (237)..(237): n is a, c, g, or t
  modified_base (430)..(430): a, c, t, g, unknown or other
  misc_feature (430)..(430): n is a, c, g, or t
tcagcgtagactagcacgaccggtgctcgatttagagtagtgatcaggacttctcagttcatcttctcaccatgaggctccctgctcagctcctggtgctgctaatgctctggatccctggatccagtgcggatattgtgatgacccagactccactctctctgtccgtcacccctggacagccggcctccatctcctgcaagtctagtcagagccctctgcatagtgataggaaanaccttatttgtattggtacctgacaggaagcaggccagtctcacatctactaatctatgtattccagtctattccctctaggagtcgactagtattagggtttcaaggttcgggacaggggcgggtacacgggactacgaggttaactttacaactaacgttagaaaactcgaacgggccggggtaggacggngtaggaggtaagttagggtttagggtttattacgtgtactagttgtacgttaaggtttactttccgttacggttacgggtacggttcggaaccgtaaacgggtaccgtaagggtaacggttaacacgaaccgacgtaacgtcggtacggtcgtacggacctaaccg

SEQ ID NO: 327836 - DNA, 586 bp, Homo sapiens
  misc_feature: GZ8MTXP02GBZ1L.17.4.A04.1.454.CMB.2.raw
  modified_base (236)..(236): a, c, t, g, unknown or other
  misc_feature (236)..(236): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagagcctcctgcatagtgatggaaanacctattgtattggtacctgcagaagcaggccagtctccacatctacctaatctatgtaagtttccagtcgattctctggatgccagattaggttcagtggcagcggggtcagggcacagtatttacaacactagaaaacgtcgaaggcccggggtggaggcgtagggaggtaagttagtttgggggtttaatttacgtgactagtagtacgtaagggttacttttccgtttcgggttggtaccggtttacgggaccggtaaacggggtaaacccggtaaagggtacgggtaaaacttaccgaaaccgtaacggaaaaccgttggtacggggtcctaggaccacctaacg

SEQ ID NO: 327837 - DNA, 574 bp, Homo sapiens
  misc_feature: GZ8MTXP02IH8E0.17.4.A04.1.454.CMB.2.raw
  modified_base (343)..(343): a, c, t, g, unknown or other
  misc_feature (343)..(343): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcaccctggacagccgcctccatctcctgcaagtctagtcagagcctctgcatagtgataggaaagtcctattgtattggtacctgacagaagcaggccagtcctcacatctacctaatctatgaagtttccagtcattctctggatgactagattaggttcagtgcagcggtanaggcacagtattcaacactagtaaaactcgaacggccgggtaggacggtcgtaggaagggtagttaggtttagggtttaattacgtagtacgtagtcgtacgtaaggtttacttttccgttaccggtcggtaaccggtttcgggacccgtaaagggtaaccgtaaagggtacggtaaaacttccgaaacgtaaccggtaaagtacggtcggacgttacgaccgtacctacg

SEQ ID NO: 327838 - DNA, 737 bp, Homo sapiens
  misc_feature: GZ8MTXP02GHN7W.17.4.A04.1.454.CMB.2.raw
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtccacccctggacagccggcctccatctcctgcaagtctagtcagagcctcctgcatagtgataggaaatacctattgtattggtacctgcagaagcaggccagtctccacatcctacctaatctatagtaacgtttccagtcgtattctccgtaggagtcgccgtaagtaacgttagggttccaagggttcgggaccgaggggtccgggggtacaacggggaccaaacgtaaggtaattttaccgaaactaacgttaaacgaaaaaacttccggaaacggggtcccgggggttagggaacggggtaccgtaggggtaaagggttaaagtttaaggggtttttaggggggttttaaaactttaccgttaggtaccgttaagttaggtaacggttaaaacgggttttaccgtttttacccggttttaccggggttacgggttacccgggtttaccggggaaacccggtaaaacgggggtaaaccgtaaagggggtaacggtaaaacgttaccgaaacgaaaccggtaaaccggtggttacggtaccgttacggaccgtaacccttaacgg

SEQ ID NO: 327839 - DNA, 514 bp, Homo sapiens
  misc_feature: GZ8MTXP02FH7QD.17.4.A04.1.454.CMB.2.raw
  modified_base (311)..(311): a, c, t, g, unknown or other
  misc_feature (311)..(311): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcaccctggacagccggcctccatctcctgcaagtctagtcagagcctcctgcatagtgatggaaagacctatttgattggtacctgcagaaggcaggccagtctccacatctcctaatctatgaagtttccagtcgatttcncctggatgccagattaggttcagtggcagcggtcaggcacagatttcacactagaaaatcgaagccggggtgggaggcgtgaggatagttggggtttattacgtgcagtgactaaggtatttccgttcgtggtacgttcggaccgaacgggaccgaaggtacggaaactcgaacaacgaacgtgtacggtctcggacactacg

SEQ ID NO: 327840 - DNA, 573 bp, Homo sapiens
  misc_feature: GZ8MTXP02ICBN7.17.4.A04.1.454.CMB.2.raw
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagagcctctgcatagtgatggaaagtctattgtattggtacctgcagaggcaggcagtctcacatctctaatctatgtaattccagtcgattctcgtggagtcgccagtattagggttcagttggcaggtcgggtcagggcacgtagatttcaacactagaaaatcgacggtccggggtaggacggcgtaggaggtagttaggtttaggggtttattacgtgactagttagactaaagttataacgtacgtaccgtttaccgtaacgttacgtttacgggacccggtaacgggggaccaaacggtccgtaagggaacgtaacgtaaccgtaaaacggtaaccgttggtacggtaccgtaccgg

SEQ ID NO: 327841 - DNA, 554 bp, Homo sapiens
  misc_feature: GZ8MTXP02G8E24.17.4.A04.1.454.CMB.2.raw
  modified_base (319)..(319): a, c, t, g, unknown or other
  misc_feature (319)..(319): n is a, c, g, or t
  modified_base (389)..(389): a, c, t, g, unknown or other
  misc_feature (389)..(389): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcaccctggacagccgcctcatctcctgcaagtctagtcagagcctctgcatagtgataggaaagacctattgtattggtactgcagaaggcaggccagtcctccacatcctacctaatctatgtaatttccagtcgattctcgtggagtnacctagattaggttcagtggcaggcggtcagcacagtattcacatagaaaatcgaggcgggtaggacggngtaggaggtaagttaggtttaggggttaattacgtgtactagtagtagtaacggtttacgtttccgttccggtaggtaccggttaccgggaccgtaaacgggtaaccgtaaagggtacgaaacgtacgaacgaacgaacgtggtacgtcgtacgactaccctacg

SEQ ID NO: 327842 - DNA, 517 bp, Homo sapiens
  misc_feature: GZ8MTXP02FNF8J.17.4.A04.1.454.CMB.2.raw
  modified_base (236)..(236): a, c, t, g, unknown or other
  misc_feature (236)..(236): n is a, c, g, or t
  modified_base (342)..(342): a, c, t, g, unknown or other
  misc_feature (342)..(342): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagagcctcctgcatagtgatggaaanacctatttgtattggtacctgcagaaggcaggcagtctcacatctctaatctatgaagtttccagtcgattctctggatgccagataggttcagtggcagcgggtnagggcacagtattacacactagaaaatcgagccgggtggaggcgtaggaggagttagttggggtttaattacgtgtacagtgacgtaaggttatttccgttcgtcggtacgttcggaccgaaacggaccgaaggtacggaaactacgaacgaacgacgtagtggactgacactac

SEQ ID NO: 327843 - DNA, 531 bp, Homo sapiens
  misc_feature: GZ8MTXP02JWO4E.17.4.A04.1.454.CMB.2.raw
  modified_base (236)..(236): a, c, t, g, unknown or other
  misc_feature (236)..(236): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagagcctcctgcatagtgatggaaanccttatttgtattggtacctgcagaaggcaggccagtctccacatctcctaatctatgaagtttccagtcgattctctggatgccagattaggttcaggtggcagcgggtcaggcacagtatttcacactagaaaatcgaggccgggtggaggcgtaggaggtagttagtttaggggtttattacgtgacgtagtgacgtaaggttacttttccgttcgtacggtaccgttcggaccgtaaacgggaccgaaggtacgaaactcgacgaacgtaacgtgtacgctcgctactacg

SEQ ID NO: 327844 - DNA, 541 bp, Homo sapiens
  misc_feature: GZ8MTXP02J2JOL.17.4.A04.1.454.CMB.2.raw
  modified_base (235)..(235): a, c, t, g, unknown or other
  misc_feature (235)..(235): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagagcctctgcatagtgatggaaanccttatttgtattggtacctgacaggaaggcaggccagtctccacatctacctaatctatgtaagttccagtcgattctctggatgctagattaggtcaggtggcaggcgggtcaggcacagtattacacactagaaatcgaaggtcgggtggaggctaggaggtagttaggttggggtttatacgtgctagtagacgttaaggttctttccgtcggtaggtaccgttacgggaccgtaaacggggacctaagggtacggaaaactcgaacgaacgtaacgtggtacggtcgtcggaccacgtacg

SEQ ID NO: 327845 - DNA, 643 bp, Homo sapiens
  misc_feature: GZ8MTXP02FYY55.17.4.A04.1.454.CMB.2.raw
  modified_base (374)..(374): a, c, t, g, unknown or other
  misc_feature (374)..(374): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagacgcctcctgcatagtgataggaaataccttattgtattggtacctgcagaaggcaggccagtctaccactactctacctaatctatcgtaagtttccagttcgtatttctcgtggtagtgaccagtagttaggttcaggtcgggacgagggtccggggtanacgggcaacgtagtactttacaactaactaagaaaactcgacgggtaccggggtggaggtcgtaggaaggttaagtttagggtttagggggtttaattacgtggtacgtagttaggtacgttaaacgggtttcttttacccggtttcggtacgggttaaccggtttaccgggaaaccggtaaacggggtaaccggtaaagggtacgggtaaaactccgaaaaccgtaacgtaaacgttcggtacggtaccgttacggacctaccgtacg

SEQ ID NO: 327846 - DNA, 588 bp, Homo sapiens
  misc_feature: GZ8MTXP02G01JF.17.4.A04.1.454.CMB.2.raw
  modified_base (287)..(287): a, c, t, g, unknown or other
  misc_feature (287)..(287): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagacgcctcctgcatagtgataggaaagtaccttatttgtattggtacctgacaaggaaggcaggccagtcctccanactcctacctaatctatagtaacgtttccagttcgtatttctccgtagggatcgacctagtagttaggttcaggtggcgaggcggggtacagggccaacgagtatttacaacgtaactaagaaaactcgaacggccggggtagggaggctaggaggtagttaggtttaggggtttaattacgtgacgtagtgtacgtaaggtttctttccgttcggtacggtacgttcgggacgtaaacgggtaaccgaagggtacgaaactacgtaacgaacgtacgtaggtacggactacgaccaactc

SEQ ID NO: 327847 - DNA, 676 bp, Homo sapiens
  misc_feature: GZ8MTXP02H2CZJ.17.4.A04.1.454.CMB.2.raw
  modified_base (276)..(276): a, c, t, g, unknown or other
  misc_feature (276)..(276): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagagcctctgcatagtgatggaaagccttattgtattggtacctgcagaaggcacgcagtctccanctctactatctatagttaacttcagtgtacttctccgtggtagtcgacgtaagtagttacgttcgagggtcgacgacggggcgtacggacgtacgaacagtactttacaactaacgtaaagtaaaacgtcggacggggtaccggggtagggacggtacgtagggtaaaggttagtttaggggttttaaggggttttaattaaccggtgtaagttaggttacggttaacggtttaaacggtttttaccgtttttaccccggttacgggttaaccgggttaccggtttaacccgggaccggggtaaaaccggtaaccgggtaaaggggtaaaacgtaacgttaccgaaaccggtaacccggtaagttcgggaccggtacgttaccggaacccttacctaccg

SEQ ID NO: 327848 - DNA, 564 bp, Homo sapiens
  misc_feature: GZ8MTXP02HU2YK.17.4.A04.1.454.CMB.2.raw
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagagcctcctgcatagtgataggaaagtccttatttgtattggtacctgcagaaggcaggccagtcctccacatcctactaatctatgtaagtttccagttcgattctcgtggagtgacctagagttagggttcaggttggcgaggccggggtcaggcacagtattcacataagtaaaatcgaggccgggtggaggcgtaggaggttagttaggtttaggggtttattacgtgtactagtagtacgtaaggtttacttttccgttcggttacggtaccggttcggaccgtaaacgggaccgtaaagggtacgaaactacgacgaacgtacgtaggtcggcgtacgaccacgtac

SEQ ID NO: 327849 - DNA, 530 bp, Homo sapiens
  misc_feature: GZ8MTXP02GQEJ8.17.4.A04.1.454.CMB.2.raw
  modified_base (214)..(214): a, c, t, g, unknown or other
  misc_feature (214)..(214): n is a, c, g, or t
  modified_base (426)..(426): a, c, t, g, unknown or other
  misc_feature (426)..(426): n is a, c, g, or t
  modified_base (435)..(435): a, c, t, g, unknown or other
  misc_feature (435)..(435): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagancctcctgcatagtgatggaaagacctatttgtattggtacctgcagaaggcaggccagtctcacatctcctaatctatgaagtttccagtcgattctcctggatgccagattaggttcagtggcagcgggtcagggcacagatttcacactagaaaatcgaaggccgggtggaggcgtagaggagttagttggggtttattacgtgctatgntaacggttntttaccgttcggtaggtacgttacggaccgaaacgggacctaaagggtacggtaaactcgaacgaacgtaacgtggtacggctacggacacctac

SEQ ID NO: 327850 - DNA, 660 bp, Homo sapiens
  misc_feature: GZ8MTXP02FJTGS.17.4.A04.1.454.CMB.2.raw
  modified_base (164)..(164): a, c, t, g, unknown or other
  misc_feature (164)..(164): n is a, c, g, or t
  modified_base (209)..(209): a, c, t, g, unknown or other
  misc_feature (209)..(209): n is a, c, g, or t
  modified_base (230)..(230): a, c, t, g, unknown or other
  misc_feature (230)..(230): n is a, c, g, or t
  modified_base (246)..(246): a, c, t, g, unknown or other
  misc_feature (246)..(246): n is a, c, g, or t
  modified_base (255)..(255): a, c, t, g, unknown or other
  misc_feature (255)..(255): n is a, c, g, or t
  modified_base (262)..(262): a, c, t, g, unknown or other
  misc_feature (262)..(262): n is a, c, g, or t
tcagcgtagactagcacgaccggtgctcgatttagagtagtgatcaggacttctcagttcatctctcaccatgaggctccctgctcagctcctgggctgctaatgctctggatccctggatccagtgcggatattgtgatgacccagacctccactctctcgtntccgtcacccgtgacagccgctccatctcctgcaagtctagcagncctctgcatagtgatggaaancctattgatggtaccngcagacgcngccatcnccactctctactatctagtagtaacgtttcagtcgtactttcgcgtaggacgtcgaccgtagtagttaggttcacgtcggtacgtcgtcggtacgacgacgtaacgtaacgttaacttaacctaaccgtaacgtaaacgtaaaacgtaaccgtacgggtaccgggggtacgggtacgggtacggtacggtacggttacgtttacggtttacgggttttacgttacgttacgtacgtacgtacgtaacgttaacggtttaaccgtttacccgtttaccggttacgggtaaccggtaaccggtaaccggtaaaccggtaaaccggtaaacggtaacggtaaacgtaaccgaaccgtaaccgtaacgtacggtacggtaccgtaccgtaccgtaccgtacg

SEQ ID NO: 327851 - DNA, 577 bp, Homo sapiens
  misc_feature: GZ8MTXP02IDS9Z.17.4.A04.1.454.CMB.2.raw
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcaccctggacagccggctccatctcctgcaagtctagtcagacgcctcctgcatagtgatggaaagtcctattgtattggacctgcagaaggcaggccagtctcacatctctaatctatgtaagtttccaagtcgattctcctggatgaccagattaggttcagtggcaggcgggtcagggctacgagatttacactactagaaaatcgaaggccggggtgggaggcgtaggaggtagttaggtttaggggtttattacgtagctagtggtactaaagggtttcttttccgttcggttaggttacggttcggtacccggtaaagggtacccgaaaagggttacggtaaaacgttaccgaacgtaaaccggtaaccgtggttacggggtactcggacctaaccgttacg

SEQ ID NO: 327852 - DNA, 575 bp, Homo sapiens
  misc_feature: GZ8MTXP02GM5BX.17.4.A04.1.454.CMB.2.raw
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcaccctggacagccggcctccatctcctgcaagtctagtcagagcctcctgcatagtgatggaaagacctatttgtattggtacctgacagaaggcaggccagtctccacatctacctaatctaatgaacgtttccagtcgtattctcctggatgccagtataggttcagtggcaggcggtcaggcacagtattcaacactagaaaatcgaaggccggggtaggaggcgtaggaaggtagttaaggtttaggggtttaattacgttagactagttaggacttaaaggtttacgttttccgttcggttcggtacggtttaccgggaccgtaaacggggaaccgtaaacgggtagggtaaaactccgaacgaacgtaaacgtcggttggacgtcggtacgacctaacg

SEQ ID NO: 327853 - DNA, 572 bp, Homo sapiens
  misc_feature: GZ8MTXP02IWVS3.17.4.A04.1.454.CMB.2.raw
  modified_base (346)..(346): a, c, t, g, unknown or other
  misc_feature (346)..(346): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagagcctcctgcatagtgatggaaagactattgtattggtacctgcagaaggcaggccagtctcacatctctaatctatgaatttccagtcgattctctggatgccaggtatagggttcagtggcaggccgggtancggcacagtattacacatacgaaatcaggacgggtggaggtcgtaggaggtagttaggtttggggtttaacttagtagtcgtagttagacgtaaggtttaacttttccgttccgttggtacggtttaccggaccggtaaacggggtaacccggtaaacggggtaggtaaaacgtacgaaaccgaacggtaaaccgttggtacggtaccgtcggtaccaccttaacg

SEQ ID NO: 327854 - DNA, 676 bp, Homo sapiens
  misc_feature: GZ8MTXP02HCC3B.17.4.A04.1.454.CMB.2.raw
  modified_base (180)..(180): a, c, t, g, unknown or other
  misc_feature (180)..(180): n is a, c, g, or t
  modified_base (276)..(276): a, c, t, g, unknown or other
  misc_feature (276)..(276): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcaccctggacngccgcctcatctctgcaagtctagtcagacgcctctgcatagtgataggaaagtaccttattgtattggtacctgcagaagcaggccagtctccanactcctactaatctatagtaactttccagtcgtatttctccgtaggtagtcgacctaagtacgttaggttcgaggtggcgagggtcgggtacagggacaactagttactttaccaacgtaacgtaaagtaaaacgtcggaacgggtaccggggtagggacggtacgtaagggtaaagggttaagtttaaggggtttttaggggtttaattaccggtaggtacttaagttacggtaacgtttaaacgggttttacctttttccgggttaccggttaacggggttaccggtttacccgggaaaccgggtaaaacggggtaaccggttaaaagggtaaacggtaaaacttaaccgaaacgtaaaccggtaaagttcggtacggtactacggacctaacttacg

SEQ ID NO: 327855 - DNA, 732 bp, Homo sapiens
  misc_feature: GZ8MTXP02IBBNZ.17.4.A04.1.454.CMB.2.raw
  modified_base (277)..(277): a, c, t, g, unknown or other
  misc_feature (277)..(277): n is a, c, g, or t
tcagcgtagactagcacgaccggtgctcgatttagagtagtgatcaggacttctcagttcatcttctcaccatgaggctccctgctcagctcctggtgctgctaatgctctggatccctggatccagtgcggatattgtgatgacccagactccactctctctgtccgtcacccctggacacgccggcctccatcctcctgcaagtctagtcagcgccctctgcatagtgatggaaatcctatttgattggtacctgacaggaagcaggccagtccnccacatcctacctaatctatagtaacgtttccaagtcgtatttcccgtacgtggacgtcgaccgtaaggtagtttagggttcaagggttcggggaccgaagggggtccgggggtacaaggggaccctaacgaggttacttttaccgaaacctaacgttaaaggtaaaaacgtccggaaacggggcccgggggttaggggaacgggtcggttaggggtaaagggttaggtttaagggtttttagggggtttttaacttacgttaggtacctaagttaggtaacgtttaaaacgggtttccgtttttacccggttacccggggttaggttaacccggggtttaccgggaaccggttaaaacgggggtaacccgtaaaaggggttacggtaaaaacgttaccgaaaacccggtaacgtaaaaccggttcggtaacgggtcctacggtaccctaaaccg

SEQ ID NO: 327856 - DNA, 601 bp, Homo sapiens
  misc_feature: GZ8MTXP02JIL1T.17.4.A04.1.454.CMB.2.raw
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtccacccctggacagcccggcctccatcctcctgcaagtctagtcagacgccctctgcatagtgataggaaagtaccttatttgtattcggacctgacaggaacggcacggccagtcctccacatcctacctaatctatgtaactttccagtctattctcgtggagtcgacctaggtagttagggttcaagggtggaccgtaggggccggggtacgaagggccaacgagttactttaccaactaacgtaagaaaacgtccggaacgggtccgggggtagggacggtacgtaggaaggtagtttaggtttaggggtttattacgtgtactagtagtacgtaagtttcgtttccgtcggtggtacggttacggacgaaacgggtacgaaggtacgaactcaacgaagtaacgtcggtcggactacgacacgtacg

SEQ ID NO: 327857 - DNA, 528 bp, Homo sapiens
  misc_feature: GZ8MTXP02HC3ZQ.17.4.A04.1.454.CMB.2.raw
  modified_base (277)..(277): a, c, t, g, unknown or other
  misc_feature (277)..(277): n is a, c, g, or t
  modified_base (347)..(347): a, c, t, g, unknown or other
  misc_feature (347)..(347): n is a, c, g, or t
  modified_base (353)..(353): a, c, t, g, unknown or other
  misc_feature (353)..(353): n is a, c, g, or t
  modified_base (390)..(390): a, c, t, g, unknown or other
  misc_feature (390)..(390): n is a, c, g, or t
  modified_base (422)..(422): a, c, t, g, unknown or other
  misc_feature (422)..(422): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagagcctcctgcatagtgataggaaagaccttattgtattggtacctgcagaagcaggcagtctcanatctctaatctatgtaagttccagtcgtattctcgtggatgcagtataggttcagtggcagtcgggtacngggcanagtatttacacactagaaaatcaggccgggtggacgngtagaggtagtagtttggggttattacgtgtntagtagtacgtaaggtttactttccgttcggtcggtacggttccggacgaacgggacgtaagggtagaaactcgaacgaacgtaacgtggtcgacgtcgacactac

SEQ ID NO: 327858 - DNA, 660 bp, Homo sapiens
  misc_feature: GZ8MTXP02IBH0Y.17.4.A04.1.454.CMB.2.raw
  modified_base (233)..(233): a, c, t, g, unknown or other
  misc_feature (233)..(233): n is a, c, g, or t
tcagcgtagactagcacgaccggtgctcgatttagagtagtgatcaggacttctcagttcatcttctcaccatgaggctccctgctcagctcctggggctgctaatgctctggatcctggatccagtgcggatattgtgatgacccagactccactctctctgtccgtcaccctggacagccgctcatctcctgcaagtctagtcagacgcctcctgcatagtgataggaaanacctattgtattggtacctgacaggaaggcaggccagtctccacatctacctaatctatgtaagtttccagttcgtattctccgtggtactgacctaggtaacgttcgggtttcagggttggaccgagggtccgggggtcaaagggccaaccgtagtaactttacgaactaacgtaagaaaacgttcgaacgggtaccggggtaggggacggtcgtaagggtaagggttaagtttaagggtttttagggggttttaatttaccggtagtacgtaaagttcggtaagttaaacgggttttaacgtttttacccggtttccgggttacgggttaccggtttaccgggtaccggtaaaacggggtaccggtaaagggtacgtaaacgttacgaacgtaacggtaactggtacgtacgtcggactactacg

SEQ ID NO: 327859 - DNA, 560 bp, Homo sapiens
  misc_feature: GZ8MTXP02JGSNH.17.4.A04.1.454.CMB.2.raw
  modified_base (236)..(236): a, c, t, g, unknown or other
  misc_feature (236)..(236): n is a, c, g, or t
  modified_base (340)..(340): a, c, t, g, unknown or other
  misc_feature (340)..(340): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagagcctcctgcatagtgatggaaanacctattgtattggtacctgcagaagcaggccagtctcacatctctaatctatgaatttccagtcgattctctggatgccagataggttcagtggcagcgggtnaggcacagatttcacactagaaaatcgaagccgggtgggaggcgtaggaggagttagtttgggggttttattacgtgacagtgacgtaaggttattttcccgtttccggttacggtacgtttccgggaccgtaaacgggggtaaccgtaaacggggttaggtaaaacgttaccgaaacgaacgtaaaccgtaggttacgggacttcggaccaccgtaacg

SEQ ID NO: 327860 - DNA, 602 bp, Homo sapiens
  misc_feature: GZ8MTXP02IR7NY.17.4.A04.1.454.CMB.2.raw
  modified_base (217)..(217): a, c, t, g, unknown or other
  misc_feature (217)..(217): n is a, c, g, or t
  modified_base (240)..(240): a, c, t, g, unknown or other
  misc_feature (240)..(240): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtccacccctggacacgccggcctccatctcctgcaagtctagtcagacncctcctgcatagtgataggaaanacttagtttgtattggtacctgcaaggaaggcaggcctagtcctaccacactcctacctaaatctatgtaacgtttccagtcgattctcgtggatgaccagtagttcggttcaggtcgggacagggtccggggtcaagggcacgtagtatttacaacacttaagaaaactcgaacgggtcggggtaggagcgtaggaggttagttaggttttagggtttaattacgtagtctagtagtacgttaaaggtttctttttaccgtcggttcggttacggttcggaccggtaaacggggtaaccgtaaggtacggtaaaactccgaaacgtaacgtaacgttggtacggtctacgactaacgtacg

SEQ ID NO: 327861 - DNA, 599 bp, Homo sapiens
  misc_feature: GZ8MTXP02ISZ41.17.4.A04.1.454.CMB.2.raw
  modified_base (215)..(215): a, c, t, g, unknown or other
  misc_feature (215)..(215): n is a, c, g, or t
  modified_base (414)..(414): a, c, t, g, unknown or other
  misc_feature (414)..(414): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagacncctcctgcatagtgataggaaacacttatttgtattggtacctgacaaggaaggcaggccagtctccacatctactaatctatgtaattccagtcgattctcgtggagtcgacagtattaggttcgaagtggacacggcggggtacagggcacgagtatttacaacactaagaaaactcgaacggccggggtaggaggngtaggtaaggtaagttaaggtttagggggttttaattacgtaggtactagtagtacgtaaaggtttacgttttacccgttcggtacggtacggttcggaaaccggtaaacggggaaaccgtaaagggtacgtaaaacgtacaaacgtaaccgtaaacggtggtacggactcggaccgaactaacg

SEQ ID NO: 327862 - DNA, 564 bp, Homo sapiens
  misc_feature: GZ8MTXP02JXKWV.17.4.A04.1.454.CMB.2.raw
  modified_base (180)..(180): a, c, t, g, unknown or other
  misc_feature (180)..(180): n is a, c, g, or t
  modified_base (354)..(354): a, c, t, g, unknown or other
  misc_feature (354)..(354): n is a, c, g, or t
  modified_base (358)..(358): a, c, t, g, unknown or other
  misc_feature (358)..(358): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcaccctggacngccgcctccatcctcctgcaagtctagtcagacgcctctgcatagtgataggaaagaccttattgtattggtacctgcagaaggcaggccagtctccacatctacctaatctaattcgaagttttcccaagttccgattcgtaccttgggactgcctaggctagggttcaggtntcgngcggtcgagacactagtacttactactaactagaaagtacgacggacgggtaggaggacgtagtaggtagttagttaggttagttacgtagtgagtaggtacgttacgttacgtttccgttcgttcggtacggtacggtaccgaacggtaacggtaacggtacgaacgtacgaacgtaacgtacgtacgtcgtcgtacgacactcg

SEQ ID NO: 327863 - DNA, 555 bp, Homo sapiens
  misc_feature: GZ8MTXP02JZQQ7.17.4.A04.1.454.CMB.2.raw
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtcccgtcacccctggacacgccggcctccatctcctgcaagtctagtcagacgcctctgcatagtgataggaaagtaccttatttgtattggtacctgacagaaggcaggccagtctaccacatcctacctaatctatagtaactttcagttcgattctcgtggatcgacagtagttaggtcaggtggcgaggcgggtacagggcagagtattcaactactagaaatcgaggtcggggtaggacgtcgtaggaggtagttagggtttaggggtttattacgtgtactagtagtacgttaaggtttactttccgttcggtcggtacgttcggacgaacgggacgtaaggtacgaactacgacgaacgtacgtggtcggacgtcgactacgta

SEQ ID NO: 327864 - DNA, 509 bp, Homo sapiens
  misc_feature: GZ8MTXP02HNTV5.17.4.A04.1.454.CMB.2.raw
  modified_base (236)..(236): a, c, t, g, unknown or other
  misc_feature (236)..(236): n is a, c, g, or t
  modified_base (272)..(272): a, c, t, g, unknown or other
  misc_feature (272)..(272): n is a, c, g, or t
  modified_base (433)..(433): a, c, t, g, unknown or other
  misc_feature (433)..(433): n is a, c, g, or t
  modified_base (509)..(509): a, c, t, g, unknown or other
  misc_feature (509)..(509): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagagcctcctgcatagtgatggaaanctattgtattggtactgcagagcaggccagtctcanatctctaatctatgaatttcagtcgattctccgtggagtcgacctagacgttggttcagtggccaggcgggtcaggcacgagtattacactactagaaaatcgaggccgggtggagcgtaggaggtattaggtttgggttatacgtgcatcgataaggttntttcgtcgtggtacgttcggacgtaacggaccgtaaaggtgaaactcgacgaacgacgtcgtgactcgactacgtn

SEQ ID NO: 327865 - DNA, 565 bp, Homo sapiens
  misc_feature: GZ8MTXP02HAR9S.17.4.A04.1.454.CMB.2.raw
  modified_base (285)..(285): a, c, t, g, unknown or other
  misc_feature (285)..(285): n is a, c, g, or t
  modified_base (370)..(370): a, c, t, g, unknown or other
  misc_feature (370)..(370): n is a, c, g, or t
  modified_base (427)..(427): a, c, t, g, unknown or other
  misc_feature (427)..(427): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcaccctggacagccgcctcatctcctgcaagtctagtcagacgcctctgcatagtgaataggaaagtaccttaatttgtaattcggtacctgacaaggaaggcaggcagtctccanatctactaatctatgtaactttccaagttcgattctcgtggagtcgaccaggtattagggttcaggttggccagggccggggtanaagggtccaagagtactttacaactactaagaaaatcgacggtacggggtaggaggngtaggagtagttaggtttagggtttatacgtgtacgtaagtgtacgtaaggtttacttttccgtacgtggtacgttcggacgtaaacggacgtaaggtacgaaactacgaacaagaacgttcggcgactacactactg

SEQ ID NO: 327866 - DNA, 637 bp, Homo sapiens
  misc_feature: GZ8MTXP02GZKNQ.17.4.A04.1.454.CMB.2.raw
  modified_base (277)..(277): a, c, t, g, unknown or other
  misc_feature (277)..(277): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagacctccactctctctgtccgtcacccctggacagccgcctccatctcctgcaagtctagtcagacgcctcctgcatagtgataggaaagacttattgtattggtacctgcagaggcaggcagtctcanatctctatctatagattccagtcgtattctcgtggagtcgacagtattaggttcgaggtggcgagggtcggggtacgaggacacgtagtactttacgaactaacctaagtaaaaactcggaacgggccgggggtagggacggacggtaggtaagggttaagtttaagggttttagggggttttaatttacggtaggtaccgtagttacggtacgttaacggtttaacttttcccggtttccggttacggggttaccggttaccgggtaccgggtaaacggggtaaaccggtaaagggtacggaaacgtaccgaaccgtaacggaacgttcggtacggtacgttacggaccctaccgtacg

SEQ ID NO: 327867 - DNA, 516 bp, Homo sapiens
  misc_feature: GZ8MTXP02JZO3T.17.4.A04.1.454.CMB.2.raw
  modified_base (193)..(193): a, c, t, g, unknown or other
  misc_feature (193)..(193): n is a, c, g, or t
  modified_base (228)..(228): a, c, t, g, unknown or other
  misc_feature (228)..(228): n is a, c, g, or t
  modified_base (273)..(273): a, c, t, g, unknown or other
  misc_feature (273)..(273): n is a, c, g, or t
  modified_base (316)..(316): a, c, t, g, unknown or other
  misc_feature (316)..(316): n is a, c, g, or t
  modified_base (325)..(325): a, c, t, g, unknown or other
  misc_feature (325)..(325): n is a, c, g, or t
  modified_base (351)..(351): a, c, t, g, unknown or other
  misc_feature (351)..(351): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgaccccagactccactctctctgtcccgtcacccctggacagccgcctccntctcctgcaagtctagtcagagcctcctgcatagngataggaatacctatttgtattgggtacctgcagaaggcaggccngtctccactctcctaaatctattgaagtttccagtcgatttcncctggatcncagatagggttcagtgccaggcggtnaggcacagtatttacacactagaaaatcgagcggggtgaggctgaggtatagttggggttttatactgcatgctaagttactttttccgttctagggtacgttcggaccgaaacgggaccgaaaggttaggaaactcacaacgacgtagtcggctcgtacactac

SEQ ID NO: 327868 - DNA, 556 bp, Homo sapiens
  misc_feature: GZ8MTXP02JU98Q.17.4.A04.1.454.CMB.2.raw
  modified_base (238)..(238): a, c, t, g, unknown or other
  misc_feature (238)..(238): n is a, c, g, or t
  modified_base (281)..(281): a, c, t, g, unknown or other
  misc_feature (281)..(281): n is a, c, g, or t
  modified_base (314)..(314): a, c, t, g, unknown or other
  misc_feature (314)..(314): n is a, c, g, or t
  modified_base (544)..(544): a, c, t, g, unknown or other
  misc_feature (544)..(544): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagacgcctcctgcatagtgataggaaanaccttattgtattggtacctgcagaaggcaggccagtctccanatctacctaatctatgaatttccagtcgattcncgtggatgcagataggttcaggtggcaggcgggtacagggccaacgagtactttacaacacgtaagaaaactcgaaggccggggtaggaggcgtaggaggtagttaggtttaggggttattacgtagtcgtaagtgtacgtaagttacttttccgtcgtggtacgttacggaccgaaacggggaccgtaaggtacggaaactaccgaacgtaaccgacgtaggtcggacncggtacacgtac

SEQ ID NO: 327869 - DNA, 600 bp, Homo sapiens
  misc_feature: GZ8MTXP02H6M5G.17.4.A04.1.454.CMB.2.raw
  modified_base (226)..(226): a, c, t, g, unknown or other
  misc_feature (226)..(226): n is a, c, g, or t
  modified_base (320)..(320): a, c, t, g, unknown or other
  misc_feature (320)..(320): n is a, c, g, or t
  modified_base (365)..(365): a, c, t, g, unknown or other
  misc_feature (365)..(365): n is a, c, g, or t
  modified_base (470)..(470): a, c, t, g, unknown or other
  misc_feature (470)..(470): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccgcctccatcctcctgcaagtctagtcagacgcctctgcatgngataggaaatcctattgtattggacctgcaagaagcagtcgactagtccacatctcctaactatactagtagttacgttcagtctatcccgtgngtacgtcgacgtaagtagttacgtcgaggtcgacgagggtcgganacggaccaagtaagttacttaacaaccgtaagtaaagtaaacgtcggaacggggtcgggaggaggtagaaggtaaggttaagtttagggtttagggtttactagngtactagtgtaacggttaacgttttccgtttaccgtacggtacggtaccggttccggaaaccggtaaagggaaccgtaagggtaacgaactaccgaaacgtaaccgtagtcggacggtcacgtacctacg

SEQ ID NO: 327870 - DNA, 560 bp, Homo sapiens
  misc_feature: GZ8MTXP02FFKNU.17.4.A04.1.454.CMB.2.raw
  modified_base (310)..(310): a, c, t, g, unknown or other
  misc_feature (310)..(310): n is a, c, g, or t
  modified_base (349)..(349): a, c, t, g, unknown or other
  misc_feature (349)..(349): n is a, c, g, or t
  modified_base (373)..(373): a, c, t, g, unknown or other
  misc_feature (373)..(373): n is a, c, g, or t
  modified_base (391)..(391): a, c, t, g, unknown or other
  misc_feature (391)..(391): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagagcctctgcatagtgatggaaagacctatttgattggtacctgcagaaggcaggccagtctccacatctcctaatctatgaagtttccagtcgattcncctggagtgccagactagggttcaggtggcagccgggtnagcacagtattacaacatagaaancgacggcgggtaggaggngtaggaggtagttaggtttaggggtttattacgtgtactagtagtacgtaaggtttacgtttccgttcggtacggtacggtacgggaccggtaaacgggaaccggtaaacgggtaacggtaaacgtacgtaacgaacggtaacgtcggtacggtcgtacgaccacctag

SEQ ID NO: 327871 - DNA, 551 bp, Homo sapiens
  misc_feature: GZ8MTXP02G8EW8.17.4.A04.1.454.CMB.2.raw
  modified_base (275)..(275): a, c, t, g, unknown or other
  misc_feature (275)..(275): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcaccctggacagccggcctccatctcctgcaagtctagtcagacgcctcctgcatagtgatggaaagacctattgtatggtacctgcagaagcaggcagtctccanactctactaatctatgtaagttccagtcgattctcgtggatgccagataggttcagtggacagcgggtcaggcacagtatttcaacactaagaaaatcgaggtccgggtaggaggcgtagaggtagttagtttggggttattacgtagcgtagtgtacgtaaggtttactttaccgttcggtacggtacggttacggaccgtaaacgggaccgtaaacgggtagtaaaactacgtaacgaacgtaacgtaggtacggactacggacctaactaacg

SEQ ID NO: 327872 - DNA, 614 bp, Homo sapiens
  misc_feature: GZ8MTXP02H0184.17.4.A04.1.454.CMB.2.raw
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtccacccctggacacgcccggcctccatctcctgcaagtctagtcagacgcctcctgctagtagtgaagtaggaaacgtaccttatttgttattgggtacctggacaaggaagcgaggccagtcctaccacactctacctaatctatagtaacgtttcagttcgatttctcgtaggagttcgaccgtaagtagttagggtttcgaggttggaccgaggtcgggtacaggacacgtagtactttacaactacgtaagtaaaacgtcgacgggtaccggggtaggacggtcgtagggaaggttagtttaggttttaggggtttacttacgtgacgtagtacgtacgtaaggtttacgtttccgtcggttacgtacggttcggacgtaaacggaacgaaggttacgaaactacgaacgaacgtaacgtcggcggtactcgactactacg

SEQ ID NO: 327873 - DNA, 652 bp, Homo sapiens
  misc_feature: GZ8MTXP02HKMV0.17.4.A04.1.454.CMB.2.raw
  modified_base (224)..(224): a, c, t, g, unknown or other
  misc_feature (224)..(224): n is a, c, g, or t
  modified_base (315)..(315): a, c, t, g, unknown or other
  misc_feature (315)..(315): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcaccctggacagccgcctcatctcctgcaagtctagtcagacgcctctgcatagngataggaaagtactattgtattggtactgcagaaggcacggccagtcctccactatcctactaatctatgtaacgtttccagtctatttcnccgtggacgtcgaccgtaaggtacgttaggttcgaggttcggacgaagggtccgggggtacaacgggtcaacgtaagtactttacaacgtactaagtaaaacgtcgaacgggtccgggtagggacggtcgtagggtaggtaaagtttaggttttaggggtttatttaacgtcgtacgtagttacgtaacgttaagggttttacttttcccggttacgggttacggttaaccgggtttaccggtaaccggtaaacggggtaaaccgttaaaggggtaacgtaaaacgttaccgaacgtaaacggtaacgttggtacggtcgtacgaccgtaccgtacg

SEQ ID NO: 327874 - DNA, 540 bp, Homo sapiens
  misc_feature: GZ8MTXP02IO8CU.17.4.A04.1.454.CMB.2.raw
  modified_base (274)..(274): a, c, t, g, unknown or other
  misc_feature (274)..(274): n is a, c, g, or t
  modified_base (346)..(346): a, c, t, g, unknown or other
  misc_feature (346)..(346): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagagcctcctgcatagtgatggaaagtactattgtatggtacctgcagaggcaggcagtctcantctctaatctatgtaattccagtcattctcgtggatgacagtagttaggttcaggtcggcaggccggggtanagggcacagtatttcaacactagaaaatcgaaggcggggtaggagcgtagaaggtagttagtttaggggtttatacgtgacgtagtgtacgtaagtttacgttttccgtacggtcggtacgttcggaccgtaacgggtaaaccgaaggtacgaaactacgaacgtaacgaacgtggtacgactacgcaactacg

SEQ ID NO: 327875 - DNA, 738 bp, Homo sapiens
  misc_feature: GZ8MTXP02H4N0E.17.4.A04.1.454.CMB.2.raw
tcagcgtagactagcacgaccggtgctcgatttagagtagtgatcaggacttctcagttcatcttctcaccatgaggctcctgctcagctcctggggctgctaatgctctggatccctggatccagtgcggatattgtgatgacccagactccactctctctgtccgtcacccctggacagccgcctcatctcctgcaagtctagtcagacgcctctgactatagtagataggaaacgtaccttatttgtattcggtacctgacaaggaaggcgacggccagtcctcactactctactaatctatacgttaacgttccagttcgtatttctccgtggtacgtcgaccgtaagttacggttagttccgaagggttcggaccggtacggggtaccgggggttacgaacggggtaccctaacgtaaacggttaacttttaccgaaacgttaaacgttaaaaggtaaaaaccgttcgggtaaaccgggggtcccgggggttaagggagggttacgtaaggggtaaagggtttaaaggtttaaggggtttttagggggtttaacttacggtgtaccgttagttacgggtttaacggtaaacggtttttaccgttttcccgggtttaccggttacggggttaccggttaccgggtaaaccggtaaacgggtaaaccgtaaaggggtacgtaaaacctacgaacgtaacggtacgtacggtcggacgttacggactaaccgttcg

SEQ ID NO: 327876 - DNA, 606 bp, Homo sapiens
  misc_feature: GZ8MTXP02JMIGV.17.4.A04.1.454.CMB.2.raw
  modified_base (319)..(319): a, c, t, g, unknown or other
  misc_feature (319)..(319): n is a, c, g, or t
  modified_base (379)..(379): a, c, t, g, unknown or other
  misc_feature (379)..(379): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagagcctcctgcatagtgataggaaatccttatttgtattggtacctgcagaaggcacggccagtctaccatatcctacctaatctaattgaacgtttccagtcattcncgtgggatcgcctaagtattagggttcaggtggacacggtcggggtcaagggcctaacgngtaactttcaacgtaactaagaaaactcgaggtccggggtagaggtcgtaggaggtaagtttaggtttaggggtttaattacgtagtactagtcggtacgtaacggtttcttttaccgttcggtacggggttaccggttacggaccgggtaaacggggaaccgtaaacgggttagaaaacgtccaaacgtaacgtaacgtagggtcggtacgtcggacctaactacg

SEQ ID NO: 327877 - DNA, 550 bp, Homo sapiens
  misc_feature: GZ8MTXP02GEMBV.17.4.A04.1.454.CMB.2.raw
  modified_base (350)..(350): a, c, t, g, unknown or other
  misc_feature (350)..(350): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagagcctctgcatagtgatggaaatcctatttgattggtacctgcagaagcaggccagtctccacattcctacctaatctaatgtaagtttccagtcgattctcctggatgccagattaggttcagtggctaggcgggtnagggcacagtattcacactagaaaatcgaaggccggggtggaggcgtaggaggagttagtttaggggtttattacgtgctaagtgcgtaaaggttcttttccgttcggttcggtacggttcggtaccggaaacggtaaccgtaaaggtaggaaaacgtacaacgtaaccgtaaacgtggtacggctacggaccacgtacg

SEQ ID NO: 327878 - DNA, 647 bp, Homo sapiens
  misc_feature: GZ8MTXP02G7EUC.17.4.A04.1.454.CMB.2.raw
  modified_base (278)..(278): a, c, t, g, unknown or other
  misc_feature (278)..(278): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcaccctggacagccggcctccatctcctgcaagtctagtcagagcctcctgcatagtgataggaaatacttattgtattggtacctgacagaagcaggccagtctccanatcctactaatctatgtaacgtttccagttcgtattctccgtggacgtgacctagtagttagggttcgaggtcggacgacgggcggggtacagggacacgagtatttacaacgtataagaaaatcgaacggcgggtaggagcgtaggaggtagttaggtttaggggtttaattacgtagtactagttacggtaacgttaaacggtttacgtttttcccggttaccgggttacgggttaaccggtttacccggggtaacccggtaaacgggggtaaaccgtaaaggggttaacggtaaaaccgtaccgttaaaacggaacccggtaaagttcgggtacggtaccgttacggacccgtaaacccgttaacg

SEQ ID NO: 327879 - DNA, 554 bp, Homo sapiens
  misc_feature: GZ8MTXP02IOUNB.17.4.A04.1.454.CMB.2.raw
  modified_base (252)..(253): a, c, t, g, unknown or other
  misc_feature (252)..(253): n is a, c, g, or t
  modified_base (260)..(260): a, c, t, g, unknown or other
  misc_feature (260)..(260): n is a, c, g, or t
  modified_base (344)..(344): a, c, t, g, unknown or other
  misc_feature (344)..(344): n is a, c, g, or t
  modified_base (384)..(384): a, c, t, g, unknown or other
  misc_feature (384)..(384): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagagcctcctgcatagtgatgaaagtctattgtattggtacnncagaagnagcatctcacatctactaatctagtgtaacttcagtcattctctggatgaccagtattggtcagtggcaggcgggtcagggcanagtattcaacataagaaaatacgacggacgggagggaggngtaggaaggtaagttagtttagggtttagtttacgtagatagtagtacgtaaggttactttaccgtttcgttacggtacggttacggtacggaacggtaaaccggaaacggtaaggttaaactaacgtaactaaccgaacgtaacgttacggtacgtacgtactaactac

SEQ ID NO: 327880 - DNA, 595 bp, Homo sapiens
  misc_feature: GZ8MTXP02HMOXT.17.4.A04.1.454.CMB.2.raw
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccgcctccatctcctgcaagtctagtcagacgcctcctgcatagtgatggaaagacctattgtattggtacctgcagaaggcaggccagtctcacatctactaatctatgtaatttccagtcgtatttctccgtgggagtcgacctagtagttagggttcaaggttggcgagggtcggggtacagggcaacgtaagtatttaccgaactaactaagaaaactcgaagggtcccggggtagggacggtcgtagggaaggttaagttaagggtttttagggggtttaattacgtgtactagtgtacgttaaggttacttttccgttacggtcggtacggtttcggacgtaaacgggaccgtaaagggtacgaaactcgaacgtaacgtaacgtggtcggactcggacctactacg

SEQ ID NO: 327881 - DNA, 575 bp, Homo sapiens
  misc_feature: GZ8MTXP02GZ7PA.17.4.A04.1.454.CMB.2.raw
  modified_base (236)..(236): a, c, t, g, unknown or other
  misc_feature (236)..(236): n is a, c, g, or t
  modified_base (351)..(351): a, c, t, g, unknown or other
  misc_feature (351)..(351): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcaccctggacagccggcctccatctcctgcaagtctagtcagagcctcctgcatagtgataggaaanccttatttgtaattggtacctgcagaagcaggccagtctccacatcctactaatctatgtaagtttccagtcgatttctcctggagtgcagtatggttcagtggcaggcggggtnagggcacagtattcaacactaagaaaactcaggccgggtaggaggacgtaggaggtagttagtttggggtttattacgtgctagtgtactaaggttacttttaccgtttacggtaggtaccggttacgggtacccggtaaacggggtaacccgaaagggttacggtaaaacgttaccgaacgaacggtaaccgttaggtacgggtctacggtaccgacctaacg

SEQ ID NO: 327882 - DNA, 612 bp, Homo sapiens
  misc_feature: GZ8MTXP02GAYTM.17.4.A04.1.454.CMB.2.raw
  modified_base (236)..(236): a, c, t, g, unknown or other
  misc_feature (236)..(236): n is a, c, g, or t
  modified_base (278)..(278): a, c, t, g, unknown or other
  misc_feature (278)..(278): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagagcctcctgcatagtgatggaaanacctatttgtattggacctgacagaaggcaggccagtctcanatctacctaatctatgaagtttccagtcattctcgtgagtgaccagataggttcagtggacgaggcgggtacagggcacagtatttacaacactaagaaaatcgaaggccggggtaggaggcgtaggaaggtagttaaggtttaggggttttaacttagtagacgtagttagtacgtaaaggtttactttttaccgttaccggttacggtaaccggttaccgggaaccggtaaacggggtaaacccgtaaaacgggtaaggtaaaacgtaccgtaaaacgaaaccggtaaaccgttacgggttaggaccgttacggacccgtaacccgttaacg

SEQ ID NO: 327883 - DNA, 550 bp, Homo sapiens
  misc_feature: GZ8MTXP02I4XLC.17.4.A04.1.454.CMB.2.raw
  modified_base (235)..(235): a, c, t, g, unknown or other
  misc_feature (235)..(235): n is a, c, g, or t
  modified_base (277)..(277): a, c, t, g, unknown or other
  misc_feature (277)..(277): n is a, c, g, or t
  modified_base (309)..(309): a, c, t, g, unknown or other
  misc_feature (309)..(309): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccgcctccatctcctgcaagtctagtcagagcctcctgcatagtgatggaaancctattgtattggtacctgacagaaggcaggccagtctccanatctctaatctatgtaatttccagtcgattcncgtggagtgaccagtagttaggtcagtggctaggcgggtcagggcacgagtattacacactagaaaatcgaaggtccgggtaggagcgtaggaggtagttagtttaggggtttattacgtagcgtagtgtacgtaaggttactttccgttacggttcgggtacgttcggtacgtaaacgggaaccgtaaggtacggaaactacgaacgaacgtaacgtggtacggcgtacgacgtactacg

SEQ ID NO: 327884 - DNA, 546 bp, Homo sapiens
  misc_feature: GZ8MTXP02G74WZ.17.4.A04.1.454.CMB.2.raw
  modified_base (232)..(232): a, c, t, g, unknown or other
  misc_feature (232)..(232): n is a, c, g, or t
  modified_base (273)..(273): a, c, t, g, unknown or other
  misc_feature (273)..(273): n is a, c, g, or t
  modified_base (307)..(307): a, c, t, g, unknown or other
  misc_feature (307)..(307): n is a, c, g, or t
  modified_base (354)..(354): a, c, t, g, unknown or other
  misc_feature (354)..(354): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcaccctggacagccgctcatctctgcaagtctagtcagagcctcctgcatagtgataggaaanccttattgtattggtacctgcagaggcaggccagtctccanatctactaatctatgtaagtttccagtcgattcncgtggatgacctagattaggttcaggtggcagcgggtacagggtcanagtattacacactagaaatcgaggtccggggtaggacggtcgtaggaggtagttacggtttaggggtttattacgtgactagtgacgtaaggttactttccgtcggtcggtaccggttcggacgtaaacgggaccgtaaaggtacgaaactacgaacgaacgtaacgtggtacggtcgtacgcctacgtacg

SEQ ID NO: 327885 - DNA, 577 bp, Homo sapiens
  misc_feature: GZ8MTXP02JRLPA.17.4.A04.1.454.CMB.2.raw
  modified_base (323)..(323): a, c, t, g, unknown or other
  misc_feature (323)..(323): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagacgcctcctgcatagtgagtaggaaataccttatttgtattggtaccctggcagaaggcaggccagtctccacatctacctaatctatgtaacgtttccagttcgatttcncgtggagtcgacagtagttaggttcaggtcggcaggcgggtacaggcacgtagtatttacacactagaaatcgaggcgggtggaggcgtaggaggtagtagtttggggtttaattacgtagcgtagtagtacgtaacggtttacgttttccgttacgttcggtaccggtttacggaccggtaaacggggtaaccgtaaagggtacggtaaacgtacgtaacgaacgtaacgtacggtcggtcgacgcgactacg

SEQ ID NO: 327886 - DNA, 572 bp, Homo sapiens
  misc_feature: GZ8MTXP02ISSLA.17.4.A04.1.454.CMB.2.raw
  modified_base (280)..(280): a, c, t, g, unknown or other
  misc_feature (280)..(280): n is a, c, g, or t
  modified_base (355)..(355): a, c, t, g, unknown or other
  misc_feature (355)..(355): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagagcctctgcatagtgatggaaagacctattgtattggtacctgcagaacgccaggccagcctccacgnggtcctgatctatgaacgtttccaacggtttctcgtggacgtgaccagtattagggttcaggtggcaggcgggtnaggggacagtattcacactagaaatcgaaggccgggtaggaggacgtaggaggtagttaggtttaggggtttattacgtgctagtagacgtaaaggtataactacgtacgttaccgtacgtacgttttcggaccgtaacggggtaaccgaaacggtacgtaggacgtaacgtaacgaaacgtaacgtaggttacggactaaccgacctaactttccg

SEQ ID NO: 327887 - DNA, 535 bp, Homo sapiens
  misc_feature: GZ8MTXP02HCBI4.17.4.A04.1.454.CMB.2.raw
  modified_base (312)..(312): a, c, t, g, unknown or other
  misc_feature (312)..(312): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagagcctcctgcatagtgataggaaagtcctatttgtattggtacctgcagaagcaggccagtctcacatctacctaatctatgtaattccagtcgatttcncgtggatcgccagtagttaggttcaggtggcgaggcgggtacaggcacgagtacttacacacgtagaaaatcgaggcgggtgaggtcgtaggagtagttaggtttaggggtttatacgtgactagtgtacgtaaggtttctttaccgtcggtacggtacgttcggacgaacgggtacaagggtagaactcgaacgaacgtaacgtggtcgctacgacacgtac

SEQ ID NO: 327888 - DNA, 599 bp, Homo sapiens
  misc_feature: GZ8MTXP02IFQA2.17.4.A04.1.454.CMB.2.raw
  modified_base (238)..(238): a, c, t, g, unknown or other
  misc_feature (238)..(238): n is a, c, g, or t
  modified_base (270)..(270): a, c, t, g, unknown or other
  misc_feature (270)..(270): n is a, c, g, or t
  modified_base (273)..(273): a, c, t, g, unknown or other
  misc_feature (273)..(273): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtccacccctggacagccggcctccatctcctgcaagtctagtcagacgcctcctgcatagtgatggaaanctattgtatgtactgcagaggcaggccagtcncanatctctaatctatgtaagttccagtcgtattctcgtaggagtcgacctaagtagttacggtttcaggttggccgtaggtccgggggtacagggaccaacgtagtactttacaactaactaagtaaaactccgaaggtcccggggtagggacggtacgtaggtaggttaaggtttaggtttagggtttagttacgtagtacgtagtagtacgttacgtttacgtttaccgttcgttacggtacggttacggtacggtaacggtaacggtaacggtacgtaacgtacgtaacgtaacgtacgtacgtacgtacgtacgtactactacg

SEQ ID NO: 327889 - DNA, 546 bp, Homo sapiens
  misc_feature: GZ8MTXP02IXXDZ.17.4.A04.1.454.CMB.2.raw
  modified_base (277)..(277): a, c, t, g, unknown or other
  misc_feature (277)..(277): n is a, c, g, or t
  modified_base (344)..(344): a, c, t, g, unknown or other
  misc_feature (344)..(344): n is a, c, g, or t
  modified_base (389)..(389): a, c, t, g, unknown or other
  misc_feature (389)..(389): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagagcctcctgcatagtgataggaaagacctattgtattggtacctgcagaaggcaggcagtctcanatctctaatctatgtattccagtcgattctcctggatgctagattaggttcagtggcaggcgggtanagggacacgagtattcaacactagaaaatcgaggcgggtaggagngtaggaaggtagttaggtttaggggtttattacgtgactagtgtacgtaagtttacgttttccgttcggtcggtacggttcggaccgtaaacggggtaccgtaaaggttaggaaaacttcgaaacgaacgtaaacgtggtacgcgtacgacacttac

SEQ ID NO: 327890 - DNA, 584 bp, Homo sapiens
  misc_feature: GZ8MTXP02FU7Y2.17.4.A04.1.454.CMB.2.raw
  modified_base (288)..(288): a, c, t, g, unknown or other
  misc_feature (288)..(288): n is a, c, g, or t
  modified_base (424)..(424): a, c, t, g, unknown or other
  misc_feature (424)..(424): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctcgtccgtccaccccgtggaccagcccggcctccatctcctgcaagtctagcagacgcctcctgcatagtgataggaaatccttatttgtattggtacctgacagaaggcaggccagtctccactntcctacctaatctatgtaattccagtcgtattctcgtggactgacctagtagtacggttcagggtggcgaggccggggtacacggcaactagtattcgaacacgttaagaaaactcgagggtccgggtagggacgngtaggtaggtagttaggtttagggtttattacgtggactagtcgtacgttaaagttcgttttccgtcggtacggttacggtacggtaccggtaaacgggaaccgtaaagggtacgaaaactccgaaacgaacgtaacgtcggtcggactcaccacttacg

SEQ ID NO: 327891 - DNA, 577 bp, Homo sapiens
  misc_feature: GZ8MTXP02HW9HC.17.4.A04.1.454.CMB.2.raw
  modified_base (213)..(213): a, c, t, g, unknown or other
  misc_feature (213)..(213): n is a, c, g, or t
  modified_base (218)..(218): a, c, t, g, unknown or other
  misc_feature (218)..(218): n is a, c, g, or t
  modified_base (312)..(312): a, c, t, g, unknown or other
  misc_feature (312)..(312): n is a, c, g, or t
  modified_base (337)..(337): a, c, t, g, unknown or other
  misc_feature (337)..(337): n is a, c, g, or t
  modified_base (345)..(345): a, c, t, g, unknown or other
  misc_feature (345)..(345): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcaccctggacagccgcctccatctcctgcaagtctagtcagacncctcngcatagtgatggaaatccttattgtattggtacctgacagaaggcaggccagtcctccacatctacctaatctatgtaatttccagtcgattcncgtggatgcagtattaggtcagtgnaggcggtnagcactagtacttacaactactagaaaactcgaacggtaccggggtaggaggacgtagggtaagtagttaaggttttaggggtttaatacggtgtacgtaagtcggtacgtaaaggtttaccttttccggtttaccggtacgggttaccggttacccgggacggtaaacggtaaccggtaaggtaacggaaacttacgaacgaacgtaacgtggtcggactcgacaaccgtc

SEQ ID NO: 327892 - DNA, 520 bp, Homo sapiens
  misc_feature: GZ8MTXP02FEG7A.17.4.A04.1.454.CMB.2.raw
  modified_base (214)..(214): a, c, t, g, unknown or other
  misc_feature (214)..(214): n is a, c, g, or t
  modified_base (236)..(236): a, c, t, g, unknown or other
  misc_feature (236)..(236): n is a, c, g, or t
  modified_base (273)..(273): a, c, t, g, unknown or other
  misc_feature (273)..(273): n is a, c, g, or t
  modified_base (277)..(277): a, c, t, g, unknown or other
  misc_feature (277)..(277): n is a, c, g, or t
  modified_base (312)..(312): a, c, t, g, unknown or other
  misc_feature (312)..(312): n is a, c, g, or t
  modified_base (349)..(349): a, c, t, g, unknown or other
  misc_feature (349)..(349): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagancctcctgcatagtgatggaaancctatttgattggtacctgcagaaggcaggccagtcnccanatctctaatctatgaagttttcccagtcgatttcncctggatgccagatagggttcaggtggcaggcgggtnaggcacagtatttcaacactagaaaatcgagccggggtggaggctaggaggtatagtttggggtttattaacgtgcagtgacgtaagttatttccttcggtggtacgttcggaccgaaacgggaccgaaaggtaggaaactacaacaacgaactgtacgcgtcgacactac

SEQ ID NO: 327893 - DNA, 536 bp, Homo sapiens
  misc_feature: GZ8MTXP02IR7DI.17.4.A04.1.454.CMB.2.raw
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctatccgtcacccctggacagccggcctccatctcctgcaagtctagtcagagcctcctgcatagtgatggaaagtactattgtattggtacctgcagaggcaggccagtctcacatctctaatctatgtaatttccagtcattctctggatcgccagattaggttcagtggcagcgggtcagggcacagatttcacactagaaaatccgaggccggtggagctagaggtattagtttgggttattacgtgtctagtgcgtaaaggttcttttaccgtacggtgggtacgttccgggaccgaacggggtaaccaagggttacggaaaacttcgaaccgtaacgtaacgtggttacggcttcggacctaccgtacg

SEQ ID NO: 327894 - DNA, 573 bp, Homo sapiens
  misc_feature: GZ8MTXP02HKWQE.17.4.A04.1.454.CMB.2.raw
  modified_base (275)..(275): a, c, t, g, unknown or other
  misc_feature (275)..(275): n is a, c, g, or t
  modified_base (286)..(286): a, c, t, g, unknown or other
  misc_feature (286)..(286): n is a, c, g, or t
  modified_base (308)..(308): a, c, t, g, unknown or other
  misc_feature (308)..(308): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcaccctggacagccgcctccatctcctgcaagtatagtcagacgcctcctgcatagtgatggaaatcctattgtattggtacctgcagaagccaggccagcctcanaggtcctgatntatagtaactttccaaccgttntcgtggactgaccagattaggtcaggtggcaggcgggtcaggggacagtacttacactactagaaaactgaacggcgggtggaggcgtaggaggtagttagggtttaggggtttaattcgttagagtagttagaacgtaaagtataacgtacgtccttaccgtacttacggttttacgggacgtaagggggaacctaggtacgttacgggaagtaacgtaacggaaaaccgtacgtaggttacggacgttcgaccgtaaccgtcg

SEQ ID NO: 327895 - DNA, 552 bp, Homo sapiens
  misc_feature: GZ8MTXP02GAB37.17.4.A04.1.454.CMB.2.raw
  modified_base (312)..(312): a, c, t, g, unknown or other
  misc_feature (312)..(312): n is a, c, g, or t
  modified_base (348)..(348): a, c, t, g, unknown or other
  misc_feature (348)..(348): n is a, c, g, or t
tcagcgtagactagcacgaccggtgctcgatttagagtagtgatcaggacttctcagttcatcttctcaccatgaggctccctgctcagctcctggggctgctaatgctctggatccctggatccagtgcggatattgtgatgacccagactccactctctctgtccgtcacccctggacagccggcctccatctcctgcaagtctagtcagagcctctgcatagtgataggaaagaccttatttgtattggtacctgcagaaggcaggccagtctcacatctcctaatctatgaagtttccagtcgattcnctggatgcagacttagggttcagtggcaggcgggtnagggcacgagtatttcaacactagaaaactcgaagggccggggtggacggcgtaggaaggtagttaggttggggttttaattacgtgactagtgtacgtaaggtttactttccgttcggtaggtacgttcggacgaacgggaaccgtaaagggtacggaaactacgaacgaacgtaaacgtggtacggactacggaccactacg

SEQ ID NO: 327896 - DNA, 691 bp, Homo sapiens
  misc_feature: GZ8MTXP02IKS6I.17.4.A04.1.454.CMB.2.raw
  modified_base (358)..(358): a, c, t, g, unknown or other
  misc_feature (358)..(358): n is a, c, g, or t
tcagcgtagactagcacgaccggtgctcgatttagagtagtgatcaggacttctcagttcatcttctcaccatgaggctccctgctcagctcctggggctgctaatgctctggatccctggatccaatgcggatattgtgatgacccagactccactctctctgtccgtcaccctggacagccggcctccatctctgcaagtctagtcagacgcctcctgcatagtgaatggaaagtactattgtattgtactgacagagcaggcagtctcacatctactaatctaatgtaagtttccagtcgattctcgtaggacgtgacgagtagttaggttcgaaggtcggcgtaggccggggtnaaggcaacagtaactttcgaactacgtaaagtaaaaactcggaaacgggtccggggtagggaaacgggtccgtaagggtaaacgggttagtttaaaggggtttttagggggttttaaaatttaccggtaagtacgtaaagttacggtaaacggtttaaaacggtttcctttttacccggttaccgggttacgggttaaccgggttttaaccggggaacccgggtaaaacgggggttaaaaacccggtaaagggttaaaacgggtaaaacgttaacgtaaaaccgtaaacggtaaaacgttcgggtacggtactcggtaactaaaccgtttacg
